United States Patent 8,781,750 (CELL-TYPE-SPECIFIC PATTERNS OF GENE EXPRESSION) - sequence listing, part 46

SEQ ID NO: 37910 - DNA, 279818 bp, Homo sapiens
cccccgagggacatgagagaagaggagcggcgctcaggtaagctggattttgcggtcggaattcgcgtagaaacgaaaacttctggaaggggcttagccccgagccccggaggcggacaagctgagcctcctggctgcaccctttggaggctgctggttgcagacgccgtcgtctcccaagggcggctgtcaccgcgtgcgtcggtcagaccaggccgcggtgccctcggcatccccgcgtcccggcggctgtatccggctcctccccacgaccgaggtcccgggcaccgcgcctctccctccggacgctctgcgcgacgtcgtcccagttctcatcagcatcgagggcagtccgcggtcattttataaacgtcttagtgtcgcaaccgttttcacttttactattttcaatgtttgcaacggttttcaatgaggctggaaaaatatcacttctcgctaaaagcgaccccgagttaggaggagcgcgcacccccgcggctccccctcccacactttccctcccctgaccccctctcctcccctctggtccttcccttgctcctcgcccctccagtagtcgcgtgctgggttcctttcctgctggggccggactctctcctccggccgtcccagcctctgctcctccgcctccctcctcctcttcctcctcctccgcctcctcctcttcctcctcctcttcctcccggagccgccagccgcgtcctaaacccgagcagggcgcgtagtgtccaaacctgcccgcgcggcccgcgctcttggccccgagggcgcgcgcacggacacgcgagcacacccacacccacgcgcacacggacacgcgcgcactcgaagactcccgcgcgctcgcacccacgcgcacctggccacgcgcgtgcattcccgcccacgcgtccctgccccgcccccggcgcgcactccgggttcgcaagtcgcgcgtcggggcggccgccctgctccgcgattggcgggagccggagcctccctgaacccggcgcccacaccatgggctgagcccgtcggcgccgagggagttagtgcgacccggctcggcgcgcacggccaaggcacgcgcgctggcacacgcgggcgcggacacgcgcggacacacacgtgcgggacacgccctcccccgacggcggcgctaacctctcggtaagtccagcgccccacgcgacctgcccggctcccacgctggctacagcggctgcggggacggggaggaaggcagcggggtggccctaggggctcactctgcagggctcttccgacggcgccgggacaggtggggcgtccagcgccgggagggacggctcgccagtgcggggtcccagggaggcgcgtgcagtcgggtgcggatggagaggagggggcaccccgaaattgacaagggccaggagagcacaccgcggggacttcatctggggccccgaccaagaggttatttgtccttgtctggagtggaaatcagggttgaactaaaaaagctgacgcttggcctaaagtagggaccaggtttgaggctgggttgtcactgtccgctgggtcctgatggtggaatgacccccgacggcgccttcccgcacaccccgcaacaccggctctgggaccagctctcagcgccaggagcggtccctttcctttcccactctcagtctcagtcttttcacctttccattcttcagcctgcagctgttaagtttatttgcctccagtttaccaccctaattgcaaaacttggcatgttaaaaaaaatatagtctgtattttatcagctagccttacctggtttctgtctgaaatacatcgtccgtttattgctatggtatgttgcatagatgcatagaggcattaattatcttttaagtacaggacaaattctgttattaatagcagactacactgcgcaataaaatggataaacaatttcaatgaggatgtggatttaatacaactcatcgttaatctaaagatagtttcctttatctttcaaaataacatattcgtatgtgctacaggtttcactctgtacatgtctctatagcttttgtagttcagaaaactttcaatgtgagtaaaaatacattttattcttccctgggtgacatacataggacacagagtttatttacctttgggactatttttgactgttttccattctctccaagtagtttagagcccctgaagggagaactgtcacagtcccaaagttaacccttgctccgctggcattggctggtgcccgctcccggggcaggccagagctcatagccttcatccacaggaggatcaggcaacagacgttgcgaagaacccaaccatgtaaattaattcaccatgtgtcaaattattaataagctaattacaccattgaaattataattctagcagaaacggtgagctatgtaaacttgtggctaatatatcaagttttacaattctcaagaaaggctttagaagagctacacacatcacaaatgctatttgccatttggtaatcctagcttcggtttgggtcaatggcttttggaaagtacactgaattagcaaatgggtaatccgtctcaagatatttgttaaggaatatataattccagtagcacttataattccagtttcttctcttttgtaacattttataattacttcattctatttaaaaaaatttagagtagaattgtagtacatgatttcacgtttatctgttatttcatgaggaattattggtgatttaatctttagctaaaatttagaaaattagcatttaccattgaagggattgtgtgaggggctgcattcacacctgtatataaacattcccccctccacgttccacgttttgcttttatattaaagaaaaaccttgttgagtttttaatcttataaaatcagatattttatttgtggtaagacctaagatcccaatggaataccagatacataagtaagaaggaaagcatctctgaaagacgtcagaaggaatgtgtaactcacatactattctacaatgttatacgttatgtatcttttaaatgcatctcacattgtaagtagggtaataggaaactttcaacactttttttttctaaaagtaatattagtttttatttttatcttgctatctttaaacaaaaaagaaataaaagggggaatttatttcttctcaaaacagaagagctaatgtttctggaatcgtttcctattcccaggcaaaaaccgatagcaagtcagtcccggtcataggatctggagtggtgggaagacattgtcatagtgaataaatgtctgatgcctgttatttcatagaactccattgagaaggtgtcgacacagagccacctacgtttctaatgagacttatggagcctgggaagcagtttggtcaaggtggcaaaatcccagctctgtgaggcatcaggtcacttctcagtttaagttgacagctgatctctctgaatgcaggtctctttttgtcacctctttgcttctttaccccttgcgtctgagcagttttccagagagcaggagtatggcaaaggagttcttttttccttccccagtgtgtaaggttacttgggctttcccagggagcatggtccttcacaatacagctattgtttaatgttctacaccttgaatttgaaccttagcagcaacatttgtaagaaaaataggctgatgtaacagggacgttcagatctttggggcacagtttccgatgattatggtacttagtggcagtggtgtgagtagggctttttgaaaactctgaaaatcactgcggtatttggggatgctcatgcttggcagtgaccagccacccctccatattgttgctgttccttgcatgatagcattctccctggtatttcccacactcttattaggggtcagttaattagttgtccattatgcattgtcagtgtacggacctctcacaatgattgattgaaagcagttattttgtaaataaacaacagcgggagttttccaatggcttttccaatggctgggctgtcacccaaaccagttcttcaacatagctaaaaaagttaaaagttaaagttaaaaggggcatctttcccttttaactttatcttttatttaaaacattttcatattagaaagaggcttgaatgcttcatgtttgtaacattgcaaagtctagtgaaggtagtgaaggagggtgagctaaaattactttgctaaatttaagtataagtaaaatgtagacaaaaccaagaaattaaagggtgcatctaaaaatggagcgctggatctaagttttagatttaaactaacttttaagttctcctatttttagggtcgcatgtcataatctgggagaccctgattgcgtatgagaaacagtaattttacaatgaaagtaaggggtttggctatcttgactcagtgcgtgttcaggagaatgtgcaaaggaagtttcattatgtgactctgtcctattcagaatggctatatgagacaatggaaatatccttcaagtatgtaaaataggccatttgaattaatttatcacctctttttttttgttattatcccagagaaatagacatcagatgtgatctgggacaaatctttagtgtgtctaaaggtttttaaaacctagatttgtagttgcttccttttaaagcctaacctatgattttgaattgttttagtgggaatgagatttttgtacctgcttttgtcttatatgtgctcccttttaaggataacattattgcagtaattattacccctgcaaaacatactcgggggggaaaagctgtctctctaggaaataggaaagaaaacaggcatatatagaatgacttttaaaaaataggaaacccttattttcacttgatgtcagcattcagcaaaagttcccacatgttcatttgaaagtgtagaaatgcatttgaacctcagttttgagagtaggggagcaaaggagcgaagccttatttagtgaagtactatcgtcctatttccattaagtgattctctgttattggtagaaagattaattttctctctaactgggtggaaagagtggctatgcattcttggggctcactaaagtacttaaagttggaaagtaaaagaaagactaaattggagcgtgcacatttttctgcacgcctggcagggaggtttgtgtgactatcttaaggaaatattagcttgtgcaccgtcagaagctgcatcctggaatcagattagctggtgttgtgaatctccatctgaactaagatggacagtaagagaatcccaatatcttagtaaatctgttacttacctattgccttagtttaataaattgattgaaattggcaatgggaacgtgctgttccttcttggtctacagatgtgagttcctgaaatccaggcagcccttgatgtctcgatggcccaatgacatgggacaagctctgcagtgtcctttcatgggtcctgtcactggagctttccatctgtaggggctgctgccagctttggagcctgaacctctctgccctccctggaacccccctccagccagaaacccctttgtaatattcctctctttcttccacagacccttgcctgctgctggggcctctgcaggggcagtggtttctcatcacgtgtgggttggcggggggcgcggtgaagagtaggggagggagagagccctggcctctggggaccttaaaactgtatttcatggaaagcctgttttccaaggcaggcagattctgcagtactacctgcaattcctcccatttggcctgttcaccaaataatttgagggggcagagctgggtaccagcctttacttagagctgtgcttctgttgaaaagtggggcccaagtttgtattaactaatctgggaactggatgctgaggtagagtctgttggtcatgttgttgtcccccaaaacttcacttcttaaaaccatgacagtttcatggttacagtgacagtgctgcttacattttaaaaatccacactcaagcctcaataagcctgaagggaatttggcctgattaaatggttctttttagttgttcgtagtcagatgtcacccctcacacacaattaatttgttcggagccaagtgcgttccacacacattgctaaagggtgagaagaggggatagcaggtgaatctcctagcaatcaagctaattatccatttgcaatgtatggtgggagatgctgaatgctagtgcaatgctagcattgcattgtgttcttaaaatgaggactcttgggagaattgggaagcttaggcacaggcaaagcaggaatttcagaaacacgggatacctccctggacccacctctgtgtgcaatgaaggcttggaattctgcttgacatgagagtgaacgggggtctcagggttcagaggaaggactgaaagaagctattatgagggccctgtgggaggaagagggggtgactgtggcactacttaggaaggggaaactttagacctcagcactgaagaaggtgcatttcaggatttttgcatgggaaatgcagagatctaagcagagtataaataataagtgaaggatgtactagcaaaatgaaatgttttgaaacagaaaccactcacatttacaatctcaacataaaactttttaattaaatgtatcagaaagctgagatttcttttattaggaaatgaggtaaaaacattttgaaaagaaaccaagtgctaattgagaaacattctaagatttcatatgttgaatggattctcattaaaattatacccaacctcacaaagctgatgtgagcctgctgccagatttacaaatctgggtctataattgcacaaagtttaaacttgccttgtgcaaggcttgctttttctgcagttcaagatacagcagcaagaggacagaataagcaaaagtggaggaaaaatttgcttcttcagtattgaaaagtactttctagtctatttgaccccgacagtaaaacttacttcactacagagttttaaaatagaaataatgacagtaaaaatcaaatctagggagtcttctggagaagagatgttagatcagcatattattagtatttatcccaaattctgaaaccttacctaaaggccctgccattagaacagagagggatattattgattactacttgaggtatcaaagtaaaaggattttatttatgtatttatttatttagagatggagccttgctctgttgcccaggctggagtgcaatggcacattcttggctcactgcagcctccaccgcctgggtgcaaatgattctcctgcctcagcctcccgagtagctgggattacaggcacctgccaacaggcctgggtaatttttgtagtagagacaggatttcgccacattggccaggctggtctcaaactcctgacctcaggtgatctgcccgcctcgtccttccaaagtgctgggattacaggcgtgagccactgcgcccagccagtaaaaggattttatagatgaaatagtatcagttctgaagatcgaatatctcttaatgaaactgaatatatttttacagttttctaaggcttgtaaatataagtgattagacagaatgtcccacaagggcagtttcttctaagtaccccatagccaaattgtaaaaccaaaggtaagtcaataaaatcatttcataagtatgtgtaacccacagtaagggctgtatttgtttgtacattacgagcacatttgtaaatgcatttagcatcaatataaactttttctttgcaaaattaagcattacattgtattaattgttctttatgggtcttaagcaacgtgaaaatacatttcttaattaaaatatattgagcatctattaaatgagagcactgtcccaaacaagaggtgggagcataagtcatacagggactgttaagacacgggacacgtctagagattagacgaacaactgcaaatttagtgggagaagccagaacattccgctatggagcccgcctatccacctgtctgtctgactgcagcaattagtggcatgcttgaatttttctctcttccatgagttgtgttaacaggtaaacaaaactaccaccctttttactttaaatagctaagtttagctgaagagaggagcatcccctcttgcaaggacactctaaatgcggtgtccttaggataaatacctacaggtggaaattaatacaggacaagtggaatgcctgagaattcagggaatgctgagtaggcagagatcagcgggcagtcagatttgactcaaggtgagaagatacaggactccatccacagagggggtgctccggatcctgggaaaggcacgtgcaaaggaagggaggctagaagctacagactgtgtggtggaaggcaagctgtccatttagtccatgtttttgccttatgttctgtgtaagacttcatgcaagacactatgcagaagacttgcacagtgccttcagggaggcaaaatccagaaagaggatgaatccgcatgctatggaatctagaaagggaggtgagcaagaatgccatggaattggggcagacattcacaccacagagtctagaaaggaggggaacattcacatcgtggaatctagaaagtgggcgaatgtgcatgccgtggaatctagaatctaggcggtgaatgcgaatgccgtgcaatctggaaagtgggtgaacatacttgccatagaatctagaaaaggggtgaatgcttgtgtcatgaaatctagaacgggggtgaatgtgcacatcatgaaatctcgaaggagatgagttcacacaccaacaagagtggcatcctcagtgggaccacctggttgaactgggccagcatggcagtgaacagggctctagactgtatggcaatggaggagatgttcccgagcagggagacagcctcgtgcaatacactgggtttgctgtagggccgttcttgggcatgcttgctatcacacaggtccttctttcttatggaatcattggaggatttcatttttagccttagcatcaggagtcattgtctgagcatttggttggatttcattatttggagacgtgtgaatgacccaactccagcagatatgtgagaccctgaggcctgcctggcgggccattgcattcctagctcgagtttatgttcttacccttgtttctctttagcttcatctttattttttattttgcttctgaattttaaacaaccttgtcatattgcatatatccttgtagaccactttgagtccctttttgggaacaaggtagagtataaataacataaaatagaatcatgcaatccaaaagcaatctacaccattccataggaagatcagaggatcagagcatgctacccggaggctgaggcccttgagctgtgccatggcgtgttggatctggattggcgggaatggtagagatagcagtgggcgggagggtggaggagtcaggcctgctggtgtgtttggagggtggaagtgttacctgggagtgggtcacacagtgtggaaactgaccaaatcctctggagtgttggagggatcagaccagacacctacttcaatatctcaggtgtaaagttaagaggtagggaagaaagcagtcttacataagggaagggagaggtgtgatgttgtggaaggtggcaggtgacattcactcaccagatggtatagccacaggagacactttgccaggactgtcttcactgtggctctttgcaggaggtgctctaattgtcctcattttccagaatagcagtgaggctcaggagtgctgagcaccttgcctggagtcacacagtagtgggaaccagggcagcatcagaaccaggcaggcggatgctgagatccacccatgggactctgctgtgtgtagttatcttggtcagagtggcgggcctgttatggaagtgaccggaagggagcgagtgacgtggaggcagagtccgtgtaaggtcctggcagtgctgggcaaaggaaatagaacatgaacttcaagggtagttttaaatcttccagtagccaaattaaaaaagacagggacaggtggaattaattttaataatgtaatttatgtaacacatgctgaaaatactaccatttcaaatgtaatcagtgtaaaatatggatgagatatttgactttattttttttctatatgaaatcttcaaaatccattgtgtagtgtatatttacagcacgtctccatctgggctggtcacatttcaagggctccatagtcacatgtggctagtggccaccatgccgaatagtgcaggtctagaatgtttagcttaggaattcaaatttaatataatgagcaaccgcaacatctattatgtctcttggccacaggagtagaagttttgtgaccttatgtcactaaggaaccagatatgatagcaatagaaaattgaatgccagcgtgacatgttcggtactagatctgcagtttttacattggagggaaaaatgtatgtataatttcctgttgagtcacttcatgcttttaaagggtaaaataaaatactgaatttcaggccaaaactctgtgtgccagctaacaaatagtgcggcttttgccggaatcatgctgcgacaactccaggcataaaaatgctatttgaatatcctctatttaaagataattccagcttgatgacaaatttcttattttgcatgtttcttgagaataatacaattgattattttgaagaacggcattcttaaagtgctagaatcccagaggaagaaagcacatcaactaaatgtattgctatagaattaacctttacaaggacatattcacactatttgatcatgacaggttgcacataacacaggcttttcccttcgtttgtgatactgaagcttatggaaaagtcttctgaagtcaatccacagtgcttacatgccatttgttattatcagtgtgctatatgtgtactatacgtgatgcgtcattgagtaaccttctacccttttaactatgccactcttttttttttaatttttatttcttgagacagagtcttgctctgttgcgcaggctggagtgcagtggtgcgatcttggctcactgcaacgtccgcctcctgggttcaagcgattcttgtgcttcagcctcctgagtagcagggactacaggtgcacaccaccatacccggctaattttttgtattgttagtagagacagggtttcgccatgttgcccaggctggtctggaactcatgagttcaggcagtcctcctgcctcagcctcccaaagtgttgggattacaggctgagccaccgtgcccagcctatgctactcttaaagttaagatttcatttaattttttgtgcaaagtaagaaacttcactagcagattcttactcattcacattttcctgaataagaaatttgtttttagttccagtagctggtctctaggcaaatttctcgtctgtggttctttgtagataagtttgttttcattatcgctagtgcataataagggaatttcactctttttattttggtttatttttcccagtgggcagtgcttactgtaaaaataaaacaaaaactgctaaataaaataagtgtggcttctctagactctaatcaccatattgaattttacacctaaggcagcacaattattggtaaccaaacagtgaaggagaaggaatattgtggtttattaaaacacccaaccatacccaaaacctctgaccaaggagcatgactgtgtgttctcgcgtctagcattatacgtctctggtgtgtagcgatgcttcattgtagggtcacgtaaggacaaatggagaagcaagactttatcttgtgtactgcaggctccccagctttcaaacgtaggcaatgagttggattttgtagttgaatcttgtttcgtcctataaggaacgtgggccactaggtgtgagccctttaggggtaactgaaattctattccaaggcctcctgcatgtccacttgatgccgtaagctgcattcaagcattgcagtttcgtatcagagtacaaatttaatttaaagtctaaattatatttgagcagtctgaagcacattaaggcttcttaaataattcacttgaggttacgttcagtgaacatgtgtaaatatgagaacgtgcgaggcaagtggtctaaacacacaatgaatacgagaccacattgatgtaagccacaagtgcttaaaatcttgtcggaaaaagcgtgtcatccccggtaaccagaacgtttgactggccatgtggctcgcagggaagggttggtgtccaggtgcctctgtgcttggtccttgcagtttgccacatcatcaagggagacctttgagagaaacgctacgtcatcagctcatgggtgtggctctcagctgcagcgccacaggggagacagaagccccctgggtgctgcctgccgcagccctcggtgatgccaaaacagccgtttcccatcagcttctcaggttgggtatctgcgggtgcgaaatggctgaaatgtactcttggaaactgttgtgtttagttaaacttggattaatgagaaccatcgagtttattttttcctttgggctgaacagttttcatatgttatagagatgtgtgggtggattcaggggcatgacaagtgactcccagtagagtcagctcatgaaggcatctaagcatcgctgagcaatgccccttcctcactgtctctgagcttctagaccttcctcctgggcacgtccttccttaagtgtttggactcacagttctgaagtgtcgtcgttagtgaggtttctcctgcagtcaacacacccagggactaaaagaaacaagccagcgagtccaatgaaatcaggctgcagatctgaagtgcttttggaatatcctgcccctgctttctgtcctctgtctggttttcatggaaatttgtgtctgggaatgagggggaatcggagtggatttgctggaggcaggtgcctgtgttctttggcccttgccattaggagtcaggaccaaggaacctcggaggaggtggaggaggaggcagaggccgtgggagatgcgatgagcacggtgcaatctttataagacagtagggatttccacagacttcctgatttttgaaaattattcataagcctgccctcatctgggattttcaggacagaaaacataccccatttactgtccacgctccataaattaccctttcagattgttgcaaagttattttttgcattctgtaatgctggcatacgtaagctctgtgattgtgagtaaaatgcctccatttctttctccagcaaggatcaggacggcactggtcaggacaacatgcggtagcatcgcggccccatttgaaatacaggctacttctccaaaaggttgggaataaatgctggcccaaccctgatttaaaaagattaaggaagaaatggaaatgaggatcagaattagttacgtttgcactggcaaaggaagcgagattaaatacttgctttcagtctttgctccaagcaagtaaaaaatttaaaaaaaagaattgcatattacatatttgggaaagttaaatgcatgcttcctttctggaatgcacaagcctatttgtaatgggctttgcaaggcaaagattgctgcattggacacttaacatgaaataagatgtcctgagaaatctttagttcatagacattaaaaaataagttgctgttttaaataaacataatcatctgcttcatctgtgtcagagtgccgagtctttatttctttcctttttattttttgctttttcagtggttttatttcttgtgctttaatacccattggcttctaaaataggaggtgacgtgtatgtgacttgttaaagagtgaatgagtgtaacataaccctttcaattcccaacttagagaaatcattttggggataccttaagcatatcagaataaaagaaaacttagtatttctgtgtcacctgaggcactggtgccaaaaccagcaagaagtagtgacattttgtaatgtagttacatttaggcttaaattagtgtttttcaaccttttttttcatgaccaacctcctgttttcatgatcaacctcctaaaaagcattttctgattttttttcctaattgtccctcctcacatgaaaatttaataccacagatatactgttttagtactttgcattatacatatacgtatgtctacatttaggtatatctgtgctttatacagaaaaggaataagacgtttttcatccttcaagaactaattttagcctccttgaggatgcatggcttaaatacgaaatgccaatacttgactttgcaaagtattctgtttaggaaaaaagacggtggatgcccgtacgtgaccttagaaaggactgaaggtggtgaggagattcaaagtaagcaaggactgggacaccagggaatgatgttctgttggttgtcgtccttgtttagaacgtggcctgaaaactgataatgagaaaacaaaagatggatgacagctcccctttgtattgttcaagcaccattaaacatgccgaatcgctgaccacatgttttccacgtatgagaaggtgacacggtacttatcaaagttatgagtggacaaaagcagaaggttgcaaaaaccagtagcctagagagagcaaggcggcatggaggctggcagccaccggtgagctgatgggagaggctgcctttatgaacttctggacctgagcacgcagccttttccctgcacgctttggatgtaacagtgcaggtcatgtggcgggactgacgtgcagcagctggatcacattgactctgatctttcccctccagtaaaaatggaaatgtaataaaacaaacaacaacaacaaagatgctgagcttaccccaaaactcaatcagaagagaaaaacacctgggccattgtcaagagaaacaaaactgggccggtatgaacatgatcagcgaatagtatttccattaaaaggcaactgactcagagatggagggtgagtgttctgtgaggcagagctgaataacccacccacgccctgtagctgacaggatcacttaagcagagttactagaaatgacccagtgatactgaaaacaggaaaaagtacatgaagggaaaagcagattcttaggaagggaaagaagtgtgtgaaaccagagcagatcggtcagaatctaacattctgtttgagtctctcctcatcacctgcagtcctaacaaatcctccacttctcatcttcaagtgagtaatggtatggcaatgccctgtcttctaggagagattaaatggtaaaggatgttaccatgagtgcagaagcgactgttttgtttttgtttgttttgcttttttttttttttttttagacagagactccctctgtcacccaggctggagtgcagtggtgccatctttgctcactgcagcctccatcttccgggttcaagcaattcttgtgccgcagtctcccaagtaggtgggattacaggtgcatttcaccatacccagctgattttttaatatttttagtagagacagggtttcgtcctgttggctaggctggtctcgaactcctgacctcaagtgatccgccctccttggcctctcagagtgttgggattacaggcgtgagccaccacacccagtcaagactaggtttctaagagaatggttgcatccaactcagaatgtgggaagtgtggtgatgctttgtgctggtcgacgtcttcctgggccatcactagagtatatgcttctatctgggggctgagatcagagtggtacctgcattaaacatcaacaagtcggctatacagagcccagctgtgccttttgcttattgctttctgggcctgtatttggaatgtaaaagggacatacattttcactgatgctttttgtctttgttgtctatgttttaagtggtgtttaaattcaagcaaatactgtttagttgtaaaagctcactctttctcaagtctttcctcccttctgtttttccaaattgtctcttttgaatcatcttacagatagagttagtttgagtcagtggtgatccacacattgaatttggagcccaagccgcagaactgaccaagtgcttgtcatggtcacgtggaacccagatctgaagtctgtgaattcttgcccttaaaaatcactaaaaatacctctttgaaatatgactcgtttcacagtggattccacagtagcaaaatcacattgtggtttatttggtagcagggtcagatgagatgatacattgcaatgtatgcctacactcttatgtatatgaaacctatttatattacaagccatatatttgtttctctatagccatagttcacacttaggtttttcttgccttttctgggtaattccctttgagcttagtaattggggccgttaactgtacaacagtgtaggaatttattatttacttatttttaagggtttaaaatttttaaaatcgtttatttttttctgagacagagtctcattctgtcactgaggctggagtgtagtggtgtgaccacagctcactgcagcctccatctcccacactcaaatgatcctcccacatcagcctcccaagtagctgggactacaagtgcatgctgccatgcccggctaagttttaaaatatttttgtagagatggggtctcgctgtgttgcccaggctgctctctaactcctgggctcaagagatgctccctccttggcccctcaaaatgctaggattacaggcatcagctgcccagtgtaggattctagaaacattaatgatccttaccacctggggtcaatgatggcatgaagatcacatctgtattcagaaaaagtgaatatcaaatacatgttatttctaggccatttcagagttgtttcactgcttggctcaattttaatatgatttttgtatggcaattttttcccccaaaatatttaattgatataatcctgataaataatcttgtaaatattgtgataaccttgtcttaatagaattcagcctaagttagttcttccttggactacattgaaaggaatccagggaagacccctgtcataccaaatttcaccctttgctaattctctaggtagaaaaagactgtgttatacgttgatctccttataaggtgtttctacagaccaagatgtctgcaggcaatgtttgggaaggctcttgtttgctaagaaatcacacccaaatggaaaccttcagaaaacaagtggaagccaggaaaagtgtccatcactggaaagttgaaatctcctttaagaaaatcaatttattaaaaggaaaatgtcttcccatcttgttatagtatgttataatatatcgaaagttcttttaaaagggattcttctacttagtaacaatatcatcatggtggtttgcagacagaatgtcatgctactaaatggtgccgcctcttccattggatttcagaagccagtggctgccctgctctgcacttcttcctcttcctggcttgacctcaattcagacctgtgtgtccttctgcacagtaggtcccaggctaccacctggagaggggaaaaagtggctatgaaggcctctaggaaaaaaagccaactccactaaagtttgttgagagggtgagaaagaaaggaggggagagggtgagcagaggggactgtcccttgggaccccagcttcccaagttctggcagtggatggtgtctgtgggcacttggttttcagttactcactgcctggacagtgtgtgttcttcctgccccacgtggccagccaacatatggctcaagcccacagttcttattttcctgtgtttacttgaaatctctctgagcacgtggaatttacagaaacatgcacttcaattatcctttacattgacccaaaatggtactgaggaaattttccagtggccctgctaaccctgaaaatggcaacagacaggtgcagaccgatgcattcccggtggggcggaatcctctttgcagcttgtgagtgttgcccctgtggtttggaaatacaggggaggactgaattgaatgagttcttttgttttgcggaacacctgagtttgtgtgtgtagcttgaagacccattctaccacaagaaacaaatttgcctcttaaataaaaggaacaggaaatagcatgttgttggctttggtgtgcatcaaggttgggagaaggaggagttgtgaccttactctgtcccctgcagcctcgggcctgtgtgtcctatgagcgagtgtcatggggtgcacgtgggctcactggctgtgtccagatagacgtttttgttcccctgcttcaggttttagtcctgagactaccaattaaaccatcccgtaaatcttccattataggtagtaaaacctaattttggatttcctgcgtgctctggtatcctgcctgattgctaccaggctggacctgtgaagcagacagtacgtgtattgtgccacgtgggaaagcccttttcttacatattcgggatttagtcttaattccctgactgctttcatcttaagttttaaaactcctgaggatagctatctggaactctgcagttgacttaattcttttcagtggatcactttgatgcaatgagtaagggaagggggcgctaagaaaagagtaggcataaaagtgggtgaagtaaaacaccaaagccactgtagctctgccattcttgctgcgaaggcacagggtgtgccctctctcagtgtttcatactccatcatctgtaactcagcactttcctcaagctggggagtaacagctgcttgggaaaacacatacatattttggaagtatttgaatcaatgccttgtttctacccctctcctccttcagtgacccaatacctttgaccaatgatgctgaatggtttacctgggctggaatctgggggatcaggagtggtgctggtgacttggtctttgtccccctcatcccttgcacatttgtgaaggtgaacttggaagatcagtgggtgtaacagtgttgcaaggatgttctgagtttgaggcagccagactttgttacctattaatacaaaggaaagatgaaacctatgcaaaagttgttcttcacgctggagacttggcaggatgtagtgtgctctgagaatctgcaggtgagagtttgagtgggtctgtgtatatggatttagggtggggtgtgaggtgaaatctatatgaacagtactaaaatgtttaaaacttacaagtgatatataacagcatttttgaactttagaagatggtgtcaataatactttgtttaccgtgagcatacagatgaacaaaagtatttaaattaaatctttctgcactcagacataatggctattgaaaagtaatgcatttcattccagatagtggaatttctctcttatacacatgtttttccccaaaggggatcatattatatatacacttttatatatatgtgctggcacctgttttgttcacttaccagcacattagaagtatctgcccatgttcataggtatgcttaatgatatttttaatgccacattacttttaaactgtctagtattccatcgtatgtctctgtcattataaatttatctacctagtcctcttctgttgagtattcaggctgtttctagttttctatattataaaccaggaattcccaatcttgagtgcagaatgcagatgcccaggtcctatcccaggccaattgaatcaggctgtcttggggtggggcccaggaatcagtattctcacatgcctccaagatgaaaattactgtttcaaaccatgctgtagtttatcagactgagatacgctcttgaaagtggaattgtgtgatgaaagatatgtatctttaatcttttgatatagactgacaaattacctttcagaaatttgttttttttttcacactaattttcactttaagctttaaggcttttaaaaggtaaataatgaaaaaatttgcatgtgcatttggaagaggtttatgtcatactaaataattatgttgatctgtttgacattgcttagtttattttgtattataacatgactgtgttactaacataacaaagggggacgtatttggtgcctctttccggttgctttagtgagactgtggtgggaaggggcagatgcaacagccctgatgatgagtgtcttggttcattcaggctgctataacaaaatactgtacactggatggtcataaacaagactttatttcacatagttctggaggctgggaagttcaatgtcaaggcactggcaggtttgttgtctgttgagggcccattttctggttcatagatggcatcttcttgctgtgtcctcaaatggtagaaggggtgaagggagctctctctggtcccttttataagggcattgatcccattcatgaagggtccatcctcaacacctaatcacctcccaaaggccccccagctcctaatgccattaccttgagggttaggatttcaacatgtgaattttgggaggaagcaaactggtggtacatgcaatgagcatgggatggctctgaagaactggattttatgccttttctgggttcacaactgactctcagaaaacggttgcctatctatgtatgcgttagtttattcactgtgaaattttctacatgttttatcactgttctattctagttgttatatttctcatgctaatacatagttgtaaaagtcaaatagtatttctgcgcttataatgaaaaatagcagttctctgccttccattttcccagagagccccctttcctagaggtaactgctgtcctcttagctgtttcttctgtcatttacctccttgttgatacatcactgcgttttcatgagcttttcatttggactttgtattagtccattttcacaccgctgataaagatgtacctgagactgggtagtttataaagaaaaagaggcttagtggactcacagttccacgtggctggggaggcctcacaatcatggcagaaggtgaaaggcacatcttacatggcggcaggcaagacagatcagagccaagtgaaaggggtttcccctcataaaaccatcagatcttgtgagacttattcactgccacaagaacagtgtgggagacaccaccccatgactcaatcatctcccaccggctccctcccacaacacgttgaagttacgggagctacaatttaagatgagatttgggtggagacacaggcaaaccatatcagacattatcaattttctcctaaggtagatgagaatttagctcatgcccccttcccccatctcctgtttctccatccttccaatgtaggtaaatcataatgttggttaagttgatatgcatttgtaacattattataactatgtaaatgttacttagaactgagtcatatagtgtgctgtaatgttcgattttttcaaaaacaataacttttcattgattttcaattgatttttcattgattttcaatgattttcaattgatttttcattgattttcaatgatttttttattgccttggtttttctaagtacttacaataagactcccttaaactccttggcagaaccagttcctcttttcagtgtgttagaatgaatttggtcatctctcagggtttttattgttttgttgtgggggagggtgctttaaggagccctgtgctcacagatggaaccggctgtttccaggcgtggctgtcctggcatctctgccctctggcaccctaggattctgttggttttcatgctgggtcccctgtctccaggttatcctgtcagcctcatggttggtgtagttcttcacattgatggcttggctgggcctttgattccctttaagaaacatttccctcacgatttggaaagtgaaagtgatgcttcatagactaccagctcttattgttgttatcaagaagcttgggatgccatcctggttcccatttctcttctctgaatgttttaggtttttctctttcatctcagtgtcctgaaatgtcacagagatgtgccttgtttagggtcttcttccttttattatgtggggtactcagtgggcctcttcagttgtgggaaatttttctgtatgatttctttgagaattttctcttccatttttaaatgttttctcttcttggaactcttgttatttagatgttgaacctcctctctgatcctttttattcaaggcatctttaactgtttttttaatggctgtattatttgttcttatctttaggatcttaatgatagtttttttttttaaagttaaaacatctctttttgctccacattttttcttcgtgattgttagattttggtcatcatttctaatgcttggaagtttttcacaagtgtctggtggaccttggatgctcttcactaggaaataattcagaataattcactaggaaactgtgtgcccaggtggggcttgttggctgggggtgtgtgccgtgatgggtatcagcacctgactatgtcattggggacccataagtgactgtctaagtagctctttctcttgggttggtcagcatctcctgggggagaatactgctgttgtcagctgtggaaagggtggtggaatgagggtggggttgttagagcctggctgcagggttctgagggtgaagtagagggaagatcctgggggaggtaccttgccattcacttggtcccccttttcagtatgttgcctcattccctcactctgcagagcctggagtccctgatttctctctggagaggaaccctaaattacctgctaggcacaggatggttacctggctgcaggggatcagaaaggggatgtgggaggaggagggagcacttgaatttcccctttctccaacactcatacactctcatgttttcagccccattccttgccctgctcccaccctctgagtgacctcaaatttccaaagctctcagggtcgtatgttgcaaattgcctttccctttactgactccccccatcctctggcagggaggtcccctcactcatcaactgccattctcttatttgctttccatcttccaaattttgcaaacatcttccacaggctgttgtctcttctttcttccctttgtccatttgaatttctacttttagtgatattattctagaggtaagcccacaagttcaatctgcccttttttacctggacctgttacattttagagatgaagtgagttgcaagtcttgttggatgagtgctgcattctaccacggggtgcagtagttgtaagtgaggagggccagatgcacgcaaagtgataagatgatcatgatgaagctcacgcttatagaatgccgactgtgctgggctttacctggattaactccccaaatcctcacaacaacccactgggaggggctctgttattcccaactcacagagcaggaacctgaggcatggaatcatggagtgacttgctcaaggtcccatggggacaagtggctgagctggacattgcacccggactggcgcacccagatcggaggagtttcacaaaccaggcccccctaccagatcttcccctcagcatttcgagttgcatgtgctgtgtttcacaccttaccttagatcttcgttttctctgatatgcccaatgcattgtgctcataggtttggctgtgatgagaactctcttgctcttcaatccactcagttaacatttgtgtagtcctggatttcttacttttattatctagaccccagcataaacttctaatgggcaagtgggaacccctgttggaacacacacttgcatacatacacatgtgtacacacacacacacacacacgcagaaaaagaacttgtgaagagacagcataaaactaacagataagaaaaagacatggatcacaagactaaggacaaagcaagtgaacaggctaccacagacagttgatattacagtaagttaaaaacgaggaaattattttaaagtcttttattattattaacagtattgatgattaaaattataattaataacattaacataattttagttgctctttcttaggatcctgtagacagtagcacagttgtcaggacaatcttgcatgatggacatttttatcctcattttatgttgaggaaatggaagctcagaaatgttaggtaactttccaaggacacacaattagtagtacagtgtctaattccaacgtgatcactcatttcaccacaatagcttccaaaatattgagcccaagtaagtagaaagactattttgaacacccagattagtaagaaatccactggattgtttcttaagctctgaatcaaggagtttttattcagtcaggttccgtttgccaattcgcaggtgggtcattttctctggcaagtttcaacagaaaggctggcagaaacacaaaatgacacacatatgggatgcacacacacacacacatttcaggagactgaagtctgggaaagcaatggttttgagatgctttttacactgactagaaagcaaagagaggctagtggctgagcagaaggatgctgtccagatcttcatctagactagattatcaccagccagaccagcgtgcggttccaagcctgcctcccactgggcagcatttccacaacatctttcccctccttggggctttatttccatccccatttaaagtctcccatttgttaagaatccatggttcatgtttgtaaactgtaacagtgttcgcctcttcctttttgacagtttgttgtattacctaataaatatttttgaataaacatttgcttccttctaagcagggggacagccaggcagtgtccagccctctattagagtacagggccccggaatccaggttgagagagttctttttcctgtcaggctgtgggccgcagggttgggaacggagctttttgggtgacatcctgcagagctgctgcagccagcccaggtgggagaggagaggttggatgggtttccaggggccagagtacattcttcctgataatctccttagaaatgagaaaaagcttccctccggcttttatagttccagctttcatctgctcttcacccacaggtgcttcattccttggcttgagtaaataccttcagggaaaaggaaccagatgccactatttttaaagctgaggaattctttgttcaaataaaattttgcataaaagcccaataagtagcccttcccccagagggtgaactcttttggtgggagccggaccctccttgccctcctgctcctcctagcttctcttctcctggagacgggtgtgaaaactgctagctgacctcttctgtgcatttattgtgtattagttcattcttaggctcctataagtacataactgagaatgggtaatttatgaaggaaagacgtttaattgactcacagttccaacatggctggggaggcctcaggaaactttcaatcatggcagaaggggaagcaaacatgtccttcttcacatggcagcaggaaggagaaatgctgatcaatagggggaaaagccccagataaaatcattagatctcatgagaactcactcactatcttgagaacagcaagagggtaccacccccatgattcagttacctgccctggtccctcccatgacacatggagattatgggaactacaattcaatatgagatttggatggggacacagccaaaccatatcatcttgtatgggaaaatagagacctagaagaatcacctcccccaaattgtggaactagtgattgcaagagctgggaccctagcccaaggcctcatttcctgaatattattcaacctgagtcatgctagggtcagctatgtttggacataggtggtaatagtggcggactgctgccaccatgacctcaaatgtcaatggcccagctctcaactctgcagtcaaccttacctaaacacagaaaaggttattgcaaagttatatgccttccagattgtattttatgctcaataattgtgctttaaaaatatcacattgaatccttttgtaacagtttttggattttagaaatgagaagtttattattattatgcttatttctttgtttccttaaaggaatcatgcctgtgaagtttcctcttggttactttttcatttatcgaattactcactatttctttatttatgcatatatctggtgttttttggtatctcagagtagtttgattgtttttgctttttagtgtgttatatttgttacaattgataaatctaggttggcacatcattatcacctaaagtctatagtttacattagggcctgctcttggtgttgtatgttttatgggttttgacaaatgtgagcctactattacagtaggctatactattatagtaggctcacatttttcagaaaggattcagtatgggtctatgttaaaaacagatcctactatgatagtaccatatggaaaagtttcactgccctaaaaatgccccgggctctccctattcatccttctcttcctcctcactaacccatagaaaccactgatctttttactgtctccttttctagaatatcatgtagttggagtcatatagtatgtaggcttttcatattgacttttcccttagcaatatgcactcaggattcctccgtgttttttcgtggtttggcggctcatttcctttcattgctaaataatattccattgtcttgatgtgccacactttgtttatccattcacctatataaggaaccttggttgcttccaagttttagcagttatcttcatgttcttttcaaagcttcagtgaaaccctgtaggcaaggattctacagtataccttccaggtgacatgctgtgccattgtaatcattattgagattctaaaaatggatcatcaatctgcatccatgcaaagggagctgactatttttaatagaataagtgttacagattcattataggtctgtgttaaaaacaatggaatattgggtcttcgtgcaggcaacatggaagtcagtagtgaagattttcttagcattctgtcctgaagtcaccctgagaatacagatgttctctccacttgatgtgccttaaaactggactcgaagagtttttggttggaggagaggttgattgttatctacaccagatatttggggtctagttagaagtttcttcttggcattcttaatgctcacattttctcctcctgcatattcccagggacagggaacttactccctcataaaatagccattcccgttatgcacagctgtgtttgtgagcgtgaactttctcatatcgacctcaaatatgcctccatcatcgtatctacttttccctcctcgaataacacagtgaagtggcgacttttgctcataatggggactaggaacacctagaatggtacctagaaatcttacagtgaatagtggctgaataatttcagaactgaataaatgaatgaatatttgacttatcttcatttatttcaaagcagtatttccttaaacttctcttttgcagataaaatacaactacttattttaacctgatttcctacaatatgtattttagagttatcatattggttttatttttgtggacgtattattttttatcaatgttcttcttagagaattatatacagaacaggccctaggaaatctgagaccattatattttgtgatctgaaccttatggttcttttgaggcagcagctttagggcagcccatcacactgcctttggaaacaacctgatttttttttttttcatatcaactgctgccaatctacatccctctcattcagtaaaaagaaggacctttaaaacccaaaacaaatgaaataattcggcacttcaaattgtatcttatgaaattgaaggagatgcagatgatggttttctcagacatttattttctactttttattttcatcctggtaaggaataattaaaaaatagatgtgtaaagcttctaaaacaggcctcagaaaacacagaaaattgagaaggcaaaaataaataagaaaacaaaactccatacaaacaaataaaaaggcacccaaccaaacataaaataattcatgtgtgctgatatagcatggagcagggtatgtgaattcgttgataacgatgacatttgagaaatgctcgctcgtgccatccagtgttgtatgctttacacacatgaactgatataatccatacaaaagctctatgaagaatcactttttaaatgattttttttctattatggtaaaaagaaatgcataacatgaaagttaccatcttaatcatatttaagtgtagagttcagtagtgttaagtattttcacattgttctgaaacaaaactgaagaaattttccatcttgcaaatctgaaactctacactcagcaaacaataactcccctctccctactttctccagcctgtggtaacccattctattttctgtttccatgaatttcactcccttagatacattatataactagaatcataccatatttatcttttttttgtggctggcttatttcttagcttaatgtcctcaaggttcattcatgttgtaacatgggacaggactttcttactttttaaggctgaataatattccatggtatgtatattctaaatttcatttattcatccatccatggacatttgggttgcttctacttcttggctattgtgattagtccttccaagaatgtgggtatgcaaatatctatctcagttagtttggatatatggacacggaagtgggatttctggaccacacagcatttctggttttaatttttgaggaccctccatactgttttccagaggggctacaccattttacaatcccactgtattagtctgtttttatgctgccaataaagacatactcaagactgggtaatttataaaggaaagaggtttaattgactcatggttccacatggctggggaggcctcacaatcatggtggaaggcaaaggaggaggaaagtcacatcttacatggcagcaggcgagagagagagagcatgtgcaggggaactcccctttataaaactatcaaatctcgtgagacttattcactatcacgagaacaacacaggaaagacctgctctcatgattcaattacctcccactgggtccctccacaacacgtggggattattacaattcaaggtgagacttgggtggagacacagatccaaaccctatcacccatcaacagtgcataagggttctacctcctctacatcctgaccaacacttgtttttaatttttaaaaaattatagtgttcatcctaatgggtgtgaggtgacatctctttgtgttttcaatctgcatttttctgatgattagtgacattgagcatcttttcatatgcttgtagaccatttttttaatgaggatgcacttttactgtgcccattttatagataagaatgtagaggcaaagaaaggttagtcagcttatccaaagttatattcaggcgaagtgatggaatcagaatttgcatctggatggttggctacagagtcctgctttgcaatcactatgttatacccttcttaggggagccatgttacaagatgggaggatgtcctcagatgccgttccttcaagatgggtaataaatattaaatataagggaaggtttcaagtgctttagaccttgagcaacgactttctggaatgatgatgttaatggagtgatgattcaagcagaagccagttaaactgggtttccaaagtcaagcacaccctctagaactgtctgtgggattcggtttgcaggtctcagggctgacgtgcttcctgacttgagccacaaacctggcaggagagaggagatgccaggagggttgagctgggatgagggtcacggctaccaagaggtcaggataggggtgtgggaactttttgcctttatgcatagattgctgccaaaatgaggggtgaaaacggtacggaaatcaggtgtgcacacagtaatgcagagatgttctagtgttacagaggattacatggattttatccaaaggaaaggaaagtagtaaaagggaggtcaaaattgggaccacgccatcccttaaaggacgggaaggctataaaaatcttcccaggctgttagttatttcatctctgctgaaaatgacatatatagcagcaacagaatgttcagttaccactaaaagcaaaatttcccccaatgtgctttaaagagacgagacgtgtgggcgtttagtgttactgattcttcctgattcctttttttttcaaccaaattttctgtgactcatagaactcctattctctctcttaaccatgtgagtatgtgaaaccatgtacttggcccgcaacatttttaaccaagacaaccttaatgggaaatgaagtgtggggaatggtgtgttctgaaggtgccaaatcttttttctcaagggcaagatgcagtccgagttgaaggaattggaagagggtgtgtggtcaactccccggaaaaagcaaatatttgttacccacctgaaacattaggaatgagccagtggtcacatcctggtttctgccaaggctgaatgcagcccagattgtcagagctttatgctttccattccaggggtttcaaattctacaaaatgcataggatgaggcattaagaaagtgaccctttatcttcatttttgttcttcttcatttattttttctttgtagtgcttctcagtttagctctacttcttcctgagggtatatggtgaataactatgtagctcacatccctatgaggtctgaattcctcttatgttgcaaagtgagcttaacaaagaagaaagtcctcagaaccatttcttaaagcttcttctttttgactgtgatcctaggaaaacataaaggtgtgcagtcctgtgctaaaaaacatttgcactcaaggtgattttcaacttatgcaggattggttgttgttttcagtacttgtttgtctcttcttcctcaatgttagctgaaaagatgggtgcccagaacaaagtcaacattgcccagcttcccttgaagccatgtgcaactatgtgaccaagttctgaccaatagaatggaaggactgtgtgccacttccagaaagtatccctcaagggaaggttgaacttccaggtagaggagtgcccttgtccttcctcctcccacctccctgttgcatggctgagatgatgactggagttggagcagccatgttggatcataaagaggaagccctgtgttgaggtggctgaatggatggaacctgggtccctgataatcataccaggcctatctgcttgttttcctatggtttaagccaccattattaacaagaaatctactgtggtaaaacatacataatataaattttatcatttatctatttttaagaatataattcaggggtatcgagcacatttgcaatattgtacaagcatcaccacatcatttccagaactttaaaaatcatcatcccccaaaaaactctttacctgttgaacactaattcccccttccccctttccatagcccctggtaacctggattctcctttctgtccctgtgaacttacctaatctaggtagctcatgtaagtggagtcatatgatatttgttcttttgtgactgacttacttcactttgcataatgttttcaagggccatccattttgtaacatggattataatttcatttcttttttaaggctgagtaatatgcccgtgtatgtatagactacattttgtttacctgttcatctgttgatcatgaataggttgtttccacattttgtttattgtgattaatactgttatgaacattgatgtacaagtatctgtgtgaattcctgcttttgattcttttgtgtatatacccagaagtataattgctggatcacatggtaattctatatttaatcttttaagaactgtcatactgttttccacagcagctgtactatttcatgctcccaccagcatggaacaagggttccaatttctccatatcctcaacaacacttgatatattttttttctactggccatcctcatgagtgtgaagtggtatctcattgatgttgagtatttttctatgtgctcattggccatagaatggtctttggagaaatgtctgttcatgtcctttgcccatttttgagttgggttgtttgtttttaagccaccattgtttttaaaaaatcaatgttatcttctgtcacttgcaactaaaatggattttaactaatacactgccctgctgctttggttgtgatgagaatccattgagtgtggaaaggtttgcacctttcatagagacctagtgtatcaatgctggaagccacttaaaattgcctctggtttaggagcagagagaatgggcaatctgccttagtttacttccctggagaaagaaccagggatggaggagcttatgtctcctggcctctcatccaggtgtttccatctcactgcctcccacaggggaactctgcaagcaggcagctgggagcctgtgttcccttgtccaggggctgcaggactctgtaaatagtacagtctgtgcaggaaactctgctattgaattgtaaatgttattgcctaaaacaggtcatctcttggctttaacagtactagtatactgataacggcaccaatgataatgataatttgtttagaaaggtttggaggaaagggttactggggaggccctagtcctctaaagctgtgtactgctgctttatctcttgacaaaagagaaaaaagttttaatgcagatctcatgaacagggatggtttaatgagaaatggtgtgaagatttagtctgtttgttgcccaccacaaactcagccttgttgactctggagcacgaaaggtgtgattctgagagcttgtagcttctggagggaagggacagggaagttccatgagagaagtgggggcatgagagtgcaggtgtggtatgctcactgtggggagggagccaccaggttccagacagcaggtctctgttgtgcttcacagtttcccccaggagggggactgcagccagctctctcttttctccacgcagtagctgtgggtgtgcaggtggctattgagcagggacattttgtgttttagatcgacccctccctcggtccttagatcatcatgtctttcattgatgtgttagtcattctgggtagtgtatggagcccatcagtcattaatgctcatgtggtcccttagatgggcaaagctcttgacaatgttttttaaatggttgaacttgtgtgacccttttatgactctgtggtctttgtttctaatgacataggcagcattcagggtagaaaaacaactataaatacagagaagcaaaagaaagaaaaagcaggctgtgtatggtggctcacacctctgattccagcactctgagaggctgaggcgagtggattctgtgagctcaggaatttgagactagcctgggcaacatcgcaaaaccctgtctctacaaaaatatacaacaattagccagctgtggtggcatgcacctgtagccccagctactcaggaggctgaggtgggaggtgtgcatgagcccaggaggttggggctgcagtgagccaagatcacaccactgcactccagactccaacctggatgacagagcaaaaccctgtttcacaaaaaaaaaaaaaagaagagaaaactccttgtcatttctctccagagttagccactcttattattttgttttgtatattcccagactcttctatgcatggttatataaagatatacatcaaaaaattaccacatccctttcttgcataggagtattaagatattttcaaatactgaggatgtcagacagataagaaagtctggctgtctaattcacatctttaaaaacatgggacaaaactcgtttcctaccagaacgctaagagttcatttcccatttcaaacattcttgtcagaatctttccccataacagccatcaagccttgcatgcttctacggttctttatgttcatcttctataatatcacataataaatgtaaaaaccttgaatttaatgcattagtttttatatactatgtctctaagcatgttgttcagctgattttttttttcctcctggcaagactttctgaagaaaagaagcaggttgttgatttattttcattgttatctgaataatgatttcacagtattttcctgtcattacagctatgctatcagcccattcttaaaaacactgatttgtgatattattaaaaagtggtactcaagcttcctttttttgggttacagattcaccgaacatttccaagtagacttctttaatgtagttttacattaatgtcttggcaattttatgatttttgtttgattgttcattttgtttgtttttggttttagtaatgtaagtgctgctttacaggaagccttaagacattcatttttagacatgaaatattcaacatctacttttgttgtctttttaataatactcttttttgcaaatttttttttattctcggtatttaaaaaatttttttatgtaaatgctactcaagttttgatagtttcattgttttgtttgccaatacatttgttcaagtgacctacagtgtttttagcactttgctatcaattatggctgcaaaactgtagtttatggctacataaactataaaaatttgtatatgagggattatactttcaagtaaaatgaatacaaaattttttggctttcatttcttcaatgtcaacttctttgtcatcatttggttactgtgattgtcacattcaaaaaagatatatgtttttctgaccaaaaagaggccatcaatcaatcaataaaggttataaatacataatactaatttgacttcccttatttagccagtaatgttaaactataaattttaaaaagccataaacatttaattaattaaattttaattattttcataacgtgcttcccttttctcagattatgaaaataagttatgaaaataagtgcttcccttttctcagattttcatataatttgatttatccttgacaaactgaccttaaaaggtcacatgttgtaatgtggccctaccaatgagtgcccaaatgtgagtaatgctgcagtgtctgaagtggtcggcaccttatttagaggaactggagcactgagctcatactgatgtcacagtgatgtcaacttgctctaaaattttacaagcccttcttactttccgtacttctctcatcatggtcagtcaacattttgcaaaatggcactggtctatggattacactcagtaccactgctacagactgtatcatggtttgcaggtgactcagaattcagtccttccacactgaatattattatcatgacattttgggaaaagtgagtgttggccaaacgtggctcacgcctgtaatcccagcactttgggagaccaaggtgactggatcacctgaggtcaggagtttgagaccagcctggccaacatagtgaaaccctgtctctactaaaaatacaaaaattagctggaaatggtagcaggcgcctgtaggcccagctactcaggagtttgaggcaggagaatcgcttgaactgggaggcagaggttgtagtgagccgagatcacgccactgcactccagcctgggcaacagagtgaggcttggtctcaaaaaaaaaaaaaaaaaaaaaaaaagagcttcaagtattatttttattgtaatgggctttttaaagctgcttcaatgagtttcatctcagattattctaaatacgcaccatatcgccaatcatattaattagtaagtatctaagtaattgagaatgctttgccttcaataaaaaagctggtgttgtatcctggaacctgttcaaaaataaagtcttgatgtgaaaatgaatataggttgagatcttgagatcaactgtcagaagtcaggctggcttgggacttcctggaagcagcaccaggctctgcgttcaagtttgaggagcgttctgccttctgctgttgtggcttcctgcaatttaaggctcgctgcttcacactcctggtctagcaccttgacagaaaatgttccctaagggatgtttcagcctctctcctggagaacaaggccatgaataaaagaggaggccaagtgggtagcattttaaagatcaaggattcttaaaaactaatggtacaatgaatacctgtttaacaaacctgcgtgttctgcacatgtatcccaaaatttaaagtaaaattaaaaaaaaacaaactaatggtgcaagtagaccaaataactctgttcttcaaacctttacctctaagaggtgaatttatatatttttaaaattttgtattcttccatcacaagcctgtaatgctgaagatgagtattctgtatctaaggatgaaatgagtcagcacttttttgaagtgtacctttatctttaaaaactacagctttatgccatatggtttggatagagtctatttctgctctaaaaaaaaattctcaaaggatgaaggtgggttgatgtgtgaaataatgtacttcttcctcaagcagtgatgacagcacattgtcttttgggacaggatagcaggaatttaatattaatatatatttttaatttcatacatttattcattcattcaacattctgaacaaaaaattttctatgtgccaggttatttgctaaatactggggatattaaaataataaggcatattctttttaaaatgcttatagtctagtgggggagatagccacataaacagaaaactttaatacattgtgataagggctgtgatgtttcaagtattattctaggtgctttacatttattaaaatatctattccctaccacatttgcctcaagtgagtgcttatattatcccagttttacagacaagaacattgagatacaggaaggttaagtgtccaaggtcatatagccagtgagcggtgctgagattcaaatccaggtcgtcccatcacagaacctttttcccagccctacgctgtgaacggaggtggacaggagctctatggagaccacagaaggggtgtctcccagcagagctggtgcatgaactgtgtctaaggggcaggcaggagttcgccgggatgagtagggaggagagtttttttattttttgttttactttaagttctgggatgcatgtgcagaatgtgcaggtttgttacataggtatacatgtgccatggtggtttgctgtacctatcaccccgtcatctcggttttaagccctgcatgcattaggtatttgtcctaatgctctccctccccttgtcccccacccacccccgacaggccccagtatgtgatgttcccagggaggagagtttaagtggcgtatgccagagcatgcagccaggtgcttggtgtaatgtggagacagccagggctttgccgaggctggatcatgggatgggtggtggagcatggccagggatgatctagaaagtaggagtgggggctgccaagtcatgtggttaggctcacgaggaggttttcttgaaggcttcacatatagcctgaaggatgaaggccgagatgctttaataaataatttcactattccaaatggaaaacatctcaggaatgttcttatttgatatgtgattactgtaactctgggatctttaaaaaaattattgtaaaacattagcttgggaggaaattatgaacttcaattttgtttcatcaaagaaattgcagagatggccttgaagaaatctaatggctgttaggtattgccttgtttatttatggaatgatgctccccatgggtcaaaggcaaggggcccacatgcacagattcattttaagttcgacccctgctgggctggtggcaacctttgccttacttacatgtttgctgtcagtgctgagcaacttaggtgtttcatttctggagggaggaactcactctgagtctaggacctcacgctctgctaccaggacgcctgcaacaaactaacacacacatgagctctgatgtacggtgtgactggaaaatatactgtgttattccagtggcaaaacccccaacactgccggatggggcaaaaagtgaaattgtgttttgaatttgatgaagatttcagaggtaaattataaaaatcttaaatttggccagtctgctccatgtttcaatccaatatgcagggcaagagagatgaatcttggtgttcatttcctttatgtttatttcatgcaaattttatgtgtatgtgtattgtgtgtgcagtgtgtgtgtgtgtgtgtgtgtggtgcgtatgtggtgtgtggtgtgtgggtggagtgttgagtatgtgatgtgtgtgggttatgtgtgtgctctgtggtgtgtatgcatggtgtctgtgtgtgtgtgatgtgtgttatttatgagcatgtggtgtgtatttagtgtgtatgtaatgtgtgtgtgtgtggcatgtatatgtgatgtgtgtggtgtgtgtgcatgatgtgcgtgtgagtgtatggtgcatatataatgtgtgtggtgtgtatgtggggtttatgtatgatgtgtgtgtgtggtcttgtgtgtatgtggtgtgtgtggtgtgtgcatgctttgtgtgtgtgtggtgtgtatgtaaaatgtgtgtgacgtgtgtgtgtgctgatgtgtgtgtgtgtgtgtgtgtgtggtgtggtatggctgagcatgtggtgtatgtatggtgtgtgtggtatatatgatcatgtagtatgtgtggtgtgggtgtgtggaatgtatgagcacatggtgtgtatgtgtggtgtatatgtgattgtgtgtgtttgtggtatggtgtgtatgtgatgtgtgtgtggtgtgtgtggtatgtatgagcatgtggtgtgtgtggtgtggtatttatgagcatgtggtgtgtgtggtgtgtatgtgtgtggtatggtgtgtatgtaatgtgtggtgtgtatgtgacgtgtgatgtgtatgtgtgtgatatggtgtgtatgtgacgtgtgtgtgtgattgtgtgtggtgtgtgtggtacatatgagcatgtgtgcgtggtgtgtatgtgcgtggtatggtgtgtatgtgatgtgtggtgtgtgtgtggtgtgtgtggtatgtatgagcatgtgtgtgtggcatgtatgtgtatggtgtggtgtgtatgtcatgtgtggggggtgtgtgtgtgtgtgtgatatgtatgagcatgtagtgtgtgtggtgtgtggtgtgtgctgtgagtgtgtgtgttacctactgatgttgaaagagacctgggacccattccctcggcgcggcagagccctgctttcctagctgtgagccggccttcagtcctctccactgacttggcccggaaagcagcaggggccctgtttggtgagttacgtttacacgtggagcatgagaaggcccacatttggctaaaaagagtacaaatctagtcccctgctgaatgaaggcctgtgtggttgtgcactgcacagtggtgcctgagctgctatctgacagcacgtggtcacctttcctcccgtgcatgtcctgggacagctggggctgcacctgaccatctgggtaggactcaggctcctgcaggctcctggatcaggctgccttcctgagcagctgcgtgtgtttacctggagatccgagagagcctctgtctcctgtaacttcgcaccttgtgtactcagagtcatctcgatgtcagccattttttcttcggagcaggttttcattgctggaaaggcatgagtggggactcaggggagcatctaagtagactctggaaattccagtggtaaactcggagcatttttgtatattgccttgggctgaacttgcatagccatctggaactctcttaggcttggtggcctgatatctatgagggagactaaccctcctttctggggggatctgccagaagagatgggttttatttttgtattagtcagcttttgctgcagtagcaaatgatggcctccaaaagtctcagtaatttgtaacagcaaccacttgtttgtcactcagaggacttcaggtccctggagctctgtcggactcagctgggcctaatggaggtccctgtgtcttttattctgggtcccaggttgaagggacagcagctctctgaggcatgctgctctcatggcagcggggagatggcaaggggcaagcagaaatgcatgattcctcttcaagttgccacctggaacggacacactttcacttttgctcacttttactggtcaaagcaagacacctggccaagcccaaggttcctggagaggaaagtgcgctctctactgccaggcaagcacaagtcacaagatgacatgtggagctgcatgaaaggaggtaggacataagagttggggacaataatctacactaatctgctggaatttatttatcacagaagggggtagtctgttgcttcctaagtgatctcatcccatcccatggcttccaatcccacctacaccgatgactcccagatagttgcattcctgggcttcccttcacactcaaattcctgtatccaaaattttacttgacgtcttacttggatacccaataagcatctttgaaatcctccagtagttcgagttctctcaataaatgctgaaaactgatggcatcatccttcactttttttctgggaagccatgagtaaagtatgtctaaggtccttcttactgaacaaggctgtgcttgacagaatgtctagaaggagcttccaaacagattctactttccaagatttttagacctgtcttgttttaggactaaatttaccagcctgctgctgcggaaccactctgctccccaccacacttgtgtactgggaaacttgatttagcctggtggagagaaagcctgtccttgggcaatagtgaatgatagagtccacgtttaggcctgcatctttctttctccaaaatccatgcttttcccactacacaaatgtcattgataataccagctactcatggcatccttaaaatcttggtgatggggatattttattggttaggaatctctatttttaaatgtattaaaaattccattccttacctgtgagacaatgtaacctgtaaaagtaagtaagaccattgttcttttttattggtcatgttcaaattacactattgctccttcctaagcagacgagctggctgcgggcctgcagagtgtgctggggattttgcagttagaagccagaagtcaggtttggccgtcatacatgagtaggagggttgaattggcattgtttttacgtcctgggagatgtgagcaagagcaaaagaataagtcatcgcctttctgttgcataacctcttcatccccacaaacgaaccaaaccaaacccacaccagccatatcaaaccagatcagaacaaagagccaaacagcagaagacacttgctgaaggcactagcttatgctgaagaaatgcaataatgatttatggactctctgtatctaacactttaaatgttgatttacggaggagtcagagcccagatattccaaccaagtgcagcactttagcttggctggcgttctgtggcgtttcaatgggattttcactgcatactttcccattcaagtgtgcaaagcatttcgagtctgaataatactaagcacattcaagattcattcaaagactgcagactttgtcaagtatcttcttttcttctgggattgattcaggcaattagaccataacctacatgttttcttcctcttttgtttatgttggtattctcataataaccatgacgaattatcttccaggataaaatgaatgctccaggtactggaaagtgatgacaatgatgctacattaagccacaatgccataaattcacagatgtgacagtatactgaggtgtggcaatagctgactagctaatttatgaagccgtaaggctggtaataaattctggccctataaacagtgtcaggcaaggtaggctgaaatagaatagattcaccaatacattgtgtagggcctcctgagctatccctgttagaatctcagaaaagtgatgcttttatgattgctagatctcctgtgccatttttttggggtctttaaataaatgactaagggccacagttttaattagctgcaaggccagagagtgaagcaggctaggatcacagtgagattaaatgggggagcaggagggaagagacaggggagggagtaagaggaatagagaggaggaggatgaggggagggagcaagaggaatagagaggaggaggatgaggaaatgtctcagagaaacacatcccatgtcttggagaaatatgtgcccaaggctcttctctggctctctggataccaggtgtgtgggctgtaattctagactccattgacttatgaagctgaagctctgaagtacattcagcttagtatctggactggctggagcatggggaaggaagtcggtctacaggtagagtgtgtcattgacaccatcttggagaagtcagggaagtggatggtggtaggtcacaatgactgttggcttaatgtgaggtgtctgacagactcagtggtcttcccactgaacccggctttgcatgaccctggttgaattgcatctacttcatgtttcaggtccttatccagggactaactttgacttattgagtacttgctaaattttcaggattgggttctgccctttaacgcttagttttcctagcaaccctggtgggtaagtctaattttattctcatttgatagttgatgaaacagaggcacaaagttgtcacttgagcaatgtcacactgctagtgagtggtagaggggagctagaacccacatggatgtgactaacctctgctcactctgtctcctgccccacagagggtgatgctgagaggtctgtgttgtaaaggaggcagtgctgttgctgatgctattgacagaatggctacattacctacaaaccattgcctttctctagaagaatcctattctcaaggagttagtattagccattttgttaagttctgttttaaagttgttcccccccaacctccccgccaaatgagagagcttgcctgctcttgtccacttagggaccttatagttaaggtgtcttaagatgtcaccaaccaaaccttttgcttttggggccagaaaaggtctattagagtcaatctgctccacgttactttgtgattctcactctgtgccactttatccttgtcagttgttattttaggggcatgcattgttttaccggttaatgatcctgatcttcctgttttcatttttatctttcctgaatgcacctgttcgttccgagatgatcatctgccctgtttcatgacaaggctgttttcaccactcagtgcctcttaacaggatggtcttgctccttgcttggctgtcaacttctcactggggctgcattcttccagattattctggcttagtcttgcttttccagactcttctactttctgatcctactgttgatggtctggaaggctctgctctccccattcccattgtcaagtgggcaaagttgtaaatggtactccatgacacgtgtgggcttgggcctaccccttattcattcttttaagcctcgtcctgccaggtgctgctccaggctggccttgtcctgcctgtggtctcttccttctgtcatctgttgtctgggtcggtgccactgtgggggaaaacaaaggccttccctaccttcctgcccagagacagattccatttagttcttcttcagcagtggactctaaacaaaccctttgggaaacaaagacaacagatatgaacatgacatatcaaatatcaacaatgggatggggatggtacagaaacagcaggacatctctgtaccatctaaatgaaatagaaacctttccagtgacttgagttagtacttggaatagaaatgagttcaggacttgtcctgttttatgttcagtgaatgttatatgaagagatgaaggggtgaggaagaaaggttaagcaagcagaatgcctactatatttatttatgctttaaacacatccattaagacccttgacaatgaaagcatggatataattttaaagaacattttgcatttattaaacaaaatgttctcctaaatgtcagtgatggactttagtgtgtgaagaattcccaaccttgggcaggtcatccgcctgccctttccatgtggttaagggagaggctgaacacatgggctcatttcaggatcctcctggaagtccattttggatctgttatggttggaggaagggctggaaaagaaaatgtgcctcatgcctgaggtgtgtttccccatgagcagctctttccagaaggattttttcattaaattgttaaaaattgaagtcatatttatggtgccatcaaatcttagaattggaagaaacttgatgtcatctctgtcaaaattcatgagggaataaatgacatttaccaagacacagccgcattattatgttatcccttcgtggaggtcattcagaggttgggtttggagaggcagcatatgatgtaactccctaggtctctctgctagaaattcaggcaggtaattttagaagatgtcatatccctcaatatattttcatgcatagattaattgtaggtaagagttatatcacattatttactttgggaatctccagggaatttcttgatgttctgagtagtagcattgttggaatcccttggctccaagaaaatttcagcaatcaaaactgaactgtatttaaaataaagagcaagccccatggacgaaggggcatcttagatggtttccaccatgggacttggagggcatttcctccaggcagtgcttaggataaaaatgaggtgggggagggtagacttccctccctcttagaggttgaatgttttctgagcagacttatggtcagtttctttctgcatccttgtccaatccaatccaatccagtccagtccagttcagtccagtccagtccaaaccagaagtcatttacaggccatatatcttatacctggaatagtgctaggtgttgggaaggcactgtctcggtgttcatggtcaagtataagcaacagtccatgctctaatgtccctcttatctattcttattcatgaaaacatttttttctgagtctcagttcaaaggtatgcaaaattattgagacaaaaatagctttgtgtgttaataataacccatcattcataaatcattcattcactaggtgctttgccgtacacagaggaatcccaatgatcaagacgggtatattagtccattctcatgctcctataaagaaatacccaagactgtgtaatttataaaggaaagaggtttaattgactcacagctatgcatggctggggaggcctcaggaaacttacaatcatggtggaaggggaagcaggcaccttcttcacaaggcggcaggagagaggagagtgtgtgaaggaggaactgtcaaacatataaaatcatctgatctcatgagaacttactatcatgagaacagcatgggggaactgcccccatgatctaatcacctccctttcttgacacgtggggtttacaggtccctcccttgacacgtggggattacaaattgagatgagatttgggtggggacacagaaccaaaccatgtcaataggtgtgactacagtgcctgaaccagagagaagctgttgctgactcttggcagctcctgagagctgactgtatgcatctcttctcaactctgcattcagtgacatcccattggtagcttgaagttgactgtaatggaagtgttcacaccatggaaattggcagtcagtacaaaccagggcttcctccccaaacaaatgatttttcaaaaacccttttgtcagcacaccactgccagacactctaaataataatcactctaataattgtcagctatcatttattctatgcttctacatactagatgctttacagacttcatctcaaaatctttatagctacctctgagatggtgtctactaattagaaaaaggtcacaaaactagtacatgtcagagccagaaccagaactaactctgaactgaagaaagctcatgattctaccctttttgctttactgcctcctttacttgaagactttttcaaagccccatgcttgcattttttgagatgccttcccaccttcacctaagggaatgggactcaagaaattttaggctccatgacaagtcagttcacatgacattttgttcagataaccattttattcagtgaggtaattccgcatctccccatttattttatatcatctcatgtgacattttatctattggtgaggcagcagtgagttttgagggcagcactggtattgccagtttaattctaaaggcagtttatttgctttagtaaggtgaggaattaactggacatccatggttttatggtgactttctgattcttgttgtactgaataatagtgtctctaagaatcaatttgcactggccttttcataataagattgttattattatgagatcagttgttaggaaattgcttgggatgggatttgggtatctcaggcagtgatgtaatctttgccttaataataattaaatacctaagacttctgatacttcacctctgatacacacttacacatttgtgctgagtagagccggacaatcttgggcttcccccagagggagagcctgtcccaggaatctcatccaatggccaaccagaataataccttggccttgggacaggatatttccccaaaggagggactccctgctgaggccacgctgaccatgctgtgtcttttcttcccaactcaccgatcagataaattggccttcctccccacatgtgtgtttgtcttgcctaaggagagacctggacttgagcaatcatggaccagtccagggctcaaggaagccgttcgtccccaacccagtccccttctagccactgcctgccacctttgcaggtagtttcatctgcatggtcccagggtggctgctcaaggaagccattcatccatcccagtcgccttctagccactgcctgccaactttgcaggtggtttcatctgcgtggtcccaaggatggaagaggtaggagggtgtccctaagaggaagagcagggcaggatttcccagaaacccagagtagatgtctacatacatctcctaggccacaactccctctcatggccacatcttataaggaagcctgggaatgtaatttgtacctgaagatattgtggccctgaacaacattgggattcattgtaagaacaaggggagaatgtgtattgactagacattaatgctatccaacgttctcccatactttgacatcacatttcttctatgggctcatggaaacaactgtttctcctacatataagttatatgtaggaggaaggtgctagaaaggtccctggtctttggctctgagtcaaagcgcttagcttttagctggtgcccttccattgcatatgaagcctgagggaagaatcccgtttgctgaaccttggcttcccccactgttcaacgagtggagtgggatgatctccagggttccatgcagctctagaagcccatggtgctgtatttctgaaagactttaactcagaaggtgggatgcaagggatgaggccactgaagtcctgaactgaccttgtgtcctgaggaggcttggtcagcaggacctgggcaggggccggctgaagagggggggcccagcctgtggttggtattgggggggtccccttctaggtgggagatttccttgtcttttggaagctaactgcacatggacatgaagtcccttctttacccatcgtgatgaggacgaatggagcaacttcaggccctctgtccccctcactcttacccggacagcagtctgtccactgtcagtggtgttgattggaatggatcagaggagaaagggggaaaaaactgaggcagaagcctgcttgccttcacagtgagcggcgagcaccagtctgcaggcgttacctgctgtcatttgctgatgtctgcattttggggactgagctatttgggagagggcccttatgttctcatgaaaacgatgaacaacctactgcaaacaaaggaaaagaacgtcatgatttctataaggactgcttttcacagtagttacgatgtggtcagggggcgtgctttagtgactagctctgaattaactctgatgagagtgttagaggtttcatagtctagtcacttagaagacacatgtcaactgtagactggaaaggggccgcgtgtgctaactttcgttcagaaaactatgtctgactaaagatcagtgatttctttttttaaactcacagcagtgaaactgcttggtctatttgtgattttactaaacagtcttgactaagtttatgatgtccgttcactgcttcctcagatgaacaccttcttcctatgcggtgcttaaaatgtagtttaagagtgaacattttatttaaactgataagaatcagcaaacaaatggagaagagttaggatttcaatgggccccgcctgttagtaatatacatctacagatcgttaacatggtttgcaaatatctactgcttagaaatgtcaaagaaagggccgggcatggtggcttgtgcctgtaatcccagcactttgggaggccaaggtgggtggatcacgaggtcaggagatcgagaccattctggctaacacggtgaaaccccatctctactaaaaatacaaaattagccaggcatggtggcaggcgcctgtagtcccagctacttgggaggctgaggcaggagaatcgcctgaacccaggaggcggaggttgcagtgagccgagattgcaccactgcactccagcctgcgtgacagagcgagactctgtctccaaaaaaaaaaaaaaaaaggaaatgtcaaagaaaataattctaatggttcctagttagttactgtgtttcattttttcctctgtttttcatgaagacttacaatgcttcagataaaatgcaggatagagaaaggtgagggggtatttttcaagacacatttaggatttaatatgtacagatgctcttgatataaaataaatttgttgatcacacataatttcagcctttcaaaacataaacatggcatacaggacccactataatgatggaaactggaacatgttttgaaatcaaataaaatgtcaaaattttattaatatgctttaatcaaaaagctaatcctattactttatttctaaaataagaaagaaaaaggggaaaaaaagaagaaaggtaaaattaatgtaaaccagtaacagttttagaaagctatttttgaggaaaatgtgaaggtccatttcaatgggatggtaaaggtttgtaaacattttgtgactcctcttttgtgaactggaacgcgtcacattcaggacgtcgctggatcttcaggacattctgtgtgtttttcacttggccgacatttgctgcagtcttgggaatgtcacccgcattcttcctcctatttatgagctagagcacatataactgacttgagaaaaatgatttaaaaggtctccaactaaatttagtttattttaaatcaccatgttgactcaggaaaggagcttcacatgaaccccccgctttttttcctcctgcccagcactaagtttataaaccagaaaacaaagatctgccttcacctcccttctcttttgtcatttacttttagaattccattaacaaacacctattgcctgcccactccgtgcccacccctgtcctgggtgccgaggatgcagcggggagccaaacagatgaatgtccccatcctcaggcaggagacagacagacaataagacaaatgagcaaaggcctgctgtggtggaaataaatgctaaggagagaaaaatgaggcagaggcagcaaatggagagtgttgggggttaggattttatagagtgacagtcatggaaagactgacactggagtgagggcctgtgggaggcgaagggggagccgggagctatctggggaagaacattccagacacatggaacagccagttgccttgccagttgccttctgagcttgaggagcagcagggaggtcagggcggccagatggagagaggggaggagtggagatgaggtcacagaaagaggggccacgtgatgaaggggtgctgccaggttccctaagggccgtgggtctgtgtgatgggaagcccagcattggcgggttgtgagcagcgggagtgatgtgatctgatggatgttttcgggagatcttgctggttgccttgtggacagtagtttcaaggtttgaagcagggaacatgggaagctaacataataatccagttgaggggtgacagtggcctggaccagggacgttgcagtggaggtggggaggtgggcggtgatgagggcatgcgtgttattctgcatagggtttggatgcgtggcacgaggagaagaagtgagccaagggtgaagcccttgtgttgggtctgagcccctggaagggattacctctgtgttccaccttctgccagtcctgctggtttgtggatagcagggattgcttccctccaaggcagttatggtgagagcacatgggaagtgatgagggctcttttaatctaaaacttcttttctcctctgtgtgaaacactttcttcctctttttcaatctcccctcaagcctattcttgttgtccttggccagtgcggtgaagcagttccttgcattgtgtgtaggacctcgccaaggacagagagagacacagcgtgggttggtgttgcattgcattagaggtggccaagatgcacagtccagcccatgtggtcacaggaaggaggggtattactccgtaggtttcctttctcacaccacagcacagaatgattgctcagatcaaacattcattgtctttaagcactggtacaattgcagttcaatctcccctgcttcagtctacactgagttttcattgagactttgaggaattcaagcccctcttgctaaacacacacacacacacacacacacgcgcgtgcgcgcacgtggactactagtatcaggtttactaatgaaagagctgaatgcagagaagtggatggatttgggcccagttgatctgtggaagagggagactgagtctgggctctttactttcttggatggtgaatgttgccgtttgcatagaagcccgcatggcagtgaactaacagtaaccttgaagatgtgtttcatccaccacccttgaacccattatggctcaagcttgggtattgcttttaggaatctagcattgtttcaggaaaacattttagttcttattgttttctgggaagccttactttgcacaagggcagtggaagaaaccgaagtgcatattaagtgccatccattacttgctgtgtgtttgaatagtgatcgcagcgttgctatgttaaattgcaaagaacctgtgaacctgaatctccctccatccttcccttgtggcctctcatctctcgccactctaaaggcaccagccaggtgctcagaggagcagaagccgtgttaaaaatggcttggagcatttaagtaacttttctcctttaattctatttatttgaaatatacaaaagtccagtcataataaaacgaaaaacgcctttgaccaaattcaacacacgctaatgcttggttgtattgtcttctgagtctttttgaagaaacacagcttacaaacagagtgcatgattcatttgatccttttcttgcccagtctcttcctcttccatttggtatccagaaatgggtgtgttttcttcctgttcacgtgactctgctttctctttgcctgtatacagcacagatttcacacatatgcatgtgcacctgcacacatgtgtattctataaatgtgtttataattttgcacatatggtgttattctatacatatccttttgcaagtggttttttcattcaaggttatgttgttgagattatccatatgaatacaagtagattgagttcacgtactgatttttgtggtggtttagttctttcataattttctttgattgcctcataattgtttttatttttttaagtttaagtctttttttttgagatacctttgtttttttccagtgtcgagttattgtggtgagggagcgtgttgtgtggatcttcattctttgaaatttgtggatactttctttgggatttactatgtcgtttttagaaatcttccacatgggcgtgaaaatagtatgtattttcagtttggttcaggttcccttaatgcctgctagatctagctggattgttgtgttttcagatctttgtataagtggtgcattcagcaaattttcttcccctttgccttcatccacgtttggacagatctctcttttacatcccttgttactgtctggagtagattcaagagctttccagtctcctttaatcacttaaaagtctgatctggtctaataaaatctcttacatggattgtaggttcttttaccatccccttgtccccaagaaagacactgacaatgggagatgatgggtatgttaatctgtttgactgtagtatcactgtgtagtaatcattgtgctgtgtctatgtatatccagatgagtatttcaaaacatcctgttgtatactttcaataaatatatgcaattttaaaacccatggaagatcttacgtgattctacccttcttcctccctaaaccgcctcccaagacatgggggatgggctgtgggaatctggagggtgaggtctgttccattgtttgtacccacccctttgctcccaccccactggttctggtgcccctgtatgtggggtgcatagagggtgaaagaaattgtctgacttttctttcagacaattcagaatgtggggtcccagacacctccaaaccctcagctttaggtcctggccactaaatgtcaggcaacaggtgaagtctcacaaagcatcctctgagaatcattgtactaattgcttgtctacttaatctagctgtttaggtgagagcgacaacctctctctataatgaaggattttctatttctgtttataattctgttgatttttgcatatgtattttgaggctgtgttgtttggtgcccacagcttctggagttttatatcttcttgatgaattattgctccttattaccaagctttgctcatctttatccctaataaataattttatcctaaagtctaacttgtcctgatagtaaagtggctattccagctttctttttgttgatagctgaacttcttttttggtatgttatatcaggtatatctttttcagtaaatgtatgttaaacttttctgtttatttatggtttagatacatctctcataaacagagtataactggatttttaaaaatcatccaggctgagaatatttatgttttgacaagtgagattaatttatatattgtgtaaattacaatatatacaaaatatatttgtagttgttactgtcaacttattttgtgactttcatttttcctgactttatcaaatttatttatgctgcctatcccaatctcctgttttgggaatgttatacactctaattttagtctggttagactcttcttacgattgtctaattatccctcacctaacaaagtctgacatcaagcattgtttctacccactttccaaacgatccaaggccctctgactctgctcccctacttccagctctcaggttactgttacctagttctttagttctgctttgttttagtaatgatttctaaagttaatcattactattatctctttaattgtatcaatgcttatcttgatttatcaactcataattttcttttaaaattgaatttaagatgcatatatatccactcataattgtctttgtttacctttgtattttttttttgagacggagtctggctctgtcgcccaggctggagtgcagtggtgcagcgcaatctgggctcactgcaagctcagcctcccgggttcatgccattctcctgcctcagcctctcaggagtagctgggactacaggtgcccgccaccatgcccggctaattttttgtatttttagtagagacggggtttcaccatgttggccaggatggtctcgatcttctgacctcatgatccgactgcctcaggaggcgctgggattacaggcgtgagccaccacgcccagcctgtttacctttgtattttgaatttcatttttttcctttctgggtttaattttcttcttattgaagatatactctaatagctctttaattaagtgtctgtaagtagtaaaatcttttggtctttccctcaacatttcttcaatttatactcactcttgaatgttagttttgcctgacgtagaattttaggttgccagttattttccagcagcactttgaaggcattattttattcccttctggcgtctgttgttgctgatgagaaatcttgtatccatcaggttgtttcctttgtagataatctttattctattctctggtcacttttaatactttgtctttgtctttgatgttttatcatgatatgactagatgtggatttaattatgtttattttgctcaggactccttttttaaaaaaaaatctgaagtctcatttctttctctaaaatctggttattatttatctccaaatatatcttctgaataatttttatccctcattttcactgttcacttggacatctcatgctagcctccacactccttaacatctctgtttttccttctttctaggtagttcagtaatttctcttaccatttttgaataactaattttaagatagtctattaaatttttatttctggaatttgtcttcagttatttcagctctgtctgttattgatttatactctgctgctttttattatggtttaaatttctgtttttaaaaagtcattttaaattaactttatagatgcttttgtttgatcttttatccatgctgtttggggtgctaatcctcaatctttttgtatctactacatctactaaaatctacttattttggtttttttcttcatgtactttacaaaattttcttgtgagcttatcttcagtgaggattgttctttctttgtgaattctctataatgtaagctatgaaagtgtctctataaagtagttttatttttgcttctgccagagccctaggggtgttgaatcagttggtcatgaatcagtttatctatctatctgtctatcatctttctatcaaccatctatctatacatctaatcatctatcagtcacctatctacctacctatcttctatcaattatctatctgcctatcttctgtgtatcatctatctacctatctactatctatcagtcatcagtctacttacctacctactttcctgtcttccatcaatcatttatctatctatctacctatctacctatcttctatcaatcatttatctacctagctatcatctctctctctatcatttatcaatcatttatcatttatcatctatcaatcatctgtctaatgacctacttatcaatcatctatgtatctagtacctacctacctatctacctacctacttctatcaatcatctacctatttacctacgtacctatctcctatctatctatctattatttatctattatctatctatcatttatctatctagctattatctatctatctttctatcatctatctatcatctatctgggctgcaacacaccatacaagtaacagaaatgtggtttttatttctcacagatgactgtttttgctgcacgtagccttaggcacacagctacttttgctaggaaaggttccagtctttgctctcctgcttctcttgggtcataagctgtgtcctttgtccctgcttgggccttggaaccccacccgcagtgcttaggacttgcacttgtgacccaaatccctatgggttcctgtggattcagctagcacttgctaactgaatttctttctttgactctggaccttggggctttctgttttctttctcttgttcttggccatgtgtgtaatgtatgtaaattctttcttgggggcagggtggatgttggtggtggttagattttctctagcatttcaacgtgcttgtaattggaataaggcctgattgtctcaggcgagtctaccatgtggtgatttcagactgttctttatgaagattatttattgtacttctagtgaagtccaggaacagcatgggcattcagtgagggaaaccattttttaaaaacagtgatttttgtgaccccgtgacaatggttactgtgccactccaagatcacatttttaatataattttgtattattggtgttgaaagcatttggggtagtatagatagctttttgatggtttaaaaagtggacagaagtggggaaggagagaacaaaaatagccggtattttggtaggaaaaactgaaaattcagcaagagagtaagtctacaactgtgtggaagctggaagagaggacagatggagaaaaatatttcatctaggaaacactgaagattgttttaaggggaacgagagcagaatcttcagttagaaagaagcaagcaagaaaagaaataatacgccctataataagtacactttctggttaacatttcacactcccaacaagagcaaatggcttgtagatcttgcagcagcatgagtgaggctaatagaaattgcatggagatttttaagttgcttctattcaagctgacattatcagagaacggtccttgagtaaggctgaggccattcttcaggacctaatgtggatatgccagttgagttcgtacttagacaggacacaatcagtaatactaacaatgtacacattatactggtaatagaagagctaacatttatttgactatttttggaaaggcatactgtaatatctgtagagataaatgtttatgctttggtaggtaatttaaaaagtctattataaatctgttataataacattcacatgaaatttcttttaattaaaaagtaatgctttaaggacattaaacaattatttaaaaactcaaaattgcctcaattataccacccttgtgtaactatcttcattttacatttgtgtattattttttcttattgtaatcatactgtacataatattttacattttctcctatttattccataatagatgttttcatgtatataataaaattctcataattttgtagacattttagaatggagatttgctattaagacataaaactagtacttttttttttttttttttgacggagtctcgctctgtcgcccaggctggagtgcagtggtgcgatctcggctcactgcaagctccgcctcccgggttcacgccattctcctgcctcagcctcccgaatagctgggaaccacaggcgcccgctaccatgcccagctaatttttttttttttatttttagtagagacggggtttcaccgtgttagccaggatggtctcgaactcctgacctcatgatccgcccgcctcggccccctgaagggctgggattacaggcgtgagccaccgcgcccggccaaaactagtacattttttaaaaggaggaaatcaagatgccaatacgtgaaggcattaacaaaggaggaaaacctctattctctaatttcatcagcatttcagcaaataaaggacactttaacctccacccccaaaaatctgaggacatagtttcaaaagaatgtgacttcagttatgttaatttcgcctaagagtactgttcttccgctttcctcctatttttctaaggatgattgaaaaccttatcgggggcccttcttgatccaagagcaaagttggggattccctgccttgggtgatatctcgagagacttacttaaggggaatgctgttggtgatttttcttgcaaaatagcagactcagtgagaaggctggcatttccaatgatgggccccagattcgccacttcttttcacaggtggaagtccttcatgcagccccagagcaaggaactgcaaagaatgactacagggtgcgcaccaccacgcctagctaatttttgtatttttagtagagacagggtttcaccatgttgaccaggatggtctcgatctcttgaccttgtgatctgcccacctcggcctcccaaaatgctgggattacaggcgtgagccaccgtgcctggccccaatctgtttgttttaatcggattttatctgaaagtcctaaaacatgttcaaatatggccactgctagagaccttgatgtctttgccattcacattttcattaacaaaggacttgctctggatgtaagctgcgtttcgggtctcttcatgtggcagaggtgtctttaggggtctaaagacaagttcttgaggagacccagctatgagctacaagtttagcaatttggaactggctccatttgatgtcattgagtattcatagtacctgggggctggacaggattttgaacattaccttgcctgtgctcctgcttgaaatctgtctgagctcaccctgcctttctggcagattttgttcttgcctggaccctggctaggttaactttctgagttgaggcatgaagctcaactttttcaatgtggtttgcccttcacttctcagaaggaaattcattcccactggaatcgtcgtttttttcttgaggactccaccagctcttggcgttctaggagtaaaaggctcatgtgtttccttcaggaaacttctagctgcttaaaggagcttaatgtgaagcatcaagccactgagacgtgttcaaagattttcttcaaaatggcttgagagggaaaaaaatcacaaagcccacaaatgaatgtattgttaagcatgacttctccagtgtggttgctctgtgctgctatttacaaaatggagcagtgttttttaatgatgagggaggattaattgctgtaaatgcaccagttgctgcatttcccttccttatcccctgccccgttaaagtccacatttatcaagtcatttgatgtttgaatatctggtgtttgtacaactgttttggtttacttatttatttatgtatttatttatttttgagacagagtcccgctctgtcacccaggctggagtgcagtggcacaatcttggctcactgcaacctctgcctcccaggttcaagggattcttctgtctcagcctccttagtagctgggactacaggcacccatcgccatgcccagctaatttttttgtatttttagtagagacggggtttcaccatgttagccaggatgatcttgatctgctgacctcgtgatccacctgccacagcctcccaaagtgctgggattacaggcgtgagccaccatgcctggctgtggtttctttattttaaaaattcctatgtttgcagtgaaagagccaaaagttaaaaactgagatgcattagagaagcaggagtttatgccacatgcaaagagcaggtaaaaagcactcaggaagacaacagaagtgactcagaagtgttctttatgaaatatgcttctttaaggattgcttgaatctgggaggtggaggttgcagtgagctgagatcacaccactgcactccagcctgggcaacagagggagacaccatctcaaaataaaaataaaaataaaaataaagtaaaatatgctcctttaaaaaagtgctggttaagctttgactacacctcatttaaaattttttaatgtcaataaatttattttaagttgcttctaggagaaaactgttactattttaaagttactatgtaggagaaaactgttatcctctctacttaaatcaagatagtgactggaaatgctggcacatggaaataggagggtgagtgcttggagtgtaacactcatgggtgcctgtcaaaggaatgagaaactcggggagtcaagtaatctaagaattcaaacagggaaaattctccttatacaggaacaatatttagttgtgattccaatcttcaccttgtatctcccctgtttctctggctagcctttggcagtgaaacctcaaaataaatatttattcatttatctctctatttttctatttctctgtatgattttttttttcttagtgagcatgtctatgacaataatatggtgttggattgcttcaaagttaactcaccacattgcctttgccaccaaagagatctgccttttctttaggttttgtaaaacgttgtaggtattttgggcccacagtgtacaactgagccttcagttgggattcagtggggattcctatcagtggtgttattcagacattaggtgggattcctgcctgatctggctgccgcgttgtggactctgtcatctgagttgttgggggaaggcgtcctactgaccgttccatcctgtcaatcctggaatccagtgatccccttgacatctgtcagtcccggcaataaaagctggtgaactctgtgtccactggtggaggtgataaccctgggtggtgtttcttccttgtaaacctgattgtaatgcccagagagaaaggaaatctaatagtggcagccatcaccattagactcttggagccagagatttccagggggggttagatgcatggataggttgcaatcccaggcttgcctttttcaaggagcgatagcagagttttgaaatcatctgaagtctcaagggatgtctctgtggctcttatagaagatgctctgaatgtgtgtttagtggttgtccaaaaaaaacataaagaatacaaacaaaaacctcttggcatctttaagccagaaatgtgccttaattgtttaattctacattcaactggttctgtgattccatgcttattacgatttcttacttttgcagctattggtcaaataaaacggagccccttgtccctgccctttatccatcttaagagcaaggaggtgtggtcagtgttatcaatgaggtccatgtgatgttggattctacagttctgccatgatgggagtcgccacatgggatggggtccctttactgtcccctctgggccccttcattgcactctggagggtctttctcctgtggagcaaacagggaccgggagacactaggctggagctgtcctgagtcttgtccttcaggggacgttttctgtcttacccatcccaccttgaaggaaaatgggaccccagctacagaaatctacgtagagctggacatttctcccagctactggcctgcaggcaaatacttcctgattctgaggttgtcaaaactgccttgatgcccagccattctcaaacctgggtgttttcacttaataccttcgccagccccagggtagccaaagccggggcggggttgggtggggattgcgggtaggtttggatctccttgtatctgtagactcttctgcctcttggtgtttgtctatctgatatgctcgctcttgtaaacttcctggccctgtcaccaacctcgtgccttatagatcacttcttttgcctcctcttgtttcctcagctctttcagagacccagtgggctgttgctcactcttggcctgattggttttgacactatcctatttccatgtggctttgctacaggtttacctggcagggccacccacccaacatatgagaaactgggcttctttgttttctgaatgagctgttctcagtaggttatgatgtaggtgcaactttacttcctccaaactcatgcctcaagtctgatagctccttcctgtccctgttccgagtctcctcaggcaccagactttccctgtcacttctagatacagtgaacagtctaatttccaagtattgagaggtccagggaagttgaatttttaaaagcctattgttcgtcctgtttcaagattctttgcatccggagctggtgttagcatcggaaacgcctctggggccatggccggctcccagcctcagaggcttgcacacccactcctctccttaccactgacctctgcctctggttctccagggttggagcaggaagacaggacaacaagggctattaatggggttacttggccatgcatcataatttggtgtcggattcccctctgtgaagcaaaggtctaaaagctgccccttgttcatggaatgcatgggagggtgcggaagggctcttgcagtgacattgccccacagctctccatggcagggtgacatccctgtgtgtgtctgctgatggtacccttcccctagcttcaccctggtacacctccagcctctttctgtcagggctggctcacccctgcaagtccagccacctgccatgggtccctgggtacaaggatatacccaggccctctcacctcaccatggatggaagctcagtgtgcccccccatggcctctccttcttacctgtccccaggcagcctctgcaaacttctctacctggaaggcagtcactagcccctgtgccctggtagctcagaaccctaggggaacccttggaggcagcctaaatggtttttttgaagcttccctcactggccttgaggttggtgcatctgcacatggatgtgaaatttccctgcctatgtccccctttcctttctttccctggggtggagagaggtgctgcacagcctctgaaactttctctgaaggaatgccaggtctctggtctcttctatcagtgccggtgcacaagagctaattgtgcagatgtctcccaactcctcctttggttgattgaaattgtgggaggatttatactgtgcagaaaccagaaaactctacacatccaccctgctcccctctgcgactgtgggagctgtatactcagcattgaccagtttctgacatatatacccttgaggccgggaaggcagaggggcagggacttgctgttgttatttaggtcactccttagagagttgtgcatggatgtgcgggcatccttttttagagagtgcaccgctgctgtgctctgtgtgctattctgagcctcagccgatggcaggaaatgtcccattttgcactcagttacttatgtggcatttgtgatacattagtgctgtgcctggtgtttctttcatgatattattccctgttttccaggttaggaaactaaaactctgagaaggtggacttgttcagggccaggtggatggtcactgctagcctctgtgcctgcactctgctgcctgcgcttccatgcctgtgaccctgtctgtggggttcactgagccagtctcatagtccggctgctgactccaggaatggggcatggggcccaggaatgcctcagcgattctgatgcaggtggcatcagatggttggaaatcacctctgcagcctgacagggactggagtcttggggttctgggagaaaatgggtggtttttagagggaagccctcctccttcctgtgctagagcaaggtcgggcttacagtccttgctatgtgtaaaggacgtggctggtccaagatcagggctttccttaactccatctagggagcccagtgactctggtttgctgagattgacctccacacaacctgagcacctaatgctgtcaatttctgctggattgttttgtgcttattaacgaactctcagttatttcccacataatcgactttaagtcaacggattgcaaatgttaattacatcacgtaatttctaaattatatgattttataatttctaaattatatgattttataattctgagttttattggcagttttggtaatttactctgtgcacattcaatttgcccagttggtgtgggctctgtgatgtgctgtctgggttcccttcaggaaggaaggacttattccctcagatgctgggagtatggttggaagatgcctcagctgtcagccctctttgggaagtgcctgctgatgatgacagccctgtccaagctcatgcctcgttcccaggacatcctacaaccaatgactcatcaatgcaggagtgtcagccagggtgctccagaaagatccaacaggatggatgtagatagatctttctccctctctctctttctctgtgtgcgtgtgtgtgtgtgtgtgtgtgtgtgtgtagatatatatagatatctctctatatttcaagttccttaaaataaatcttattacacccatctttatgtccatacataaatgtacacacacgtgtgtttatatgtatatagatatagagataaaatgagatatctatgtatggatgtatatgtatgtaaatatatatagacagataaaccaatttcttaaaaatacatctcattatattgatccatatttataactgtgtacatatgtgtatatacatatgtatgcatctagattcagatggatgatagatataatgagatgtattttaaggaattagtttacacaattgtagactggcaagtctgaaattgggaaggcaggccagcaatgatctttccttttctccagagtgggccacagcccggtgctgcaggaagaagaagatattaccattaaaaagaacagccaagctctcctggataaaaggaagccctgggaagttggtgtctgctcagattacctacacaagagtctcagtgctttttggggagactgccttttgttttcagaaaatgtaggtggatgtgactgagttgaaggtgggtggtgtgatgtctgagtcttcctggtgttggtccaccccatgccttaaacaccactgtggggaacctctcctgggaggtaaaccacttccagctcagcctgaaaccaaccatgttcttcagtcttctcaagaaggccatcttggctgggtgagattttcagaggttaattcagagactcgttgccaaaactttgcatttcagagatgtccaggaaactaaggaattctccagagaaactgggaggcattacaacagatattagcttgcatgtacctgtgtagttgaatttctgtcatcaggacagaaggattagttctgtcaagtaatcaagtgtcacacggtttggctcacaaaggttaatctttccactcttcctgggctttgactgtgaacaagtatcgctggatcacaaaagagagggccctgtggtggagatgactcacagaaagtgcctcctgtttgctttctctgctgttgaaccaggatgtgcctttctctacacttagcagacagtatggtcctcaggaatacacagaggctggttttgaattccgagtttgaatttgtgttcatttgcttaccctacctgtgatcttcacatgcctcagttttctgagaaatgagaacaggaataatcacctttcaagctctctcaataaatggacctagtgattaaaactatgaaaggctctgcctgcaccttgcactgctgaagaaagctgttaccacgacacagaagaagggcagtagccttgctgggttaactgggttcgtgatgagcttattttttacaaaatattaagatgttctagctattataaaaagagaccccccccccccaatcccacaccaatttttatatagagaggatctggtcctgggattgcaaaacctgttcagattccagaaggctaggccagcaaagaaaattctggtacttaattgtgcctttctcagcaaaagaaaaaaaatgctgaataaacctcataatgcacctcatgaatgctacaaattgaaaactcaatgacatttcaagcaagaaaagaaccccctagtgatatgttggttcaccaggcaggtgtgtgggaagccagatggccagcgaggttctgccctccaggaagggtttgccctccaggtgcggaccctctccccatgtcactgagaagctctttccatctctctccattcttcatcacagtctccatcttaaaggctacacactgcctctggaaagtcttgctgttctttaagggcagaacacttcagagccagcctccaccgctcccgccctgcttctgctctgaggtggccccagcaggagtaccagtcctagaccctgactgagcagagctcccgggcttccattgaccaacctcacaggccccggggttcaaggatgcacatgctcattcttggggctgaaacagaactccccatcttcactgagacccacatttcctggctttccatcctgctctcctctcttccctgcaccttctctgcttaattggccaccaggctctgacatgtcttctcatctccaccctgtctcttgcattccgaggcttccccaccttcattaccttgggctggatcgtggcagccatcctggaactggcctctctgcctctggccttccctccctgtagtctcctgcctcatgaatcttcccaacagcctctttgggaaactttgctcggcaggtgctccaaaatcttcagctattttcacaacaaggttcggacttcctagcctaaaagtctagactctccccacgtcttggccctttgagatccacacaaaccctcatcgtccaaccaatgtgcctgccatttccctcttgcctcgggctctcctgcttcttcatttttctggaacttctgcctgagagacttgtctgatttctctccagcctctctgttccaggccattgtgcaaaacccctcaactctttttttgcttggcaaatcccttctcagccatctcaggagatggccaagatggcaaaatcatttttacagtttcgacagggggcttctattaaatggtctcattgactcctcacgtaaagtagctgtgttggctccctgtacagagtcttctgcaagctgcatttgatttctgttttgcctaagttattattgttgtctggattgccttcctctctgacgtccatataagttcttcctatttttcatgatctgggttctgctattcaaggctgaaatgccctattttcctctccttcagatgattccagttcttcttactggagcagctatgtggccccttcatctgcatcacaaaacctgggtccacagccttcctctcctgcaaggcatgtgggctctttgggagtgagagacacaccttgcaacttttctgtcccatatggccccgtccacagctctgtgcatggggtgagtgctcagttcatacttgttaaaggatgctttgatgatggagtccatggaaaattctatatagatgcagtgcatacctatgaggcttcatgggttaacggggaggcatgttgtcaacctcaggtcctgagtgtcggggaagcatgtttgtggcggggttcatgatttctattttaaatatgaaggatgatttttaaatttttatttcccaattgtgtccagtacaaatgaggtgatctttgtgcaatccttgtaaaccagtcaaaactcagtggaaatggaaaagctggtttcattgctcctggtggctcagtacccatcactgaaatcccaaagtgtttttggcaaagccgatgggtatagaactattttcatgatgagttcaaggttctttgaaattccccacccttaaagagcacaaggaaaccttttcctgttggtattctctaattttttttttgtcaacaatgtgatatacgaattgggaatctgaaatattttttcttcttttttctttatgcttttaatgctgcttgatttttcttaggaaaggttctcacctctatctgcctctctatactatatctgcctcctacaagtatcaaagtgatgctgaaagaataaattttatctaaaaaatgataacttgtaataaagtctcttatatgtaatctctctttaatatgacttgccatttttgttctattatagattattttgtacttgggagttttgctttatctaaaatattgagatgctaatatgatattagctaattgccaattgggtattttatatataacctcagaagtaattatgtattttttttctgtccagtattgttcatttgcaaatataaaacagatctcattgcaaagatggttgtctatgcatttgcttctttaagatttgaccttgtaattatatcgagacaaaattcattttgaaggtcaaatttgcctctaaaacagacttcaagattgtgttctcaaagatatattgtgtttgatgaactttcttagaaatacataatgcttgtttaatctgtggcttgcttttcagttgtctgctcttgtaaaatgactaaatatttgtttttccagttgagcttaaggaaaaaatccctggtaaatgtgttttcttgaacagaaggctcagtgtaaagcaggagagaagtcatatttatagttgcttttactttcttgatgtcatccgcctttcaaatgctgtctgttttccttcagatctctcgtttttacaggggggccccaggcagaccctggttcccacactgagggacatggcgctgttttgctgctgtgtgttttgttctggtggaagctggcagccacctcaactctgagatcagctcaaatgctttacatgcaaaacggcaaggctgagaaagaactgaaagtttccttgggtccaagaacgtcttgggctttacaaactggtgcccacaggcacattaatacctgtgtttatttttctatctcctgacacacacataaaaaatgggaagacgcactggggagaaaggttgattgaatgtcatgaatgaaagaaaggttgaccctccaaagcaacatgaaatgaaaccaaaccacaataacaaccaaatgaaataagactgacaagaagtatgcggtcatggccaatacatggctcagacatgattcatggagacccttgaaattttcttccagcaaaactgcactttaaaggtttaaatgttcaacatttctctgtgacttagagtaaaaggggaccctttagggaattgtataagagtctaaggattgccttactgagttctaaagtatagcagagttagtggtgcagcagtttacataggaaaagcacacacacacacacacacacacacacacacacacagtgaagggagatgacaataagcagcccacattttgggctattaaccaggtttagaaagcaaaattgctcaagtgggagtaactgaagagcactcaagcctgccacttttccagatttggaactccgcctccctggtttctcctctcatcacagggtctcagcgcctaggagagcagctggctatgctggcttcacagctttcctctgaacactcttttcttatcaacagttccaggcttcttggtctctctttggcttctggagcccatgtgtgctagagctggctcctcccaactcgctagagccggcaatgatgcgttagagcacatcttttcccaactctgcattcagggactcccctgggttccttgcagttgcccatgatggaaatattgactccatagaaatgaccaagtgcttcaaatcaggagttttcctgtgagagcctgttgttagccatctggcagcacaccccttctgagacagtggggtcccaccttcctgccagaactgaccccaccattgtgctgtgaaacatggcatttcctctacctcttccccagacagtaacgtccttaagtgccctggctctagaatctctatctcctctactccactggctccctttatcctgtctataaacatacctgcttttctcatccttcaaacagactgagcaaataagataaaccttcttttcattggtttgtaaatgccttgagggcagggctgagtcttgtgcactagtgcatccctagctactagtaatttctgaagtacagtaagtgcccagcaaatgttgggtgggtgaagccagttagtgcttttcatttttgttttcattgtttttttggttttgtttgtttgttggttggtttgttttgaggagtctcactctgtcccccaggctggagtgcagtggtgcaatctcagcttgctgcaacctctgcctcctggattcaagtgattctcttgcctcagccttctgagtagctgggattgcaggtgtccaccaccatgcccggctaatttttgtatttttagtagagataaggtttcaccatgttggccaggctggtcttgaactcctgacttaaagtgctgggattacatgcatgagccactgcaccctgtggcattagtgcttttctttgaactgccactccctccctaactttgttgctcaacttcttctatgagtagcctacattgccctttgcatatcctccctgtttttaactactgagccatttggcttaatgctgtcaggctcctacaacatttttagaggacagcaagaggttttaagttgccaaatccaggacctgttctcaatgcgtatggttggttgaatgactttctcctggacatgaatctctctgcagttgcgacactgaactttccatcttactgaatgtccttccttggcttccatgacttagatctttcctagtttcctccttatgctctgactgctcctccttgtgttcttggctgttttccttttccttctcagtctgaaaatatttcagacactgccttcaatcctcttctgcctccctaactcccacttagactcttttgcccctttcacccctggactttccaataaagaaaaaagaggaaggattgcagaatttctgtttttaaaaagctctccagctgattgtcatgctcaaccaagctacactctggcattaaggatcaagcaaggcaatgggggagttggcatttgtgatttttttctttacaactctgtctctctcactaggctctgaactcattggcaaagcccaaccctagttagtgtttagctcagtgcttggcacatggagggaactcagtgcgtatggatggatggatagatggatggatgaatacatggatggatgggtggatggatggatgaatacatggatgatggatggatgaatacatggatggatagatgaatgaatacatgaatacatggatggatggatggatggatggatggatggatgaacaattgtatgaatgaatggatttgaagggcaggttgaatttagatcatggaagaagacaacattatcagtgaaatcatcccttaattatagagacaaatcattcaacatttctgagttcatactctgtgccttgtgggacatacaggtgaaagactctttccctgcagcgtgcttccttggagaacacttcccttctttcctctcctcatctatttcctccacctttcctgctctcctccccattcccacttactgaaatgctaagtgcccatcaactgctctgttgctgcatctttggtacctctcttgtgaccctcaccacattatgcctccactcagtaatttaatttaaagtataacctctcatcatagcctttgtttattgaggggaggttccatgccacctccagtacctggacactcaacatgtggatagactgagataggccacttatcatggtaatagttatttactaattcttagatacggtgttgtaagtatggagatctatgagctgagctaatttccagcagatcattttattttaaaattagaactgaagagcatactcagcgtgtctgcgtgactatggatacagatggtaaaagagctgaaagcgacttttttgaacatggctactagagtgtatgggatacttttgctgccagtaataacaataacaacaaaaatgaccccaattcaaaatggtttagttaacaaggaaaatgcatttgatgtgcctagctgccctgccatgagatgccttcagagttggtttatactcttccctaccataggtagaaacacaaggacttccctcctttcccccagatatccacagcacattggttttatcctcaggtgacctcttctcatggtcctgggatggctctcacagttccaagtgccacacagacaggactactactctatggcctttcttcatcagccaacacttttcctagaagtcctctagctcgcttccccgagtgttagactgaccagaattatatcatgtgcccttccctaaaccaatccgtggtgagaagagatggtgcccagtgataggatttacactggtgttggggctggtcatcctccgtgggtcatgtgggggcaggcagaacacccaagcaaaattatgtttccttccataagggaggaagggcagccagttacgtctgctgccattgccacctgtgtgtggctatacatggaaaaagcaggctgctctgtggctgtgttcaccataactgtggggatggacggctgctgctgctctgtccttggcattgctggtgggagtggagccttctccccaggctgctgtcacgcacgtggggtccaggctacttcttggagtgagggtagcttttctggagttttctttcttcacagtagccagttccacctatggaatattcactgctgcttacacgtggtggccagggagatctgtgcgtagagaatggttctcttgtctagtgttttggggaacaaggtggtcattcattcctgaatttaacaatgcctttgctgggcatggtagctcacccctctaatccaagcactttgggaggctgagagaggaggattgcttgaggccaggagttcgagattggcctggacaaaatagtgagatctcatgtctccaaaattttttttttaaaaattagccaggcatggtggtgcatgactctttttcctatagtctgagctagttgggtggctgaggtgggaggatcacttgagccagggagggtccaggctgcagtgagctattgacaccactgcacaccagcctggatgacagagagaatcctgtatcaaaacaaagacaaaaacagaaagcagtgctttgcatctgtccatctggaccatcagcaaccccttctcattgaacttgcaccacctctctggagtcagagcctcttactcacagttttcagatgagcaaactgaggctgagggaggttttgttggctgctagtgggtcagcataaacttggggccccaagctcaaggttctttctgcctcaccatggctgctttgacaccttaagcttacccttcaggtactcagatgtgttcagctttggccatttccagtccagatttcctgatgatctggtgccttcttctacctccccatacagaacacagaacctgactgaatactgaatcccaggggtcatgtggtttgtcccactggccaggggcagggcttggagggtggtggtggtggtggggggtgtctcttcaggtcatgtgactccttgaccttggctttctgccgttgctggaccaggggtgattgagctggggtgagcagtttgcactcttaccaatgttctcaaacgactgtatttttgagttcttgagtctggtttacataattttctgacttttttgctttgatgaggccagctcacgcggctggtagtgtgcctttctctggcaaagcttctcttcgtggacttcgtgacatctttttggatcctttgtggcttctcagctgtgttacacataatttacgttgtcaggtaaatgctctcaggataaatgaaatattaataacgccataatgctaatttaaaaatacccattgcacatatttaagagaatcctctctgggcttgactctgggctttaaatcaggcccaacaatgtctcaaccataaatcaaattatcctttcagcctagtagaggttttggcataaaaacctactatagaatagcatagtataggaaatcttagttcacgcttttaaaacttttattccctttgcagaaattggaaaccaaatactcctttaaccacttatccatgcaaaacagttaaccaagcaatagtcaatattggcttttggatttggggaacatgtttattaactcaagatttgcacagctttggccgggcgccgtggctcacgcctgtaatcccagcactttggccgaggcgggtggatcacgaggtcaggagattgagaccgtcctggctaacacgatgaaaccccgtctctactaaaatacaaaaattagccgggtgtggtggcgggcgcctgtaatcccagctactcgggaggctgaggcaggagaatggtgtgaacctgggaggcggaggttgcagtgagccaagatcgtgccactgcactccagcctgggcgacagagcgagactccgtctcaaaaaaaaaaaaaaaagatttgcacagctttgcaaagcatgatctactgcaccgtccccctcccccatccccttgaacatcaggctgccgagcagggaaggccagctccttgggcccatgtatgactggatgggaaaagaatacattacagtgaaataaatgctttaaaagcatgtttaggattataaaatgattattccttagttttctcccctgattataaagatgaatatttttggtttagaaaatttggaaaatacacaaaactataaagaaggaaataggagttcaacttttcagatgctatgtataagtgagaggatgcagtatgtgtctttctgtgcctggcttatttcatttagcataaagttctccaggtttgttcatgttgtcacaaatgacaggatttctcttctaaatgctgaatagtgttccattgtgtatgtgcaccacttttctttatgggcgtttatgttgatggacacttaggttgatgccataccttgtctgttgtgaataatgctgtaatgaatttgggagggctggtacctctttgacataccgatttcattttccattttctttggatctatctccagagtgggattgccagcaatcatgtagtattttgatttgtaatacataccaaattgagttgtagtacatttgtaaaacatatagtattttgttttgtaattgatctttgtgtttttgaggaacctccatcctgttttccataatgactgtactgatctacgttcccaccaacggtgggcaagagttccctttttccacatccccaccaacacttgtctttttgataatggccattctaacaggtgtgagatgacactcatcatgatttcgatttgcatttccttgatgattagtgatgttgagcgtaggggaactggggagatgttggtcaaaggacacaaaatttcagttagacaggaggagtaatttcaagagatctgtgacttgaacttgaatagacctatgatctattgactgtagttaataacaatgcattatattcttgaaaatcactaagagtagatttcaagtgttcgcaccacaaaaaaataagtatgtgaggtaatgcagatgttaattagcttactttagccattccaacatgtatatatatatatatatatatatatatatatatatatatatatatatatatatatatatttcaaaacataatgttgtacacggtaaatatatattacttttattagttggtttaaaaaataaataattttaaaaatattttaaaaagaggaaaataagaactcctatttcacactggaaagccaaagaccatgactgttaaccattttgataacttttctcaggtcatcctctttcctttcctgccttccctcttttatttcatccacttatttttttttctttgtgcaatattgggatgatattatgtacgtggtttagtaccctgatttttttcccccagtaatgtgttttattttctgtatcacaacaaatgcttttctgtgacatctgggcaatttgcctctatgcataggtttcgaagacttcaggtggagttggctgggggcttcctaagtagagtgggaatgtcaactggcctgtggaaccatttagaaataattctgcccattacaaatattgatttgatgcagtgcttaagatgttttctaatttaaaaatattttcaacggaaacagatgccatttacaatttctcatgttgtaaggattctactaaatatattatttggggattgaatattttacttggaaagttgtgtaagaaattcctgtatctaaaaaaaaaaaaaaaaaaaaaaaaaagaagagagagagggactggattttggagccgtgctacaggcatattgtaagaaagatttttttctttctatctttttagctagttagtgttctaagattttaaaaaatacagatcctcctagcatttacaaagtaaaagggttgtttcttttctgggactatgacaattgcttaattacagttctcgggatgttttctaaattctaaatcccactaccctgttctgagcagcagaaagtgctaacagaatgatctagggaagccattattaccaaagctgggggctataaggaaaagaaaacattttcaaaatattttctgtgcaaaagcatctgtgtgcttcagcatgccagttaggcttggccttgctttcactcccgatttttgcttcataatgctgggcttccctcagaggagaggaatgttgtcccctctttttttaaggggaaggatttaagttctttccccttttaggatattttaaaataatgtttaagaaataggttttgtcggtacatgtacagttgatccctggtattaatatttgaaaacaaaataaggtttaatattcttcaacttatattcaggttattccaggatctttggagacccgaggaaagccgtgttgaccaaaagcaagacaaatgactcacagagaaaaaagatggcagaaccaagggcaactaaaggtaaaatgaacagaacccaaataatcttatgctgcctagtcaggaccccttttaaaaaatgtggatatgtaaatattttgtatctttcctatttgattttcatggttccaaacctccacagaccatttctggattctttgctgtacttggatgaattatgttggttctacatgacacccttgacttccctgagataagatgccccattgcccagcactgcctgttcctggccctacagtgtggagattttagaattactgccttctcagttctatagtcttcacagcccctcttttctccatcactgtctactctcttctcccttttccagaggaaccagaagctaggtgtctacagactggtgcttttacgatatttccatttttctatcatactactacatttggcttacagtcattttgtggttatttcacctgaatgcaattgaaaccttctttcaaggggcacacccaggcagtgaatctttgtattcacaaaacatgccaaaaaataaaaataaaatccagttgaagaaggagagggtcagctccctctctctaaggcatgcccatgaggccagctggaatgctagggctcccctggagaagcaccgcagggatcaaggttatgggggtgctcacatgacactcatgcaggccgcagaatgtatgagtccctcccttgccagaatgaagccagggtcgatcagtggaaggaatagtagtccatggagcctgagacatgccttgaccagggtcagagttcagtgagaaatggtacaattaaaatggatgtggctcttgaggccatgccctgactgtgaggcctctaatctgcattagttaagtgactttcgtaagtccctccatagaggtgatttcctttcccagtgctgttgtaacaaactgccatgaactgggtagcttaaaacaacagaaattcatcatctcaccgttccggaggctggatgtccaagatcaaggtgtcagcccaagtggttccctctgagggctttgaggaaaatctgttccaggcctcttttgtcttttccctgtgtcttcacaccatcgtccttctatacaggtctgtctttaaatcttgtccctttttttgtaagtggatcagtcacattgggttaggtcactaatgacctcactttaatttgattgcctctgtaaaggccctacctctctatcatcacatcccgagggaccgggggttagtactccagtgcatgaactgggggagagaattgatacaattcaacccatagctataagtatttttattcatttggaaagatgagccatttcctactgaagaagtccattttcttatttttagataaatgtgggagatgcattcagtttctcatgctgtcttctgtctcccgctggtattccctgcttagctttggagtgcaggagccagggctggactgggttaaggtgactggggcacaggatttcgggcggtgctcccctttaggtactgatcctgcacttgcatgagcctgagagggagagcctccttaaatcatgggccctatgtttctccctgcctccttcttcctgccccataagggaggcctctgccccagtcaggggcctggtgtgcttggcaggaatcaggcctgtgcagttcttatggcagggtttgctggtgaaagactgatttgcctaatatctgctcatccaggacaagtgcacccagcgaccaatgctttcaaggaatggattcattcctatgaatactaaattgcttagagccattttgcctacaatgttttcacttaatgactagttatcttaaaactaaaaaatacatttctaaattaaggatgtttttagtcagttgacaaagggctcttatgaaaattagcaatttatttattgaggattatttttcctaaaaagttgcaacattttaattagccagccatggtagcacgtgcctgtaatcccagctgctcgggaggctgaggcaggagaatcagtggaacccgggaggtggaggttgcagtgagccaagattgcgccactgcgctccagcctgggcgacagagcaagactccgtctcaaaaaaaaaaaagttgcaacattttatacagtatcaaaatcgtccatttgaaatatttttactttcttaattataatgattaccacttgtttagtgttgattatgtgcctagccttgagagagttttctttctgaggcataatttagtttaatcctcacaaaagcctgatggtgtagacagaggagataatcaaacaatggttcaacttgcatactgaccagttagaatagatacaggccaactcttgcactgacacctttgtgaattgctgaacatcgtttggaggttttacaaattttttattcatgtttcccaacaccaaatacatcatgtcttcgccagtaccaaccagtcattcaacactgataccaactgggtgtccaacagttcaattcagttctgacactgactaccggaagttagcacatgggtttaagggctgagctccccaacaccgtcctcacttcagatgccagttacaagtattgggtccccaggttacctacactctgtctgacatggctacaacattgggggttcccacaaccccccttttaggtgcaacaacttgctagaactcaggaaaacgctatgctcttatgattacagtttattattaagcatatgaatgaacaaccagatgaagaggtgcacagggcaaggtctggaaggattccaagtacaggagcctctgcccttttttttttttttttttttttgtgagatggagtctcgctctgttgcccaggctggagtgcagtggcacgatctcggctcactgcaacctcctcctcccgggttcacgccattctcctgcctcagcctcctgagcagctgggactacaggcgtccaccaccacgcccggctaatcttttgtattttcagtagagatggggtttcaccgtgttaaccaggatggtctcgatctcctgacctcgtgatccaccctcctcggcctcccaaggtgctgggattacaggcgtgagccaccgcgcctggccgcctctgtccctttagcattgggttgcaccacactcttcataccaatatgctcaccagcccagaagctgtcctaaccccgtcagggtattttatggagattttgttacataggcaggattgattaaatcactggccactggggatcaactcaatttctagctcctctcctctcctgagaggttgggaaatggggctgaaggttctgagcatctaatcaagactcactctttcttgcaattagcccccatcctgaagctatctagggactcaccaacctgctgccttcttagaacaaaagatgctcccatcacttgggaaattcccagagttttaggagctccatgccagaaacgagagacaagggcaaatggagttcttattatactacagtaatattatcctcattgtgcaaatgtgtaactaaggctcttggaggataaagtgatcatttataggtttccaaggagtaagtggcagatctgatttccatccctcatctggctctgcactgtgctcatatcgagcactgcccccagcccagcgtcctgcctatgccttctaggccccattcctgccctccccagctgaacccatccccattccaggacatgccccaggtgctggggcacccagagtgcctttccaaacttgactgagcatcttttgggctgcaccagcctgtttcctggagttcatcttcttgggaagatcttgtgtgtgtttccctgggtctgaaagatgagcagggagcattgctgaatggagtgtggccatgtggatcgggatgtccacgtgactatatgcatcccctaacccgcagaacacaattgggtttgagaagagaggaggggtagggtcgaggggtctcaaacttccatctattttcttgcaccagccctgcaaatatttaggccttctcttaaccattttgcaatactgcctccataattacaaaatgcttattttcccttctaccttgggtaccagtccatcttttttatgtggttagagcttacgtaattcaaatcaagtttgtttctatttagtaagacattggcattttgaaaacaaaaacaaagaagtgacacaagtagaattctgttattgttaaggccttttttgtttctttaagatacccaataataaaatatagctgggtcatgaaacacaaaatcatatggaagtatataccttagcaaatgagtttattgcaagaaacaagtattaaagaaatgattttcaatcaacatagagtgaagttctgcaagggttcaaaggcaggtaaaatagaaaataaaaaggttcctacagtgacatgaaactatcaccaactactaaaaatttttagtatggttttagtttgtttggttaccaactactacatatttgagaaatgaccattaggaacacaaaagtaaattagaagtactctttaaaaaatccataaaatacctctgaaatggtaaaaaagaacaggcactcaaatggctgcaaaaagagtcagagagggccaggtgtggtggctcacgcctgtaatcccagcactttgggaggccaacgtgggtggatcacgaggtcaggagatcgagaccatctggccgacacggtgaaaccccgtctctactaaaaatacaaaaaattagccgggcgtggtggctcacgcctgtaatcccagtgctttgggaggccgaggcgggtggatcaagaggtcaggagatcgataccatcctggctaacacggtgaaatcccgtctctactaaaaatacaaaaaattagccaggcgtggtggtgggcggctgtagtcccagctacttgggaggctgaggcaggagaatggtgtgaacccgggaggcagaggttgcagtgagccgagatcgtaccactgcactccagcctgggcaacagagagagactccgtctcaaaaaaaaaaaaagagtcagagatccgtgtgggttgaggaggcaggggagggtggttgagcttttattctcctggtctttaggtccgttgggttttcgctgagctggtgtggagggtggcagtgccatcacgctgcgtgctgagtgaatccctttggtgtgtgatcactctggtggtggcggtgtgagaagctcatacgcccttggtctctaatgtggcagagctgggagaaacttaggttccctgcttcatgcctttcaccctctttcctccagtcctcatgcttcttgttcatcaaggctccttggtggcaccctcttgtctctgcatgaatcagctctctctttcctctaggtatatccacacgcctcactgggcacctccactaactgcctgctctcaggactgaccgcttcatatctgtatgaaacagatctgtttcccatctcgatccctcaaggatcaggactgtgttgcatctggaatctctatctattcccttccctgtcattttatacttgatgcaacctgagtactcaaaacttccccataagaaacaagagactcaaacagttgctcatttagtttatgtcttggttggttacagaccgagtggctgctgtaacttctatgatgttgctgcggtcttggatatccaaggatgttttgatttttggaatccaggggaggctggcagggcatcatgtgaagtgagaattcagttgctcctgggaagggctctgggaatcccatggaggcttctggtggaggtttcttggttatccttcagtttccaaacccattttgagggcaggattagggtttgagatcatgtctcgtaggtgagtggaaatattatgtctctgtgttgggatgaagtggcttcctttgaaatgccctgtttgagtctccttttatcactggctagaaaaattttaacgaagatctcggtaatctgattgtacattgcaaagtgtatgtcagtaatctattgtcacaaaaatgctgtgtaacaaattccccaaatttcagtggcttcaagcagtaagcacttattcagccatgagcctgtgggttggccattctggttggacttggctagcggctggtctggttgcctccctcccatgtctggggttttggttgtctatgggatgatcaaacgtagtcttggtggggtgattggggtgggtgactctgcctcaggtacctctcatcctcccgcatgcatctggccatgttcccatgctggtggaaagttacagaaaagcaaaggggaacatgtcctgcctcctgaggcttcagctaggatctgtcatacttgtctttctgctactgcctgttggctgaagcagatcatataggccgcccaaaaataagggttgggaagtaattctacctctttaatgggaagaatcacaaagttatgtggcaaaaagcatgggtacaggaggagttgagtgttggaaccatctttgtacttatccatagtgacagtgaaacaagctatttaccctctatcttctccgtgcctctagagcacttacagggtgtttcaatgacctgtgtgtgtaataaactaccccaaatcctagcagcttagtacaacaacccatttattattggtcatgattctgtgggctgactggactcagctggaagctgcctccctgatgtcggcaggggccgtggtcatctgagagtcagttctctggactgtccaggacaactccctcccgggcctggcgttggtgctggctgccccactgggcactcggtcctctgccatgtgctgtgctgctgagggtatggggacttggtttcaggaggcaggaaggggaagctcccacttccataaaggcctgagcctgggactcctgaaaccttccctctgctgtgttctgcaggtcagaggcagccacaggtcagcctgggtttgaggggagggggacgagcttcagtccctggtgtgagcgtcagcatgtgtgtgcaggcagggaggaactgtgcggagtgaactagtccagagagaatgtccagacatacggaaatagccatgtgctccccagagcagggttgtgcagtgggacgccctccctttgtgaggatggcttgcagacgctccccttccgggctgaatgaccccaggagcagagtggtgttttcctgtggcacctgctgctcttaggataaggggagttgaggattcctatgctcccagaaaccttcagccaggccccatcctctcccagcctcttctcccacgagagcaccaggagcctggtcaccttcatctgcttcccggttcaatttcaggactgcacttcactccctctgtactttcagtaactctcatcccccagagggactttaggcctgggggtgggggtggggggaagtacatattttccaagacctagaaatttggttatagaaaaaaaatgcctaaggttcccagcatgtcatcttcttggtgagccaagctccgccaatcttgggaggcctccagggagactgaagacagatgtggagcatgcagatctggaggtagatgctcttcatgagaggcaattgggttggaatgggtgtgcctgtaccgtgagaggtcagaaaggacagatgtgaatgtggggaggactcctgtgaatgctttcacttgtcactacagtaatgcgctcagtagcaaatttgaaagacagccttcgaaaatgtctcaagttctgtaatcatattgtttatttttattttgcatttgttactgcaaagagccattgtaaaggagaaaacaaacaaaaaactacaggtgataaaaagcaagtgatggcttctaaaaatgtaaactaaaaaaggcatttttagtgccaaaaaagaactgatggcttggctgagatctgcagagcaccagagactggctggggaccaggtactggaggctggagcctggaaggaggggccccatgacgggagaggtccccctagaatccagctgcagtcagaaccataaccaagcgcccagggaggttgggcggcaggtgtcggtggtgggaaggtgaggggaagagatacccctctcctctcacccctgctctccagagggggccacgtcaaccaaccctgacaggtggccaggaggcaaggcaccctgctgagcccatctgtagaggtcagccctggggcctgtgacagcaaagggaggttggagactggctcggtggaaggggagggcacagacagtggtcagaacatgctgctttataatttgaataaaggaatatattggatgaagtatttatttctggaaaattcctggattataggcatctttaaatttaatttatttaagcggtgttttaaaatgtcccttcaaaatgtgggttgatacctgctaattaagtcaaaccaaattttttttgggctctggagtcagatagcctaatctgatttgaagtttggttctgtcgcttattaaccaggtgatcctggacaaatcagtaacctttatgagtcttgacgtccacagctggacaatgggaatgacagctctcagagtcgtggttggaatgaaatgagaaaatgtgtgtggagcccttagcgctcaaggaactggcgctgaagtactcaatgaatggtagctgtgctgtttactaagaacttaataacaaagctgaaaaggatgtgcagatcgcatgagttttggtgggatttcaaagtcctgttttctcagtatgatagagaagtatgccctgttttagtcccacgtcttcctttaatggatccctcattagatgctgcccacgtggaaggatgtgtggatgctgcatgtgatgtgggttagcttgagctagattcttctgtcctgtcggactagggttctcttgggctcattgtaagtgattttcccaatggaagggaagtgagttatctagtcacctcatggaccacacgtacctagaggatgcctttaggcaaacatgtttaatgtaaagctatgattcttttgccattggtgaattgtgtcctgtcctgctagaacataaaacacagaaatgcagttgtttattattatgtatgttgttccttttgtcttctagccgtcaggttctgaacagctggtagatgggctggcttactgaaggacatgattcagactgtcccggacccagcagctcatatcaaggtaagtcccgtcttggctgggaagccagctctgccttcctctgtgcctaggttttcatggatagcagcccacatatcagttaattaggggtcagtcaacacagcccaggagctaagaaaatggtttttacttttttaaatggttgaaaaatcaaaagaagcatatttcgtaacacatgtaaattgcatgaaatttacatttcagtgtccataaagaaagctttattggaacacagccccatgcattcatttctatatcatctgtggctgccttcactccataatggcacagttgagtaggttcgacaaagaccatatggcctgccagctgaaaatatttactgtctggaccttttcagaaaaaattttgctgagttaatatatgaaatcacatccaaattcttctaactcctgttataattccatctcctttatacttgcctggggttagcgagcaggagacaagtaggtgaatgattggatttccgatgttggaacgttgttttatctgggctcgccgacactcagcgctccatcacctcacacctgccctggctgctttctgacctgcacttcctgaggctctggaggtgagagggtgaggaagtgcgacttgtgccaagggaggtccctgagaggactctggccatttattttgacactacacatacatgtgggtaatagctacagggaggaaatgagatggtagttttcatatatttgacaaaaataaagactgcagaaaaaattggggcttaagctaccttatccaaacaggctgtctacacctgtgctggttagttcaactatatctatgctggccaaagtaattgactgcatggccagttcttcactttccccatactaattcattttccctaagtggtgtggttggttttactaatgtatattccttgcctaaaacattaattgaaaatgggaagggcttataattgaaagcaaagtttgtgatattgaaaagtgtacctttttgaataaaatataaaaagcctttcaaaatcccacacatacaattacacatggacgtacacacattttaaaacaatacatttggtgaggcattctggaccatgtgcagctcacatacacacacatttactttttttgaaaatggaattggaagtaataagagtttcaatgcattccttgagctttgtgggtgctccttcactttcagagattgtggtaactctagggatgtcgaggattctaaattttgcccaaggccatagaggagcagatgcttatggggacactataatttgatttctgtgtgatgttttgttgggctatgatggttgtgtttatcaaaaaaagtgcaagtaggaaatctcttgtggatgtgataaggtttcttcggaagtgctgggaacatatttgatcagtgtgtctgtgctacacaagtaaagtgggagaaagactttctttaatttttagtgtctgctgaccatgaagctgcatgatgcaaagaaaagctcatagggaagttgagacaataaatatcttctatagttcagattgtgagggacggcaactgaaattcattttattagcattccacaccacccctccaggcaaccagaaggaaatgatgaagtcagcaagaaagtattacaggttttaaaaagctaattcataaaggtgaaacaatcccatacaaacctgaaaacaccatctttgaaaatgtgtgttggtagaaacgttctatatttgatttcaggaatgaactatgttttcggctctgatttatcttattatctgaaggggtgaccttcccctccacaactgtgggtatttctagtcaggtgggacgagagactgagaaaagaaataagacacagagacaaagtatagagaaacaacagtgggctcaggggaccggcgctcagcataccaaggacctgcaccggcaccggcctctgagttccctcagttttaattgattattattttcattattttagcaaaaaggaatgtagtaggagagcagggtgataataaggagaaggtcagcaaaaaacatgtgagcaaaagaatctatgtcataattaagttcaagggaaggtactatgcctggatgtgcacataggccagatgtatgtttctctccacccaaacatctcagcggagtaaagaataacaaagcagcattgctgtaaacatgtctcaccttccaccatagggcggtttttctctcatctcagaattgaacaaatgtacaattgggttttatactgagacattcagttcccaggggcagacaggagacagtggccttcctctatctcaactgcaagaggctttcctcttttactaatccacctcagcacagaccctttacgggtgtcgggctgggggacagtcaggtctttctcatcccacgaggccatatttcagactatcacatgggagaaaccttggacaataccccgctttcaagggcagaggtccctgcggctttccgcagtgcattgtgcccctggtttattgaggctagagaatggcgatgacttttaccaagtatactgcttgtaaacatgttaacaaggcacgtcctgcacagccctagatcccttacacattgattttatacaacacatgtttttgtgagctccaggttgggtcaaagtggctagggcaaagtggttggggcaaagctacaaattaacaacatctcagcaaagcaattgtttaaagtacaggtctttttcaaaatggagtctcttatgtctttcctttctacatagacacagtaacagtcagatctctctttcttttccctacaattatcatcatattggttgatcgtattggttaatgtcaatatataatatcatcatcatattggttgatgtcaatatatgaaatataattttgagaaatcataactgagagtttttaaaaaataaatttcaactcacatggcttctgtgtgtttggagagatgaactggcaataagaagtgtggttgctaatagctgatgttggctgcgaggtagaattgtgttaaagatatttatttcctttataaacctatcaaaatcccaccaattagaattcgaataattatttttgtaattcttttttctgcatatgaaattggggttcttgacaacaaagttgggaggataattttcttccactgattcattaaaatgcctgatatgggagtttttgaagtaaaatttcatgtgcgagaagtttcttctggctttgggctgaggaacgctgctatgatttctgggaaggaagttctttttttttttttttttttttgatggagtctcgctttgttgcccaggctggagtgcagtggcgcgatcttggcttgctgcaacctctgcctcctgggttcccgccattctcctgcctcagcctcctgagtagctgggactacaggcacctgccaccacgcctggctaattttttgcatttttttttttttttttagtagagacggggtttcaccgtgttagccaggatggtctcaatctcctgacctcgtgatccacctgccttggcctcccaaagtgctgggattacaggcgtgagccaccgcacctggccggaaggaagttcttataaatggcacatgaatggttccttttgatgtattaacatatatagtggaagattttgtttttggttcattgctactaaaatgtttttgttatctgagaaggacttgagttttccacagaagtggcttaacactgcaggtgtgattcccgtgaagactctgtgtcatcacagtcctgtccgtaggctgtcctggaggagaggaacattcctttcatcttagagaaattcactctgcaaaatttatgatgactcttttctgccagaacaaatggcttttatccttttatatgtttaaggagctggaaacaataaaaaaaggaggggtggttgaaaactatggaatataaaatattcttgatttaaatagtgcaagaattgtggcaattcatttacaaacaaaatgagcaggctgtttattttagctgcttctctgtcagtgataatagtgactgtcttgaagcataatttgatttccctttctttgcaggccgttccaggtaccttttttaaaaattttttatttattatttatttttatttattttttttaagacatagtcttgctctgttgcccaggctggagtgcagtggtatgattatggctcactgcagcctctgcctcccaggctcaagcgatcttcctgcctcaacctcctgagtagctgggactacaggtgtgcaccgctacacccagctaatttttattttttttgtagagacaaggtctcactatcttgcccaggctggtctcaaactctgggctcaagcaatcctcccacctcagcctcccaaaatgctgggattacaggcatgaccaagtactttttttattacagaaattatactaactaccatatcatgcacatctactcttagcatgttaggtgtgtatgaagatacaactctctgaaggggtggagctgtcacaaccaaagatgcacccagatgattatcatcagccgacaaaaaaaatagcaaatccattttcttaggatcctataaatatttttgtcattaattctatttctgataaagcatttttaaattcacatgattgcatttcctaaaaagagttctgtctctataatattttcatttactaacatttgctgaagaggactaactaattgcctttgttgttcaccagctaatcatatagaataatacacattttggagccgatggaatgaggactggactgagaggggaaccatctgtatattagttctgctccgtggtcgccagctgtgaatcccagagatgctagtcatgaaaattctctgagctttgcattcttatccagtttcatgtcgtggataagaacacattctggctcaattcaaatcctgctctgatgtttactaacttggtgattttgtacaagttccttagtttctttgtgccttggtctcattttatatgaaacggaagcatctgttttgcagggttcgtgggagattaaacgagttagtacatttagaccccactgagtactaaacaattgtgagctatcactgtgatctataaaatgagggtggcgtacccatcttaaagataaaacatcatcctgtctctgatacctatggagcaacatgagcatgttttacaaaacactgagtggagtgaaaaatacagaaaacagaacgcgctttgtagcacatgctacttacatacataaaaaagttatatactcctcaagcaacatcacagggttttccagggtacatacatacctaaccatatagatcacattggagtgggtgcttgcctgtgtggcacatgctggctagttgctttgagaagtggttggggataagggaaaaaataatcatatgcaaataaaacaagttaataacagtgatgtttttatgtggcacagtgggtcctccatgctggcaggagcatgagtttgtacaagcacttttgtattggcttggtgttacctagtaaagctgaagatgtgcctagcctgtgatccagcagtctcaccctgggtctgtattcccttgtacctgagcaccaggaggtatgtatgagcaaaaacagaacaacccaagtgtccatctacagaaaagtggatacataaacctattgtactccaccaatggagtactatacagcagtgaaaaataaactccaagtgtctatctgtagccatgtatcagtgtggatggttctcatatgtgagtagaaaaaagtcacagattacatacaatatgattccacaaataaagattaaaaagaggcaacattaaaaagcatattattcagagaaacgtaatatgtgttgaaaagaaaaataaggaaaaaaaaccacataactcagcattggaattaccttgtcagggaggggagagttttaggggaaaggcataaggggcttctgaggtcctggggctgactgttgtggactagggagtacctgcaaaggtgtttgcttcttattctttaaattgcacaaatagattatatatcctgttttgtgtgtactatttgcaacaaaaataccaaaagaagagagaggaaaaattaggtggctcatagtgaagtcagtcttgagaggaaggtactttctagttgtaaaactcattgtactttagcaaatcatcacattagagatcacttggtctgatgctgttctagctgcaaggaaaggtgggagctactgctggtcaagtgacttccttgaagctcaggctgtgcctgttccaaagctgggcacgggccgtttccaagttgagtgtgtcctcctgccttggctttgtgagtttttccaccgcacccttttgcgatgaggaatgatttggagactgcttctgacttgggctcgtttattcattcaacaaacatttagcaaaccttccatgtaccccactgggggtggggggggagggagagaagggatcaaaaagacacagcatctgccactcagggcatgggtcacctgttctcaaacacttcgggcacagcgaagctgctagagagggacaggggagctgctgctggggtctgggcaggatctcaggggggctgcctgtagtctgcaccttcacctgctccactggctcaccccctatcacccctgtgtcctgccgacagcatctatgttcagcagccgctgcttctgcctgtaagcctcctggcagaggatcttcctgggatcacaccttgctgtctcttccaggtgaagcaggcaggtgaccctcgggtgcttgatgaggctgggggttcataggtccactcacctgtagcaggcgagtacagatgcctgaagttggaccctccatcgacacgtcctctgtcctccagctcatgaagggtgtccaggctcaattcagctaagctaatcactagatactgctccgtaagattttgtgtgaggatcaggcaccaacaatggatgacaggggaaacaaagtcactgttcaggtttctagttgctgttcacatgtggggaaggactaaaaacccagcttacccaggatttgtttgtaattaggattttcaccccttggcttccttttccctttggcttttatacttttgctcatttttatgagtgtgctggggccagatgatctcagtgtgaagcttggctccacctgttactagctgcctcagtttcctcagctgtaaaatgggaatgaaatagtgcatctaccccatagaatcacgaggaataaattagctaatgagtttagagcattcaaagcggtgcctggcactcagtgagacttattatcacatcacattacgtattgtcaatataataatatgcacaccatgttaattatataacattaatatttttaaacaatatagcatattattaatctataatgttgtatactagcatactggtgcatatagcagtggaaggggagatactgttacatatagcagtggaaggggagatactgttacatatagcagtggaaggagaaaagtaagaaggggaaatcttacggaaaaaattaaattgacccagggtcagtacttcccaagaagtgaactgaagcacttctttcccacattgttccacggctgccgctctggaagtaacgctaaatatttctgaccataaaagacgctaaacttaaactctgtgtctgtttcatagacggaagagtctaaaacagtttcagaagtagcagcgttctgtgcgaggtcactgtgaagcctgagagcccagcagatgagccgagctcttttcaataacacgaagcagatgcagaaagcgcccgaatctgccttgcgaggaagggattaggcgatgtctcggggctggtgatgatttatcccatcgctatggcgaagggtggatttcacgatggagcccccactggctgacaaaagactcattgagttgtaagcatttctcacagtttgcaaatctgatttatagtaactgtgcttcacaggaaggtgaaagtttatccttttgagaatatactcaaaagagacagagttcccccgcccccaaagtctgtctactatgaagctgatgtaagtctttgatatgctgcctattttttctcaataaatcagctttgatcagtttccagcctggttagcacatcccgatgagccctgtgactttgtggccgtgtatagctgctttttcgttttttgtactttcatttttctgcaggatgatggcacaattaaaatttctacaatgagtacttttataatcagaaaaataatattgctttaaaatatcaagatatttaatatggcacaataatagagaccctgcctacagatttctttatgtgcgtggtctcgagctggactgtaccttctgtttctccttctcactgggttcctgcacccctcagggtcgccatgctgggcaccctccagggccagattccaatgcggtgctcagttcctgtagcctttggaacggtgttcagcatgtgtgcagcagggtttagtgaagtagtgaagtgttccccagacatgctgcacaatcccccccccagtctggcgattcctcgttaagattcagtgaggctgacattcagtagggggcaccaacttaatcaggaagtgtaagaggggtttggaggagattcacaatcacttcccaggagaatgggtggaagttgcgcatggttagcctagaccccctctggggcagtttccctgaggagttggttaaaatgcagattcctggtatctaaagcttcttctccagtaagtttgggttggagcccaggatgctgcagttcaagcacctgaagtgtttctgcgtatcttgctcagataattgatagttatcaacaattaacctagccttagataatcgataaatatttataaaaggaaccatgttttttgtttctttgtttcttcattgaaggctgctgtcttttgcgtggcttctgtgaatatcctagtcacacctctaagggtttagagagcattatttggccttgggtttcaaaacatcagcaagtctcttcggctccactatttggtgtcatagagcccagaagagaagtgacacttgttgcttcttccaccttataggaaattaacttaggaatcggagtcaataattttgcttagggttagcccccagtagttgagtgttttagagacatcagcaaggttggcatcactgtctctgacttagccctgtctgtgcaattgggggttgaggatcattatcctcgttgtaggactcagtgtggggccactgttgtgggggaagcaggaattggagggtacagtggttcaggacactaaattagcattttcccatggggacacccaactctttcttactaatgaataggaagaagtcctacttattatgggtttttgctggtttaatcttcaccttcttttccttctgtgtcttctttaccttctgatcgcaaaatcccatggtgtattggtatgaaagaatgatcattgataccagatcacccaattctgcccatctatacttctccaggaagtatctgagagcactattttatcacattctattgtggtttttaatctttgctgatttgatgggtgacaatggagttttatagatgttagcacttggaaacttgtgagcttgatcatctcttcatactcttcacacacttatcaacaagttacgttatctcatttgtgatatttttggatccaatttcaatctaatcattcagaattgctgggctacagcatgaactgaacagatgatgtccccgcctgcatgaagcttccattcccgtggctgagatagaatgtgctcaagggaatagttacaaatcaggtggtgctggttggtattctccagaacaaagcaggagaagcaagagactgaggaagggagaggtagaattttacacgaaaggttagggaaggtcatagggaggaggtgacattcaagctgagacccgaagggagtgggagcatgagccgtatgatcacacggggaagagtattgcagagagagggaacagcatgtgcaaaggccctttggcaggagctctcctggcactttcaagtaacggcaaggagactgggggctggcgtggagtgaggttaaagctgcaggatgtgagttggaggcatgctggtgaggctgtgttgtagacttctgttaagcaaggataagggcatttccattttatttggcacactgcgggaggagaaccattggaaggttcatagcagatgtgatctgattgaattttttaaagctttcttgaagtataatttacattggttgaagttctaaaagaaccatgttggctgttgtgtggggaacagtctagagggggaccaagagttgaaacagggaagaccaattaggaggccattgccaggcaccaggcagcgaaaggggaggtagtgagaaatgatcagactggggatctactttgaaggtggaaaagacagcatttgctgatggattagatatgcagtgtaggagagtcaaggatgactttaaagattttgtttgtaactgggtatatgatggtgccacctactctaaaagggacatctgcaagaggggacagttgcaatgagcaggaagtcaaaagtggggtttggctgtgttgagttggagatgcctgttggatatccaaattgtgatgttgagaggttgatatgagtctagaggtcatgtgagagatatatttgtgattcctaagcctaaggctatctgaggctgggtgactaggtgagatcacctagggaccaagatgcagaagagcattagggttgagctttgggcccctccaatgcatacaggttggaaagaggagggggaactacagaggagctgagaagagaagccagtggaggtaggagaagggctaagaaactgctgtctcggtgagatgaggactgaggattagccacaggctttggccacctggacatcattgtgaccttcatatgagtgatttgcatgggtggacaaaagccaccttgcagtgaatatgaacaaaaaaaaagagagagagagaagaagtgcagacagcttatatgcaaacaactcttttgacatgatttagaaggtgtagtgagtttctcagcaatttgtatacattatattttaatgatagttcccctcagctatgtaatatttgttgtgcagattgtttttgatgattattctacctattaatttttatgatgttccttttccaacaccccatgagataaacatttttctttgatcacatcaattgataattctttttatttttcccttagcttttaacttagaaaattttatctattttattcttctttttacttctgtgtatttaccagtattctgtatagcttgtttaatagatataaaagaaagtacatcttatcgtaaaacccaccgacaaagtcattcagcattcacaggagataaggcttgtggcatccaattcagtttccttcatcaggatttctgggttctgtgcaaaatgaacacagcatcactttgcagcagtttttttttttctcttagtcccctctgcagggttgataataaaaatagttgataattagcatggacacagtaattggaaaggggcataaaccaatcagaaaagattacaattgggagcaacaggtgtccctgtcacgttgtacaccactctctcccgataccttactcgcgagtgaattggatttctggctccatgcctttctggccttctgaattttgcctctctgtcctcggatccttgctatttgtctccttgccattttggggaaaaaggaggcatttactatgtaaggattatctgtgtgcctgttttatatgtttgctagattataaattacttgaagtgatcacataatcatttttgcatcctgcattatacgttatgtatgtagcacatgcttcacatatacgagttgactgaattgaataagcaatggcaacaatgaaacaagagtgattcagggactttgttgtattctggggcagaattgaacatgtcggtattcacttactctttattttctctcctttctaggtatgattgtaaccatacaaccaatttatagcagagaggacgtgctctcacggaccatgtgtctgcgctttcatagatacctacagactttattttttagagcagttttaggttcacaacagacttgagcatataccacaagtgttctcatataattcctgcccctatacatacatagcttccaccactatcaacattttcccacatgggtggctgacgtgtaacaagggctgaacctacatcaacacatcattatcacccaaagtccagagttctcattagggttatactttaatataaacaccgtatacccttggtgttatatgttctgtgggtttggacaaacaggtgatgacacggatccaccattataatatcatacagattagtttcactgcccctcaaattcactgagctgtgtctgttcatccctcccgacctcctaggccctgacaaccactgatctttttacatctccatagttttgccatttccagactgtcatatggttggaatcatacactatgtagccttttcagattttcttatctggtatagtaatgtgcatttaagcttcctcctcgtcttttcatggcttagtagctcttcttaactttttaaaccataaaactcttttaaaattaggtgaatactatatattttctcccaggaataagaacaaacacgcacacttttatatgctcatggatctattgcagtcaattcagtacctcccctcaacccacctcccacactctcggtcctgcaggagctgggataccaggtcagccagtccctgcaacctcttgaagcagttgatgaaattgaaagtgaatttttctttgcacctatcttgctagaaactgtgttgctccttgagctcagtaggatagaagttctttgaacaaagacagtttaagaggtgcattatcgatttaaatgtagttcagatcacagatactcattctgtacttttgcatgcaggaggacggcttctcaaactttaatacatccataagtcacctggggaccttgctaagagcagatcctagttcagtaggtctagggcaggccttgagattgtgcgccacaaactacccccaggtgctgctggttctgctggcctgaggaccagcctctttaaagccaggctggaaagccctgttttccaaactacaggtcatgacccatttgtctaagtgagtcaaggccagtattaacaaaaggaaatgggatggagtaaagtggaaactatcagggcacatcacatacagaaagaaaaagtattatttttgaagattttgttttagttatatatgtgcgtgtatgtatgcatgtgtatatatatataatatctacacactgagttttataataatctacattagtttgtactctggatacattctgtgtagcaagaaacaagggtagatgcactacgttggtttcgttctaaataatagtgagcttgcaggcataaaattgcacatgtgtctccgtggattttgctgctcagattctggtatccagatgttgggattttaaccaaggctgtaaatagcagagaaagtttttttattattttaaagatcaaattccaaaattctggttgtgttttacttaattgagagtacatgttacttctgagaatgtactttaaaaagtaaacaaatttaactgaagcatggctattagttagtgattctttgtagattttctggaaagtcttgtttgtttgtattaaacattaactctgctgtatgctgtaaatacactgctaagatcaatattgaaaaacgaacaataataccaattcatatggaccttcaaattagtcttataaaattttatgatatggtattatccagccaactgactttgagactgacaaaatatctaactttaaccaggtgattcttgcattctttgttttaaaacctcaagtttaaaatatctttatatttacatttaattgtcattaatcaaaaatatatgcctaaagtaacagtcaaaaacaagtcaattttttctgacttgtgttgtttgaaaaagcccccagttcaaatatttactttctgttattgtttgaaaaaaaaaaaaaaaggattgtgtagaatttacccatttcattgtgtgttacaaaagtgacctagagcctgcaggtgtgacaaggggtgttgggtcatctccttacctgtccaatttcaccttcagggcacaatgtcctgcaagaattatatataaaatagacaatgttggcaatgagcaaagacatcaggaaagaaaacagaccaagagggagaagatatttttacctgtgaatcatttaaacaatatgctgctgttcctgttcctcagtcttttatgataatggaaaactaacatatatccaataaaaggatttagaaagacctgttacttgattcctcaaacctgaaattaaaaacaaacgaacaacataacccttaggttaggtaaaacataccatgtgaagaaatgtggctctgaataagaaaaaaaagacattaaaaaaaaccccacattttatagtattaaaaagtatgtgttagaaaaccttttgattgatattaatgcatgacataaatcaactgaaggacttattattcttgcatcaattaaaagcatttagacttacctgaaaatctgaaagtagcatgttacatacaaccctaattattgtgtgccctcatgtaaacagcaacatttgatgatcagttcactccatgaggaccacaatttgggaagctttctcatttcctttgaaatggctaaatagcgtcatgggtaattggaattatattaaattttattttccagaaaatgagtcttcatgtaggggcttggaaagtcactttttgctggtattggttttaggagtattgtgttagttaggttccctgggaagcagatgttgagacggaattaggaatgttagtgttttattggagggggaagggggctgtgcctgtgaaggataaaatgaggatgaagcaagactgggcagggagagcctcagaccaggtacagatttgatagtttgaccaacccaacggggaggtctggagcagagcttgcctttggaggggccccgggttgggcagaaatgaccaggctctagtaccctgctgtgtcagtgattggctcagggctgtctgggatgaggcagggcctgaggtgtgaacagctggaggttgttcagatgcatgctagattctttcttgaagggagatcctagtgggacacctctggggctgccatagcatctgtagaagcaggaaagggatgtagctggttccttctgaagctccagcagggttatcatttgcttgacattgtcaccctccttgtccttttttgttgttgttgcaaatttcccttttgcaagactactttctgctcagaactaaatgcccttcactcacaaaatctgtataattttcatgacctaaaatggcttctgtcctgagtgcttagatggggtcatttgctgttggacagtcccactactgtcaagtgccaccatgatgggaaattgtaatgttaaagaaaagatgaggccgggtgtggtgtctcacgcctataatcccagcactttgggagaccaaggtgggtggatcacctgaggtcaggagttcgaggccagcctgaccaacatggtgaaaccccatctctactaaaaatacaaaaaaattagctgggcgtggtggcgcatgcctgtaatcccagctacttgggagactgaggcaggaaatcacttgaacccgggaggcagggggtgcagtgagccaagaccgtgccatggcactccagcctgggcaacaagagcgaaactctgtctcaagaaaaaaaaatgattattaaaaaatttgttttagattaattttattgttggatgtttcttgggcttagacctttagataaaccattttgactctatttgttatattacctgcctctactgttatttaaggttgacgttaaatttctttcagtgattttgttaaagtctgtcatcagttagttagacctgaaatctaaatgactaaatcgtgctggccattatatcaacctttgtcctctaaaaatttgggtcccagagttggtctttaattctgcctggggctccatctcaaaaaaaaaaaaaaaaaaaaaaagggaaatgggatccatggagaaggatctattattttttttaccaagtccattgctgccaagtggaaagaaccccctcagaatgggtcatcagcaggcaggtgtgttccaggctctgcaattctcccactccaacctcctgcttctgacagatttaaggatttttggaccagaaaaaaaagtactttgggaggatcctcctatggatttccttgttctgctcctgatctctctgtgccagcccatcagctaggattcatggagcaaggtctgtggcttcaatgctgggtgctcttttgctttcattgtggggtactcacagacaccctccagcctgaggcaccggttctgccctgtgcatgcaaaagagactgtgtctccatatcgccatcacttcccctctcctttcttgctattgttctctttatattcaaattatgtagttggtacttttaatgttattttacatttccttgcaccttgatgaaagacattgtgtatttctcacctttttctgtgctgattttttatctgctcacaaatattgcctttatgactccatttctcttaaatgtggcttttaagtgtttttggttcatttgtggaaatcatttactcttccctcaatttgcgctgtaactgtcacctccgtgtgttaagtaaatcggggagatttctttatttctacatttggctttccttattgatacgtgataggaaagaaagtaattcccaaggaagactatcccagtattgtaggaatgttgtggcaacattaagccccactccatcttgcatttccatacttttgccatttactattcaaagatttggagactgatggaaaactatttcttgtttgaggcacacacactaatgtttgactttggatgagaaatttttgaatgtccttggaaaagtagaatgctgacaaggaccttgagagaagggactgtgattcaccctgtcttaaagaatgaaacttaaaactattaccaatataatttgtaccaataatagtactcatcttcttattactttaatctcctattcagtttaaagtttcttgctaaccccagtgttgacctgtttcaggctgggaaatctcagtttggacagaaggtgtggttggtcccctttctccatggtacatgtccatttctcctgctgtcatctccttgcctcttctgtgcccttgaaatcaatgatgagttgagtgaggttcaccagaccaggtttggggccaccctcagcagattctgccttaatagtctggtacctcttttttagaatgaggtctctgccaaaactgtaggacccccccccaaaacttagcatcctgatttagatcaaagaaaaaaagcaaaagatgataaaattaaatataaaatgccagttgccataggatatataaaatgataaaatagttccaaatcataagtaatttttaaaaagttttgttcattagttgaagtgcagggagaacactttgtacatcttcctaatctcagctaattctgcatctttaggagcaagaagaagggttaatatgcaggtgatgctggggtgcccatcttcatagaacagatgcccccaaagtcatacccagaacattctaagagtcttttgagaaatccagggaaatcatccacagaacacatggttttccccatgtggttaggattttatctttacctttaagaggttttacatctaaattgtcactcttattctcattggttaacgttctcagagtataatgccaagacgtctaaattgttaaaaacttaaccttttaaaaaaacatacacatatattagttttttttcaagctaatatatgtttgatcattgatcctcagagattcctacaaacctcaggttggtcccagaagtccgggggatgtcttctaaaagtgggtgacacaaagacttatgacttgcagcctagagaagcactgtctgagtgaagcccaggggccaactgtgtagcttctcagctgctctatgtcctggatctttccattttattctaaaatagtatattgcaatattgaaattcaatatggaaatatttccttgtggctttaaataaacttttcaggaatgcatattagcaactaaaaatagagaaagtctcaaatttctccacttttccaaagctattctggagatttaacacttttcttagcactctgaaggatagaacccatgatatcagtggcacaaggtcacagaaacatttagaactttctcttcctgagtacacatagctttggagtagctgaatacatgtgctttgtgagttcagtggagagtcccacaaaacacggtggaggtggcagaacctggaagacccagtaactctatgtgacggctactctagtggaagcctgagttctctattgggtaaccttggatgattgggttaggctctgctgagggtgctgggcagatgtgaggggctaccccagcgttaatcagggtaggctaatagctctaactctcaaatttcagtggtctaaacaaagtttatttctcactcctgtaacagtccagtatgggggtctgggtgcggtgggtctcctcagtagctctctgatgagaggagcaagagaaccctgctttcttcccatccagcctctacctagccttccccccactctgtgtcctcagaagcctttcttttcagccagtgggtgggagaagaatggaagattgcatgtagacctgtttcctaggccaggcttccatctacctttcattgaccaggaatgagtcacatgaccacacctggctgcaaaggaggctggtaaatatagtctgtctgggtaccaaggaggaaaagggatattggaaaggcttggcccaccccttttgtatccacaaaaggctgcagaaatgtgattggctcatatgccctatctcctcctatctccagagatgtgacttcttctctccttgggtgactacaaaataataatcttcttcattttttctcccatgacaaatcttgatgtcactgtgaacaacaatctaaaaaagtaaagattatatataataattatatgtaatctcaccaacccagatacaattaacattttaatcgttatatttccagtctatttttccatgaacaatattacatataattatttttgccaaaagaggtcatagtaactgctattttttcaattttttgaaactgcccttttatcatcccaaaatattgcatttctgcaatatggcatttttttttccatgtccctagaaactgtttagtgacctatgcaatttcatcctatgtatattctatacattttaagctaaatattttttgttggcttcagattcttggctgttatatacagggctatgttgaatatcctgtaactatctttgattaaatctatgataacttccttaggttctaatcatataagtagaatttctagaacaaagaatatgcaactgtccaaaatttttacatatatttccaatttcctttctgaagacttttaccagtttaagcacataccagtatatgacattacttgtttccccaatatctgccaatatttgttattgtatttttataatttgacagtacaaatagcaagaccttgataggtcacatttatttgcatttctttgattattaactttattagaagtgtactgatgatttatactttttcatgtccttagtccatttttccatgtggacttgaatttttcttctttatttcctcaaatgtgttgccagtgtcagacatagtgcatatttcaatatagatactcaataaaaacttgttaactgaacaaagaaaattatgttaaggatgtaacatataagttacatcctttatgttaaggatgttaaaactctgtcaaatgtgtttcatatattttctccagaaattgttgaaatttttctattaaataataatattgaaaatagaaaatttttgacaatggatatattatttttttactgagaaaaaaaccaaaactattttttatagtctttcaatatatagtttcttaattttttttttttgagacagagtctccctctgtcagccaggctggagtgcagtggcatgatctcagctcactgcagcctccgtctcccgggctcaagcaattctcctgcctcagcctcctgagtagctgggattacaggcgtgtgccaccatgcctggataatttttgtactttcagtagagacgaggtttcactatgttggccaggctggtctcaaactcctgacctcaggtaatccgcccgcctcagcatcccaaagtgctgggattacaggtgtgaaccactacccctggccagatttttaacatgtcatttaatttgttaacatttttttttgtgaattctttagttcatcctgacagaggctgttctcatcctaaattatataactattcatctgtattttctttctgtgttttatggtttaatttttaattaaatctaatctatttggattttttagatgtataatgtgagatagggatttagttttttttttttcctttctaacttttattttaggttcgggggtacacgtgtacgtttgttacgtgggtaaattgcatgccatgagagtttggtgtgcagattatttcataaaccatgtaataagcatagtgcccaattggtagtttttcaatcttcacccttcgtctaccctccaccctcaagcagcccctggtgtctatcattccattctttgtgtccatgtgtgctcagtgtttagctcccacttataagtgaaaacatgtggtatttggttttccgctcctgtgttaactcccttaggataatggcctccagctccattcatgttactgcaaaggacatgatttcattctattttatggctgtgtagtattctgtaatgtttgtgtaccacatttttttctttatccagtccaccactgatggacttctagattggttctatgtctttgctattgtgaataatgctgtgaataatgcaggtgtctttacagtagaacaatttatattcctttatatacccagtgatgggattattgggttgaatggtagttctattttaagttctttgggaaatctccaaactgctttccacagtgtctgaactaatttacattcacacacgcagcatataactgttcctttttctctgcagcctcaccaacatgtgttattttttgacttttaaaattgccgttctgactggtgtgtcatgatatctcatggtggttttggtttgcttttctctagtgattagtgatgttgagcgttttttcatatgcttgttggtcacacatgtcttcttttgagaagtgtcttttcatgtttttttggcccattttttttaaagaagttgttttttgcttgttaatttgcttaagtttttttttatagattctgcatattagacctttgttggatgcataatttgcaaatattttctcctattctgtacattgtctgtatactctattgatagtttcttttgctgtgcagaagctctttagtttaattaggtcccatttgtcaatttctgtttttgttgccattgcttttggagtctgtcatgaaatctttgccagggcctatgtccagaatggtatgttctaggttttcttctaggtttttatagttgtatgatttacatttaagtctttaatccatcttgagttgatttttgtatatggtaaaatgaaagagtctagtttcaatcttctgcatatggctagctagttatccaagcactatttattgaatagggaatcctttccacattgcttgttttgtctactttgttgaagattagatgactatagatgtgtgacattacttctgggttctctaatctagtccattggtttatgtgtctgtttttgtactagttctatgctgtcttggttactgtggccttatggcatagtttgaagctaggtagtgtgatacttcagctttttggtttcctagaattgctttggctatttaggctcttctgtggttccatatgaatttccaaatagttttttctaattctgtgaaaatgtaattagtaatatgatagaaatagcattgaatctataagttgctttgggaagtatggccattttaacaatattgattcttcctatccatgggcatggaatgtttttccatttctttgtgtcatctctgatttctttgatctttgttttgtaatacttgtcatagagattttcactccccagttatctgtacccttaagtattgtattttttttgttgctattttgaatggaattgcattcttgatatggctctcagcttggacattgttgatgtttagaaatgctactgatttttgtacattgattttgtatcctaaaacgttgtgaaattgtttttcagatccaggagtttttagacagatacaatgaggttttccagacataaatcacgtcctctgtgaagagagatagtttgacttcctctcttcccatttggatgtattttgtttcttttttttttttttctcttgcttgattgctctggctaggacttccagtactatattgactaagagtggtgagagtgggcatccttagcttgtttcaattctcatggggaatgcttccagcttttcctgttcagtacagtgttgctgtgggtttgtcatagatggctgttagtattttgaggtatgttctttcaatgcctagtttgtcagtgttttaaacatgaaaggatgttgaattttattggaagtcttttctgcagctattgagatgatcatgtggtttttgtgtttagttctgtttatgggatgaatcacatttattgatctgcatatgttgagccaaccttgcatcccaggaataatgtgtagttaatcatggtggattagctttttgatgtggtactggatttggtttactggtattttgttgaggatttccaaatccctgttcatcatgaatattggcctgaagtttcttttcttattgtgtctctgccaggtttctgtatcaaaatgatactggcctcataaaatgaggttaaggaggagtctttcctcctaaatcttttgtaatagtttcagtaggattggtagtagctctttgttatacatctggtagaatttggttgtgaatctctctggtctagggctttttctggttggtagtctttatattactgatttaattttgtaattcgttattggtctgttcagcgtttcaatttcagactttaaaccaacaatgatcaaaaaagacaaagaagggcattatataatgataaagggtccaattcaacaagaagacttaactgttctagatatgtatgcacccaatgctggagcactcagattcataaatcaagttttagggacctagtgagagacttagataaccatacaataatagtgggagatttcaacatctcactgacagtattagatagatcatcaaggcagaaaactaacttaacatatttgagacctaaacttgacacttgaccaaatggacctaacagacatctccagaacactgcacccaacaacgacacaatatgcattcttttcacctacacgtggcacatacttcaaaattgactacgcacttggctataaaacaatttgcaacaaatgaaaaaaaaccctgaaatcatactagccgtactttcagaccacagcacggtaaaaataaaatcaatgctaagaatatctctcaaaatcatggaaattgaacaacctgctcctgaatgacttttgggtaaacaatgaaactaagacagaaatcaataaattatttgaaacaaatgaaaacaaagatacaccataccagaatctctgggatacagttaaagcaatgttaacaggaaagtttatagcactaaacactgatatcaaaaagttggaaagatcttaaattaacagcctaatgtcacacctggaggaactagaaaaaacaagagcaaaccaaacttactgctagcagaagaaaagaaataaccaaaatcggggctgaactgaatgaaattgagatacaaaaaaaccatgcaaaagaccaacaaaaataaaagttggttttttgaaagaataaataagattgatagacaactagctagactgataaagaaaaaagagagaagatccaaataagcataatcagaaatgacaaaggggacattaccactgaacccacagaaataaaaaaaaaacctcagagactattaaaaaacatttctgtgcacaaaaattagaaaacccagaaaaaaagggataaatttatggaaacatacaacaccccaagattgaaccaggaaagaaatagttatttttcctcaataaatgattgttctgttgctattgaataacttactttccaactgatatgaaaatgttacttttatcacctcctgaattcttttgtgtacaaaggtttgcttttaaattatctattctgtttcctcaatccattaatcgtctgtcaattcctgactgctacccttgctgatttatctgccttatgtttttttgtgtgtgtgtcacaaaccttgtgtgaacccgagtcccatttgcaatgatcccatctctggctggttgtagttatagtctctgttttctcaattatctcaaagccacctgctcatacataataggctgtcttagcttgggctgctgtaacaaagtgctatacattgagtggcatataaacaacagaaacttatttctcacagttctaaaggctggaagtctgagatcagagtgtagcagggttgggttctggtgagggctctcttcctgattcatagatgtccatcttcttgctgggtcttcacactgtgacaaaagggtgagggaatctccctggggtcccttttgtaaaggtactaatgcaattcatgagacctccatccttatgacctagtcaccttccaaaggcccctcctcctcatactgctaccttgggggtaaggatttaaacccatgaattttgggggcacacacacattgcagttgacaaacacactatgtgtctgaacacatctcatgggcctccatctattactccaggaccctcagctcctgcttggtctcagtggccaccccagcagattgactccttctgggtgtgagggcttccacagctcagggccagcctgttacctgtcccaggagggctggcccttctttcctgtgactcagcaaccaggtcaaaaggtttccggatcctcttggcatttctgtacttggatgaagcaccccaccaccgggcgtagaacctgacttttggagtggtcaccttgggagcaggtgacaacccagacatgcagggtgactctgaccaatgaggaaggggatgcaggaagaatgtaggcaactaagttcctatttttcctccaccccatgggctgctgtgaggtagaatttttccgtgtaacctatcagaggcatctgcatggccaagggaaggcaggggctcagtgactggctgtctccatgtccccagaagctagtgtagtgacaatctcactcgcttcccctcactctcaccgccccaggtttgcacctctccaatggagcaatagtatttaatttttgtgtcagtctgtgttcaaagaaatctaggttaaaaaaaacactgtgtcctagacaaggaagatattcatttctgtattactgctgttttttcttttctttgtactttctctttttttcatagaaaattaatatttgcacccaaagaagcctctgtttcaaaagactcagctcccatgactttggcatgttacatacctaagaagcgtaaatgcaaaacaaataataaaccccaacaatcaggacattgtgcattactgtatatgtgtgttttactttgccaaattgcagaaaagtagattgaacatctagattagggaagccaaagctataacacgtggatagacatctttagttgtagatttcggtgaagtaagataactagctgtttagatctctccctgtccagggtgcacagctacagctagttagtgtcaggatgtgcaatagtttggggtccttattctgaacttctctatactctaggagccttcagatgatgcctttagtatgatgatttatcaccctggatgcaggaaacatctaggaagatgtttataaaaacattatacctgtgccccaatcccggagatttcactggtcaggggtgggcttgggcatggcttttttgttttgttttgttttgttgttttgttttgttttttgagacagagtcttgctctgttgcccaggctggagtgcggtggtgcgatcttggctcactgcaagctccgcctcctgggttcacgccattctcctgcctcagcctcccaagtagctgggactacaggcgcccaccaccatgcctggctaatttttttgtatttttttagtagaggcggggtttcaccatgttagccaggatggtctcgatctcccgacctcgtgatctgcccgcctcagcctcccaaagtgctgggattacaggcgtgagccactgtgcccgtcccaaagtcatgctttgcagagtttctacaaataactgttcagtttctctttagaaatcatatgactggccaggcacggtggctcacgcctgtaatctcagcactttgggaggttaaggctggcagatcatgaggtcaggagatcgagaccatcctggctaacacggtcaaacgtggtctttactaaaaatgcaaaaaaaaaaaaaaaaaaaaaaattagccgggcgtggtggcgggtgcctctagtcccagctacttgggaggctgaggcaggagaatggcgtgaacccaggaggcagagcttgcagtgagcagagatcgcaccactgcactccagcctgggcaacagagtgagcttccgtctcaaaaaaaaaaaaaaatcatatgataatggtctctgtttaagagaggaaaactataaggatcttggaatcgttgcctacattgacttagaaagctttatttttagaacataattttaaattttgaactaattatgaactattaacttatatatgatgacacaataaaataaaagctgttttgatttcttggtggtacttggtggaaagccagtttattggggcaatatactgtcctcaccctcaagtgatcacagattgctcaggggacataagaggtggggttggggagctgcaatttttgctgtcattgaacagcacaggggtacaatttgcatcttttcaggtattcctctttgctagaccttacgggctagaagaaattaaagagaatgaaatggtagagaattttttttggagaaaaatatcatcacacatattaccaatgtagaacaattatgattataccgttttaaggatctcagatattttcctgcttagagtctatgtattttcatttaattattaaaaagtacaggattatgtaattttttttgcattttatgccttgtggttagaccctaagtattaaaaattgcctctacttaacagtggtgcagtcttaaaaattctggctatggtagcaaaggttctggtgttggaatattgttggcctattagattcagggaactattttgatggttaagagtatttctgactgggctaagggcatcattttatctttctttcatacctatatgtggttataaatgcctagttattttgtctatgaaaatcaaatcagtttctacaacataaacagcaaaacaaaaagcatccatgaatcagcaaactttgaagtggaattttagcactaataaaagcccttgcctatgatcgagtcgccctctttaatgatttgcaggtcactgttcatcttttcctttccttgctttaccattaaataaatctctcccaggtgtcccagagagactccttagaggcagcgttccctcttgtcttgtgagaataagtctaagacactcttcattttggtgagttgatggtggggtttgtaaatatccatatggtcaaacacgcattggttgaggccatgcagatcttgttgagcaacacagaatgcatcttcgtaccttcttccctctccagcccaatccccaatattttggcaagaataaatccatagctgcaacatgggaagctagatattcatgccaaatcacgacatttgagatcaacaagttagaaaaaaaatccatgacttttcatgtagcactttagggtgacctggctcagaagttatctagggcagaccaggccaatggctatgggacattccctgagacatcttttggactcttccttcttccaacaccctggctcatattcccactcaaaggaaatggcaggaagtgacctacagacaggcagactgtctgcagagagcaaaaatctcctttgaggaccacttcatacacccacccacaaacatgaaataagtcataactgattcatcctgccagccaccagggatagttggattaattgaacactgttcttaagaaatattcagctgagggaggtcaacgaggagatcaacaaccaggtacaatgggaagctcagctttggtattctgtgctgcacactccacgtttacccagaagatgtgtaattgcttctgagaagctgaggccaggagcagatacctctaacaagcgtgttctgagtgttctctatgagacctgggagctggaccaggttgtttcttagcgctacctccagctctccctcattgttcttcttttgatatagacatcgtgatttggaggaggaatgccttggcagccagagtggagcagtcgaaaactgtgtatcataaaaatgaaaatgcattctcttaggtttgtgggcgcttgtgtcaaggcctgaagaatgagctcatatcacaatattgtggaaatattgtgattgtggaaaacgtattgcatagtaagtgttgcctgtgatagtatcacatgagcatacacccgcacaagaagggtgtgctggagtgggcgtgctagagtggcactgaaggaagcacagtactatcttttcgtatggcatgttggctttgtgtttgacagtaaagggaataaaataaggtcctcataattggagcacttctgtgtgagtagaggaagataaaaagaagtaaaaaaagaagatagaaaaaagtaaaaacttcaatgggattttagggggagtttgcacttatatccagcatataggaaaggctttgcagacagtgggacaagatgtgggctctgggagatggaccagggcaatgacagtaagtgctgcatacagaggagacacctaaacagctgactgggtcttgggagtctgggtatggaaagagttaaagatgactctaggctcaagcctggaagcctaaaaggtgcagacaccatttctaggaataagaagtttcatggagaaggatggagttggacccaaaggagaagagaggagaagtctgtagatttggttcgcaatctttgactttgaagagctgagaagagatgtttagtaggaaatgagttggagttaatgagacactgtggagttggagggttttgaagaccactgggcaaggggacagtttctttgggattggatgtggtcatgtcatgaaagctttttcagtggagctcagtagaagccaagttgcaagtaattgaagagaaagcaggcaaaatgccaaggcatgttgatggtctctatcatgtttatcgttgtgtctgagaattgtagcaccgtactgactcaattaacttttgttaatacaagggaaagtgagatattgaatgttagcttaagtggagtcaagagatgttttggattatttattttagggcagaagaaatttctcttgcacagggaaaatatccgtcacagagaaagggaggagatgcaggagggagaagacagcaagctgggaaatcatggcagtgtctgtctcaggggcgcagatgcagggattaaatttggaaaggagcaattatcaaccctacgttgctaaaggatttgggagcaagggagcgtttacctctgagtcaagagtgaagggggagaatacaggtgaagctattgagaaatcccaagagtgggaggtccaggttgaaagaacttacattttatggcttcgttactctaaaaaagtatatagaaaacaaggtcaacctttgtgagtaatgtgagagtagttttggggtaagaggcagcagaaaggaaggttttcagcagctgtgtagagaattatataggaagtgaattaggagtgaatgaaaagaagttaaggagtgaatgtaaattccaaatggattttaaaaattatgagatttgtggtagagacagacagtattagccgcatgctttttctccatcagtgcttagttctttggcactggggtggagaaagaagaccaagagcgggtagaagcttcctggttagtaagaggatgagcaatttcagggaactagtcagagcacagtgagctgactgtggggaggggagaagagccctgagttgataaaggtcctgggaaaataggatgagtcaaagaaggagagagcttcatgagcatccaggaaggcttcagaaagagcaagggtgaggcagagatggaaggagagaaggctgtggttagagagaggaattttcactagagattttttttccctcatcagttcaaatccagcctgggctgtgtaccttatataatcattttcatcatgttggttggcttgattttacggtttctgtgttcattagaataagatatcctgggaaaggaaatgtaaagtcgcctctcttctgccacagtaggatcacgtttgaagagtcatgtttagttccagacatttcctttaactatgtattctctgcagatcccactggtaccacctgagaaatactgaaaagagtcactccccagctccactgctctctttctggtccaagtcaccgtgatcctgtgcgtggatcatgactctgctttcctaattgtcctcgcttctctgcaagcgagggtctgttcttcacagggagccgggatgactgctagacattgtcagtccatgtggctccagcgctgccagccttcctccagggcctgagggccctaaccacctgatcccggttacttcttcagcctcatctcctaatgctttacccttggttctttctgctctgcccacacaaacattcttggtattcctcaccccagggcctttgcacttgctgctcccgcaatccggaatgttctacccatcatttatgacttagttcctcactttctttgggtcttcatcaccttcacagtaaagccttccctgaccacactattcaatagtgttccccaggccgggcttggcagctcattgctgtagtcccagcactttcggaggtcaaggcaggcagatcacttgaggtcagaagtttgagacgaccagcctggccaacatggtgaaatcctgtctctactaaaaatataaaaattagctaggcatggtggtgcatgcctgaagtcccagctacttgggaggctgaggcaggagaactgcttgaaaccaggaggtggaggttgcagtgagctgagatcgagccactgccctccagcctgggcaacagagtgagacttcatctgaaaaaaaaaaaaaaaaagtgtttctcacacatcaccctgtcttccttcccacttttatatccccttctcacaggctattaactttactcttttatttttttctttactgtacgtctcttccaatgagaagggaactccacaagagcaggggtttttattttgcttgtttgtggctccatcctcacttcccagcccatagtggatgctcaatgatgttcactgaatgaatgaatattgaattacctggctataaaagtcatatatgcccattgtagataactgggaaagcacagaaaactatataatataaagatatgtgtatatacacatatacatagctctatgtggaaataacctctgctaaaattacagtggaattgctttttttttaaaaaaaaacacacatatacatatgtagtttatgcatcagtagggatattggtaaatagaatgagattgtgggtatatgaccaaggggataaagatttaaaatcatattatctgatggactgtttttgagagatacttaacctggagatgaccaggatttggagagcataatatacattttagatatttgaagaattatggtgtctaagatgaagtatacttattctgcataattctggactagagcagaatccacactactggggaaagatccagaaagggtagtgttggctgcatagtgagattaattctctccggtgggccacccatctgtagggctaaattttgaagaacagagcttgacatccatagaagttcaaatagaaacacaatggcctcctgcgaggtatttgctgcttgatggctgtcgtctaaagaatctatggtagaaaagacacatttaaaaaacctttaaggcagttttaaacagctaacagtaaatttgatagcaaccacaggacattgcttatatgtctgtgggtattttcccttttctataaaatatcttttctatctattacagagtagtaactcacatggagtatctatttactgtttattttgtctcttatcaccccattggtcctcacagttttaagtgtcgtattatcacggaagagagtgaaaatgcatttcgttagccatgcataagacagattagaccaacaattcattttcttttaaccaatctatttctctatttttagaaatacattactccagaaacatcaggaacacattaagctccataataactgagattttaaagccatgttttgaagaccctctaaacccaactgatataaacacatttaagcctgacatggtcatgatgtcatttgtcctgtaaacatcttttagcctttggagaaattgtagcagacatatcagcaggattcataaacaagccagtggaaaatacacacagagaagttcataatttgagtaatttgtgttgaaaaatcacaggacatcttgatggatttataactgtcgtgataaaattaacagtgcataggccaggcgcggtgactcacgcctgtaatcccagcactttgggaggctgaggcgggtggatcacgaggtcaggagttcgagaccagcctggccaacacagtgaaaccccatcatctctaccaaaaatgtaaaaaaattagctgggcatggtggcacggccaagtcaggagaatcacttgaacccaggaggcagaggttgtggtaagctgagaacacgccactgcactccagcctgggcaacagagcgagactccatctcaaaaaagaaaaacaaaaacgaaaataaacaaacaaacaaaaacagtgtagagtatttttactttgaagctattggtactttccaaatatctgctttttaaaaatttaatttaattttacgttccaggatatatgtgccggatgtgcaggtttgttacacaggtaaacatgtgccatggtggttccctgcacctatcaacccatcacctagatattaggccacacatgcattagctatttatcctgatggatattttcaggatatctgtttttaagaagaataatgtgcattcatttgaattgctgaagtttcgttaaattcactacaaattatttatcctacatatattttaagtcagttttaagtaagactgtttttgaaataaatttgaggtattttagcataaatcactcacaaaataatttttaaattctgtaaaattctatttgtttgactttattgccttaagattcctgttatgattgttttttgagataaatttagcagtacatcagtcatttaaggtttattttacacttgagcaagtggcaatgtgtggcataaaacaagccctccctattgttataaatgaagtgtaatcaagtagattataataatgcaaggtgaaatgggagacaaagcagttcttagccagtgctatccaggcaactcacctttgtactccgaatttatctggattaccaagataattgaggggatttttgctcaggtaattgtagttgggtaatctggacttctcttccaatttgatttgaatgaagcctcttaagcagaaacatatgggcatggaagagcaagcatcggaactcttaaagggcaataaaaagtatcctaaggatttataattggatggcgtcttccatccagatggattccacagcattttaaggcttgtaaaggaaggccagatagacgtaccacagtgccctttccactccaagttgtggtcaagtgtagtgaaatttgcagcacacgaattcctgcttccttcccttccaccccagtgcctccccagccacccaagcgctcaaaggcagagctaaagcaaggagctccacccagagccaaagctttcctgatggattctgctgcattgctgggttgtgctggtcctcctctggtaccttcttaatctttgctaaagatgtatgcccaccattgtcacccccaaaatgtccatatactttgagcttggggttgaccagtcagctgacaggtggcacatactttatggaggcagatggaaaaattttacattcagcagaagagcctaattcctagcaaggattggattgagaaacaaggagcattagaaagctccagaaggcggggtctcaggcctgcacatctgtcaatatatgatgagtgatcgggcctatgcctgagtgtaaccctccttgaggagggggtttcattccactggagcaagagagggaggtggatgttcttatcatctcatggcctcacaggggaatcatttgatgtcaggattttaagagatattaagtaattcacttgccaggggtttgcagtttactaataattttatttaacttttaggttataactgtcagggtgagtcagttgtgtgcaaagcataggactaggaagaggggtgatgtggagtgactgccttctgagcacgtggtttccttttggggtgacaaaaatgtttggaactagacagaggtgttggttggacaacattgttaattaaatgctactgaattgttcactttaaaactgttagtttcatgttatgtgaacttcacctcaataagaaaccaaatatgtttgaatattttttttcttttaactggcacagtggctcagcctgtaatcccagcactttgggaggccaagatgggtggatcacttgaggtcgggagtttgagaccagcctggccaacattgtgaaaccccgtatctactaaaatacaaaaattagccaggcgtggtggtgtgtgcctgtaatttcagctacttgggaggctgaggtaggagaattgattgaacctgggagttggaggttgcagtgagccaagatcgtgccactgtactccagcctgggcgacagagcaagactctgtctcaaaaaaaaaaaaaaaaaaaaatcacgtgttggagacgctgttttatacctctgtgatgagtcaaagaaggactgggaaaatgcttcaccctccaagacgccaacctggggtcagagcatgggtatacgtgctgtgctgactatgcttacggtcagtccctgagagccgctcctcgtctatgcacatataggagcatgacccattagcaaaacaaggtgggcagaggagccagacaggcaggggcttcaatggtaaggaatatgctcaaaatgacctcttaaaaaatacaacaatgatttgtaagtatctttaatctttagctttttcactttattcgtcgatttctgtcttctcatgcttaaaaataactcaaagttatatttatatgtctagaacagtgaacataggatgtgaatcatgtaattttacattttctagtaactacctacactaatttccatcatgtattttcttttaatacaatctcccaggatatatctgaagagtccagcatagccaaaatggaatctttttaatatgtaatcaatataaaaatgactaatgagatacttttttcatagaacatcttccaaatccagcatatattttgcacctacagcacatcttaatttggactactcacttttcaagtgatcagttgtcacaggggctagtggttgccatttagactgtgcagttctaggagttgtgatttttgttgcgtcctctctggtgtcaggagatgctcagtaactaaaacataggtgaagaatgataaacatcacattatgcattagtttacagcctcagcatcgttaaagtgccttcagctcacaatatggtgaatgacataaaagaaatagtattcttttccattttatgagtgagaaaactgagattctgagagctgacatctgctcatttattcctgcccaggaatggcttaactgctgctctggtttcctagttgtcttggacaggccctgggcagtctctgttcctggaggaaaagatttatgcactgtgaaagaaactcagtcattttttacagaagagaaaatgagtctcggagaagtacagtagctctcttggtggtcatgtgctagtcaaccatggagcttgaacaagaaccatgccaagagctcttttcaattccaggtaacaagcacaagcccacatgtcttctgtcccccagcctgctggccagtcatgtttggccatatagttgaaagcaaagggtatgtaatggaattacatgactccatttaaaacagagaagctgacagactagttcactgccttagccacttagccctgggacaaattctggctagataccaattctagaaacctggaatttcccctgacaatgcctctcccagtgcagctcagtcataaagcagggagtggctagatggaagcccattactccgtaggtcacttggtcactttggacacaattctatctccttgatccaagaactaagaaggagggagaaccaactagacccaggaatcttcttttttttttaatgagaagaaccatgtttgatttttatgactttttgttatagtaaaatatacataaaatttatcatcctaaccattttttagtgtacagttgagtggtattaaatacattcacattgtggtgcaaaactcaccatcatccatctccagaacttttttcattttcttacactgacactccaacccattaaacaatagctttccattctacccttctctcagcccctggaaaccatcattttactttctgtttctgtgaatttgactgccctaggtaactcacacaagtggaatcgtacagcatttgtccttttgtggatggcttatttctcttagcgtaagataaataagacaatctcttaactttccaaaggtccatctgtgttatagcatatgtcagaatttctctccttttctaaggctgaagatatcccatgatatgtgtatatcacattttgtttatccactcatctgtggatggacacttgggttgcctccaccttttggttattgtaaataatgctgctatgaacatggatgtgcaaatatcagttcaatttcctgctatcttcatgcggaattggtgaatcatatgttaattctatttttaatttttgaatcactagactgttttttatagtgactttcccattttactctcccaccaccagtgcataagatttgcaacttttccatatctccaccagcacttgtaattttctgattttttggtaatagtcatactaatggctacgaagtatttcattgtggatttgagttgcattttcccaatgattagtgatgttgagcataatttcatgtacttattggccattagtgttatctttggaaaaaattctgttcaagtcctttgcccatttttaaattgggttgtttttgttgttgttgttgagttgtaggttatatacatatatatatatatttttttttctggatattaatcccttattagataaattattttcagatattttctcttattttataggatgtcttttgactttgttgatagcttgtttgactcacaaaagtgtttaattttagtgcaggcaaatttgtctcttttatttatgttgcctgtgcttttggtgtcatattcaagacaggcttgtgaaatccagtgttatgaagttattccctaagcattttagagttttctcataagaattttagagttttagcttttattttttggtctttgttctattttgagttaatttttgtatatagtataaggtaagagcccaacttttttcttttgcatatgtatacccagttttcccaacaccagttgttgaaaagactcctttttttctcattaaatgatctttgaaccactttcaaaagttatcagaccatatatgcaatagtttatttctgaagtctctattctattccattggcctgtatatcttagaccccagaactttcaaggacacattgaattttactttcctctcacacactaaatcttgagattttgtcagccataaatttatctatttagttcattgatacgttcttttctgttttggttatgcgaagacttaacttgcaaaaagaaatttcagtgttgaaatatttttagccaaatcaatttagcattttaaagtacagcttgattagagatttgcacaattttcactttgcattttgaaatgtaaatactgatgacagacttccattgtcttgtttgctcatgcattcattcttcccttcaacatgcactgaatacccactaggtctcgggctctgtgttgggttctacacattcaaaaccatggtctgttgcctctaagtttagtggtggatacagctgtgcaaacagttgctttaacagaggatgcataaaatgctaggggatgcagaggagacgctgacgtcccagaggagggcttcacttagaagatgaggctggatctggtatggaaggatagataggagtcctcaaggtagataaagaggagaagagtattttaaacctgggatggaatgactcttcttgaaaccacagttcttttcatgtgggctgttttcccaaatggcttgttctttgtgttactactgaccagctttccagtatagagcctaggtggagatatggcttgatgactctggtgggcttccaaagcccctaagtataagtcaggtttggttggagattacctcagtgtctacctggagagtccattaatcgatttttaggggtaacttaccagcaagatatttaatctgagtctgatggaaatcatcacatgtactccatccctaggagtagagagggggctaattgctcatggtccatggcccacataacacttgccgtcagatgtaataacccaagattgggtccagaaatggttgcttaggcagggtaaaggaggaaagaggatgagatgtgaaaaaagcaccaagaagatagtgttgattaaaaaaaattgtgttttcttattggttgaaaatatgaatttaataagaagttctttctccccctgaaatcccatagcgttttatctgtattcctcttatgaaagaagcagctgtatgataatcaagcacgttaacttttaaacacaagtgaatttgtgggatcaacatggcaaaatattagaaattgcaattgaattgaaaaatctaggaagtatagcagttttcagcagtgaacatattttactttatattactgatatttatgtccttgcaaggctttaaatatagggtacttccctaattcgtctttgggtcttccaggctgcccagcacataacctaacacattgtgggttatacatgaaggaatgaacaaataagggaaaaaaataaaggtgttttgaaaatcataaaatattcacgagtgtaagatgtacagtgggtttggtaagtgataggtgctataaaatcttttattttttaatttaatctttatttttggttgtggcaaacacataaaacataaaatctgtagtcacaaccactttacagttcagtagtgttaagtatattcacattgttggtgcagcaaatctctggaacttctttaccttgcaaaacagaaacttgatgtcaatcaacactccccgtgttctgcatgctcccaccttttggcaaccattattactactttctgaacttggactactctaggtacctcacataagtagaatcatacactgtttgtctttttgtgactggtttatttcacgcagcataatgtccttaagattcatctatggtgtatgttgggggatggtgggggtgggagagccttagggaaaatagctaatacatactgggcttaatacctaggtgatgggttgataggtgcagcaaaccaccatggcacacgtttacctatgtaacacacctgcacatcctgcacatgtccctcggaactttaaaataaaacgattaaaaaaaccactttaatttaaaaaaagattcatctatattgtacaatgtgtccaaattttcttctttttaaagactgaatgacattttattgtatgccacattttgtttattcattcatctgtggatggacgattgggttgctttgaccttttggctattgtgagtaatgctgccatgaacatggctgtacaaagaactctttgagatcctgctttaaatttttttgaatatatacccagaagtagaattgctggatcatatggtaattctatttttaattttttgaggagccaccatactgttttccatagaggctgtatcatttgatattcccaccagcagtgcacaagggttctaatttcttcatatttttgccaccattgttatttttaattttttttatatttcatagtagccatcctaataggtgtgaagtgtaaaaattattttctaagactaaagaatgaagctattgagtgtcacttgcttatcttcaagcagtcaatgcttttttaaaataattcttcaaagcagactatatgttgaagtcagaagcttctgatgtgtgactttcagggactctgaaacaggtgttcatttggcaatagaaactgatgaaacattcaaaacaactttctctcccaaaccttaaaaagaaaaattgtgacattaaaaaaaatcacaaattgtttttttcttgtcagtaatgacttactggttcatgcagaggtgaatattggtaggtaaataatcccaggactgtatgctgagaatgaagctcagagcagacccttatcagagtgtctgtcttcggaaatacttgagtcaaggagctgtccagcaggagagaggggagttataaaggctttatttgcatgtatttgcaactctttgttgcagtgtaagtataagtgaagtgtttagtataagtgaagtgaagtgtgcttctgtgtatggggagggagagaagggaggagggtgagagcacttgttccttgtataagaaaaaaaatggctctatttacatcgtaactccccatgattagtgcatgaaggaaactatatattttctgaaggcaggctattttaagaggataaaaactgtgacatcatccaggagagctaaatatcagttgagcagctagtataagaggtatatgcaatgagttatgaggctctgaaactttccacgttagtttacgccctttgcggcatgatatgaagacttttgtgtagcctaagtgttggttttaatgaggtattgcaatgtacactcaaatgaaaaacacatgatataccccaggcaagagagaagcaataactgtacatatttttgaagaagactagtcataccacaggctaccattataacagaaaaaacaacaagaattttaatacagttgtctggccaaatatattaatttaaactgaatgccttttaaaaaatattatagctgtaaggcacaacgttccattggcaagcatcttcaaaaccttcattttagaggattgaaggaaaaagtgcaagcaggccttcccggcatgtacgtttggaagatccaccaaaaagtctttgatcatttatgtgaggcttctttgagtttgacacaaagaagctaaaataaaaataaatgaatttttaaaccagttgtcgtctttgtatttacataagagaatgactgagatgccttctggaattctatggtaagaacactgggttgtgcatcagaggtcagctggtgctttgctctgtctgtgtgttgacctgagttcaaataactgagacagattttcatttacctgtgacctcatttgggtgttagccctgggttctaataattcttgtgcaaataaagtaccgtatgttgtgtgttccttaatttagaaatctgaaatctcaaagtgctttacttcattttaattcaatagtgattttactgacttcctgcttcaaggaacacagaggtgaaaaagagctagtgccctcagatggcttattacaagtagatcatttttgaccaaatgtctctaaaatcggttgagaactgatacagcactgggaagcttgttgggtcaatggacataatttttattaagggatttcgttgtatttcttttgagtccacttcacgtataaatcaccgatgagaacatcagggtggcagttacttctactatccatagagatcattgaattgcaggtatgtggagttggaaggcagctgaaaatccatgtcagactttgatcagtgtcactaaagccccattctcttgaaaatattgcaaatgatggggatgatctctttttaccttgaacacatccagacctgtgattataatcagaaatcttagcttttggctgttctcattccagttccttaaagctccttctgacacaccagcctttcacatacggcaccttctttagaatcccctgccaagaatcaagtgtttccaaactagaattgctttagatgatgggataacacaaggtgtcaaggcttcttttagttttgtgaagtaactttcgtagtgacttcagaaatgattttccatcatttgaaatggaagcctacaatcacatttccccctaaccacagtcttccagctgttaactattgtgtcttgttatgtgggtgggtgggggtggggaatcggtatatattttccttgcaactcaaaagaatccagaaattagcaccctggactcacataacagtttatcttgttgaaacccccatgtgcccaattattattggttgtctgtttgctcctgtgagtaacggaatgagggtctcaccctttgttaccttggatcgtctggctgagaactgaactttcttgttcttattctctttgtgatctactattattctggaagcagccaaggaaatactgaatcttgatttatacaccaacacaatttgactttgttttgagaggcaaaatataataatatttttctttcttctgtcagttttatttttttcttgaaatgaaccaaattgtctacacaattgcctcagttgaaagaaagactctgtgaagcttttcctggcctgggttctgtgtaacgcactgcacttgggttctgtctgaatttgactcctggagctcgccaagccctgatgtgtaattggaaacatgcacactcactcacagcagcgcttgactctgcagaatgctgcggacatttttcccatctttgttcattcttattttgtccctgtgccatgattttttaaattgaattcaaatttgcagcttctaaaagaaaaccacaagaacatgatttttaatctcttgagatttgcttgccgctgttctacatataaaatagcaatttccttaatatatctaagccagatttatgaaacaattaaaaatggcatcttatttttttttaaagtcttttaccagttaaggaagagcgtgtactaccaaagcaaaacaggttttgcctctggcgagtctgagaagtaggaatggctatttacacagacccttcttcaaagtgtgaaggagggctcaaacactgtaaatggtgattttagccttcagccagattccaaacttggaaggaaagaaaagtcctcacaaaaccatgtcgcctcatgtgaagtgatgtcatcatgttggggagaggttacctagagaagatgaagcatcttacagattactttatttgtgagctgtttctgattattccaatggagggaaggtcactttgaataatgacgccttgtcattccttctgtggggaatctacactactagtcaccagatgtgctgggtcaggcacttcaggcttcctgaccataagctccacgtgttcaggtcccctttgtgtgtgtgcccttgctggaggaaggccaacctgaagcctgctctccctgcccaccaccccaattaaggaaagctgtggtttgtgatgatttatcatcaatatctgtgtctacaggcccagtcatcttctccgagtatgaaggtttggcctgactgtagttcagcagcttcccatgtagaactttattcgtccttttgagctaactattaaatactattgagccttttctgaaatgggaattttcctctttagacatcattacaaaatcctgtgactcgacgggactttgaagatcagttgctcttgcagatctttacattttcaacgttttaaagactcttaaaaggtataaaatgagtcctattgaaatcaaattcactatgtagcacaaacttgctcatcttgatagtaagtgagccttcatgtgttggaattttcaggaaatgaagatgtcgcctaatgatgtagatggtagattgagagggatttacagttattatacttgccaattctacaccgaattgaggactctcctgtgcagaattctgccagacagttttgagaccttttcttgactttcttcccctggagaaggctttctggcctctctgtaaagttcacccaatggtcttagatccaccctctgcaacttactagaaccataggaataagtaaatccctttttcaaatggaacctttcaactatttgaagagaacacaatcatgcctcccttcaaacctcattcttgctggacgcagtggctcacttctgcaatcccggcactttgggaggccgaggcgggtggatcacttgaggtcaggagtttgaggacagcctggccaacacgatgaaaccctctctctactaaaaatgcaaaaattagctgggcatggtggtgtgcgcctatagtctcagctactcaggaggcaaaggtgggagaatcacttgaatacaggaggcggaggttgcagtgagctgagttcgcaccattgcactccagctcaggcaacagagcaagactctgtctcaaaaacaaaaacaaaactaaaaaaccaaaagtcctcgtgtcttctgttccaggacaagtccccagtttcctcaattgttctttcccatggtttttgtttatttttatttttgagacggagtttcgctcttgtcacccaggctggagtgcaatggcgtgatctcggttcactgcaacttctgcctcctgggttcaagtgattctcctacctcagcctcctgagtagctggaactacaggtgcccaccaccatgcctggctaatattttgtatttttaatacagacggggtaacaccacgttggccaggctggtctcaaactcctgacctcaggtgatcggcctgcctcagcctcccaaagtgctgggattacaggcatgagccaccgcgcctggccagccatgtgtatcttaatggaaaaaataaagacacaaatcagaacattagatattttattctaatttgatactctgttgagcctcctataggtaacgtggcttctctctaagaaaataactcatcactgctccccaaggctactccttccctagcattacccatcttagtattaataataggataaccatttactcaggggtttgtttaagcccaaatgcctagcatcattctttaatcctctttccctcatagccatccaccaacaagttctgtaggctccctcttcaaaatagatcccagtgtccagttctccacctcacttcctccaccaccagcaccttaattcacatcactagctcattctcctggagactgaagtcacccctccctcatctccctgcctctcctcttggcttcctatagactgttctccacacagaagtcagagtgttttcctcaaagtacagatcagatgagatttatgccctgctaaacaccacctcatacttccctcggcaatgtggataaaatccaagctcctgttcatgttgccaaggcccttcaagatctcacctgcctccagcaccactggctcactctgctgtggccacactggcttcttggtggttctagaatattccttattcatttctacctcagggcccgtgtgctccctgctcctgtaatataatttaaaaggttgacaatgacatcctcatttaatttctacctgaatcattgctgtgaattttatattggaaatgcagacatagtatctttttaaaaaattaatagaccattctattattaatgctaatattgtggttctctcaatgaagcttaaaaaactggctaaatcttgccagaaaggatatttaaatattaattataccaaattttaataaatagttatgtttacaaaagtttgctatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagtttgctatggcttcctaatgtataatactaaacaacctaatatgggttgaatcgtgtcagtaattgtgaagttctaatccaggttcaagtgattctcctgagtagctggaactacaggtgcccaccaccatgcctggctaatgttttgtatttagctggtccctcaaaatgtgaccttatttggaaatagggttattgcagatgtagtagggtgggcccctaatccagtgcttggtgtccttatgagaagaggaaatttggagacagacaggtatatgaggagaaggccatgtgaacgcaaaagcagagattgggatgatgcttctataagccaaggaacaccaaagactgcagcagcccccagaagctgggggagagagagcctagaacagatcctccctcacagcctcaaaaggaaccagccctgctgacaccttgatcttggactttcgacctcagagctgtgagaaaatacatttcggtggcggaagccgcccagggtgtggcactttgttatggcacccctgggaaacgcatacaatcttatcagaccaaactcacggaacaatctgagatccacagttgtgcctaaatcattgctgttttgaagacagccacatacagtcacatgttatcattgtcacgttagggttttaaccagggtagttgttcagtaacctctggcttcaaagcttctcagggcaaggccactcatacaattttgggttgccctttgctgtttaacaggtcctgctctcctggagaattccagctttttctttggcctccgtgtaagagagttggggggtggggctccatgcctgaggatcagaggcagaaaactgcaatcaacgcctcctcttcagacccttcctggtggtcacagccctgttcatcatcagctgcggtcaaaactctggctgagaaattgatccgctcaggaatcattcagggattatttaacccgtcattcctcagcgttcactaagcattctctctgtcctcagccagcaggaagttaccaaccacagggttttaaaaacacagattcctggtccacctcagagattctgattccacaggtccaggacgtagcacatacgtttccatttccaagcccccagctgcagctgaggctgctggtctgagaccacacttggaatagcgctggccttcaaggactagaacacattcttgccgcactccatgtcgaatcttcttctcactgtttcagtctaatattatgcccttgaatttcaccaagggctagtgtgggataggccatgtttgcagtgcctgattgttttagagaggtcagagaggtcatctcagagacttcactcattatggtgctcagtatgcgtcgtggaaaattactctcagatctgaggatgcagacgtattcagtcccttcttaggaattggtgaacatcttagtagatggtgaaagttctggaagtcatcatctttctcccattacttgcagaactgggatttttcttaattgctacagcgtttcttagacagaattctcaacatagttttttcagttcttaatataatttcctccttttgctgcttgattttgtactttcgtatgttctaataataccttcataccggtgtattttattcattttattttaaacggtaacatttttattataacgttaatccaggtggacattttagtaaatagagttagtacaaagaaaattaaaaccttcctgaccctcctcactcagaaataacatctatggacattttgggggattagccttctagttaatatatgcatgtattttaattaaattatgtgcatttatatataaatctttaagtttacttgaaaattagaatgaagataattttgctaaaattaaagacatcttactcacagttttattcattgccatatgtgtttatcagttaaatcatgagtatcgttctctatcatgatgcagtccgctgtgacatagtgtagactacaatatagtcttacagtcctgctctgactcttttaggtagtttccagttgttactacttcagacaaaattatgattaatattatagcagatacatttaattgatttagtataaaattatagaaacggactacttaggggagagagggagaggtgcaaattagagtttacatttttatcctaatccctactggatttgagttcctgtttctaaagaatttagtccactcatggattatttactccttgatgggcaatccctgtccttcagccatacccgagaaggacagagcatccctcatcctccagtggtcctcagtgcttccctcacacacagcacctgcacatgtaacagaccacgccatcacatttcttagtccctctcttcttcaaggcctcctttacaatatcatgtctttgagttcatactccccataaaggagttattcttccccaacaatagtcagaaaaagtattattattattttttttaaacggattcttaatggaccactgttaatcgtattgccttaaagaaaaacaagcttaatgttttgttcagagctctcattggcccatttggctttcagtccgtctctgcatttccacagacccacatctccaccgaaggtgtggttggtagaaggactggcaaagactttgcgacttgggcttgctttcttcctcttttctgcacattgcagtaacttggcaggagatgtctagaggttggtgctcccacagatatgcaggtgcctctcctcccccataaaaagctgacgtggttgaagtcacgtaacagcatttaggaggtaacgtgagcaggatctcgcaggaaggttgggtgggggatgaggtagagaaatgactcacaagcaactctgtgtcttggctcggtaactgagagagtggaagaagtgttggagggaaagcactgaggctcaggagagctttgcgcgtgcttctggtcatgtgctctgagagcatctggaagagatgtctggcaggcttttggatgtacaggtccgaatccagaagagggttaaagcttgagtgactgtggaaggcatcgtctgttagaggcaggaaagagcatgggcattaacatggcctttcatggagaacatgggcagggatacagaacccgagagagggtgaatgccaaaaagaggtggcaggaggggcgcggggaagatgtgaggggtgtcagctacaccacgtgtgatcttcacaccacaccagtagggaggggcttgagaatcctgttaggttgactctgctcatttccttggattatctgaaataaatttctcttttagttttaaaaattaattttcttgtctctttctgtagtcacaaatgatcttaattctgcatctacccctactctttccaatagttgcttgatgtggaagcagcacccgcttctaagatggactctcaatttgcgactgttggtctctttgtttggaattaacatgagctcttgtgttttgcccacttttgtgtttgctttaggaagtatttcaaacagagaaggctggagaattctctttcaagagcatttcagaagttatttgctcaccaatgctcaggatgaactgggtgatctctgcttacaggcttttaaacatttccagaataaaggacactgttactgtttctggctctaaaaatccttggatttctttctttctttctttttttaaacagttaaccactttctgtctttttcaccccagtaaagaaaatctaatatcttatcactgctcctgtctcttggagttttaaattacagaatgtttaattaccaaaggtccttttgcttattatattttaaacatgcaatgatgtttccaaaaatactctaaattgaagcagggaaagtcagcaacagctttattcaggtttcattggtgaacagctactggtttggatgtctgaggctgagtaatttcagtgcagatagataatttagctttatgatgattctgttgactaatagtccgaaaagatcagaaaagagtcacatataggaagatgttgactttttccacagtgagccatggttgcataacgattcctagtccagtggtcaacaagttgctgccactttgtgacagatttgaatttattctttgtttatagaaattcaagccagaaaggctcatagtgttggcagctgattaaagcaatttaagtttgatttttgacactgtaattaaatgtgagctcaagtcaaatagtgcattccataccccttccaggtgggcagggctctggagctggcagtgtgtcactgtctagcttgggtttggtctcagggattccaaagaaagctttgatttgtaaatgggtgggttgaagggtgccttccaaaatatatcttttagaggtatgaactaacaaaataaatgcaagaaaattggattaattttaataattctgctgctttgattccaaatccttgaacacctacaaaaacaaagtgtctcttaaatcgcagtcttgcctttggatcccggaactctctgtttctgtttatgagcaggaagagccagacatgtattctgagatggatggagacatacggaggagagtggaggcacctgagaagcccattcagggtaccgatgggccatcactgggcttttgcagccttcagaatgaattcctttcaaattatgttttcgaaaccagatccaggttctttctgttagtgattgttttcatatgaaataacattgaaatccagtagcaaattgggctagatgtagatgagaattccgtgtgggtaactggggttttacggagaattacaataatgagtggggtgaaactcagatattgaacattcatcaggggtgggagcttagagaagtagatcagggtgaccaccggcttcctggccaaagagatttttgtccaaccctggcccccgcctcttactcactgactttggataaaggattgagtctgttttttctaaatatttttcggggagatgttggtgatgaatactcattggaatcctcatttggaaaatggacttggtgttatataagatatatcagcaagaatgttactttctggattctacaaaaagttacaggaataacaaaatagatggcttatttgtgatagacaaccaactatttgatggttcatttaaaaaagtcgaaagctcaggcaggggctacttagaaaacacaggcaggatagaaacattaacccacgttatttttagtgtgccctttttgctacctaagtgtgttttttaagaatgatagggcatatttcagagagcaaacctggaagcattcaatccaatggcatttaataaaatgattttgactagaaaactggcctcacccagacacaatgcctcctttgagaaaccatttttcagagtctgagttgctcccactttgagaagtaactaccctagtccatatggaacaatgcatttcttccccaaacatattttatgtccaagagaaataatttcgtacagcttatacctactttgtttttgttattctgtctccatcatatggtatttaaaaagattgtcagagcaacgtcgttgttcagctttctactgaaaattcacatgagagtaacaactctgtctttggaactggcttgaaaaattctgaagtaaacaagaatttgctttttccttttatctaatctgaaattgatttatgagacaggacctctactgaactgtgttaaataccttggaaatattttgaaccaaactttcatactgtcataggaacagcagaaatatatttgcttgattaaaataaaatatttagatatgcttgatctactacactgtaagttgattaaaaatagttaaagtgttttaaccttgctaggaaagcagttatggcaatatccattttatgactttcaaatagcttttattgattataactttacacaatcatttgtcatattgcaaataaaagaatatggttaatatatggatttttaatttatggtatcctcttcttgcaataccaatataatcaatcttttcaaatgttagtaaatcaagatagaatcttttattagtaaatttatagatatgataagaaaaaggaacaaaaatgcatattttataaagaccattatttcagaagtaaatctttttttttacatttgagaaaaagtacaaatctcattttatatcttgtaatttaagtagccagatcttgtcaaaacttatatatgaaacagcttacttacagcatttcttaaaagcaatttatttttcctgggggcttactcataggaaggggaccacttacgaaaaattattgatgctactttaggtttagattaaagcaactctttctataatagaaaattctcaatttttgtatgatacagcttgtagttattgtatatgacatcagttataacccttcatactgagaactttagctgatgggaggaataattataaaatttaccaagagatatctgaatttcattcatatcatgtttttaatgtgcaagccataagttgcaaatttttggtgaagaatttcacaactaagagtgtctgaatctgcaaatgtacccaagacaccctttaatacttatctgatcaaacttacggtgatcttaattgctaagttaagtccattcagttagagttgcaagtagtatagttcctgtctcctcaggggagctttgtcaccattgtgtctaagttggcctgaaaatttctttagctgattactattttagtttccaaacttccacacttgaattatgtttttttgcaagcaaattcaatgaacttcacttgtaccaggttcctctctcattttattcacctggtgatgaaccgattatatttgtatggaggctatttttcccaatcaccctgaatattgttctaaatttaagctctatgcttctctctttgctttcatgagcttcttttgtcctagagtaacccccacattttttggaggtggcgtcacatagtgttttagatgtgaaataaggagttagaaagactttggtctgaggtctgtttgcttgctgtgactgtgggcaagagacgtaacttctctgtgcctgcctacctttagctataaaatgcagctaataatcgacatatctagtaaggttttgtgataactggaccagggcttggctccgtgtgtagtagccgcactttgagatgctgaatgttgcttgagaaaatgaagggaactgtgtggctggtcttactttaagttgtgtccatgaatctctgatgcacactcactgaagcccggaaatcctcctcctcgactctgtgctgtcggctggctcttctgtccctgctgggcttctaagtgatgggcaggctgaaggttcagctttaatcttggcttttatttgttatctcacttctccccactaagaaatgagatccaatcacatggcttaaaaaccatctataaactggtgattcccagtctcgaatcctgatatatccagctcccaactgatatctcaacatgtatatctatgagcacgtctgatataaagtacaaatcccgatctgctctccccaatcttgtattcttcaagtcttcttctctgtaaagtaaaaacactattttcgcagttgttaagccttaacattacacaacaaccacaaaccacagatcatctctgattgttcttttttcgtgctctctgcctccagtcaatcaccagtcctgataggtcttcctgcagaaactcctggaatgagtcacccgtcccctagaatgatgcggtagcgtcttagcttggttatcccagctttcctttgtgcatgttgacaaaccttttctgtacacaaaaccttcagaacgtgtcaaggagatcagacaatccctaattcatctttggccccaatggcttcccgccatgtttgggattaagttcaaactcctcagtaggatctggctcttgcccacctcatggacacagatgagattgttcagccctggcttgtgtctgttcctcggatgcccctgaacttgtgagttcaaaatcaaaaaggatatttgaggagctgatccttcagtctagagggctacttctctggatctttaagtagctggttcctatttgttgtgcaggttctaatttgatgccacttctcagtgaaggccatcccctccagctcctggctcttcccaagggacaagaagggtcttgggaagaactcctgatgcttcatatctaagctctgtgttccttccttgcagtgaattgatagatgactgcaaggcaaggttatcccttctcccccgtttcatctgcctccttgcaaaagtatttcacacgtgaaaagttttgacctgctaactgaggagaaaagtaaccctggaagttttttttgtttttgttgtgtgtgtgtgtatgtgtgtgtgtctgtatgtgtgtgtgtgtggtgacatggggatatcatacaaacagtattttatacaaaatgctttcagtgtccaagctgagtttcccttgtttggaagcatatcagatggcaaagggcttctcaactgcatctttctccctgcttctacatgtgtggttagggtctcagtcctaatctagttgtgcagccagatatagcatttaactgagagaataatactgcagtggacattcttgtaggtgacttctggtgcacatatacacacatctctattgtacatgtattaaatagtggaattacacagtctttgatgacagtagatgtgccgactttctttgtttacttctctaattcattctccatccttctctgctcctcttgtcctgggagtttgacttctgtcgactacatcaaatgggctcctttgtcctctatcttctgttgggttaagcaaatgagagtcaccacaaggaagcctgagagtaggaggagagagcttggggagtttttttctccagctttctctctttggtcatgggttggcagtgactttttccctccatggaaggccacagctcctattgtttatcctctcctgtgttcacagctaccggtgctgcgtgactgctacctcccttgcccttgtaggcctgagggtagtaatggcttcctgttcttgctagcctgggggacttcctcaccctttggtttttactaaattctacctttaccgttgtaaattctttcattaaattttgttcacttacctatttgaatatgctatatgcctcttattacagccctgatggataaataaggatgttttttaaactccagctgtgtgtgagagttcttattgctccacatcttcaccaacattgttagtctttgttttagacattctgatgtatctgtggtgttatttcattcaggttttaatttgtacttcctgctttactaatgaagtagaagaccttttaatgagcagttggatatcctcttttatgactgcctgtgcagtttcttccctgtttttccttgtgtgtattctgacttgtgtgtattcttattgattgatgggggttctttacatattctggatatgaatagtagattagatgtgttaaagatatcatcttccactccatgcattgccttttgattctcttaatagtgtcttttgatgaaaatttaagttcctaatttttttcttattttaatgcagttcaatttattagtctttcctttactcttagtgtttctgtgccttgtttttaaaatctttcccttcccaagtcaggaatatagttttctatattatgttccagaaacttcatagtttttgcttgtcatatttagatttatagtttatctgacatcaatttttgtgatgttatgagttacttctcaagtttctgtttctcatgtggatttctcattttccagcatcatttaccaacagtttctcccttttttaactactctgcccctttgtaaaaaaaaatcaactgccaccttcgtcaaaaatcaagtgtgtccatatatgtgtgaatctgtttctgaactttcctttcttttccattgtctgatttgtttctacctgcatgaacactattctgacctaattgctgtgcctttataaaaatgtttagtagagcaggttgtcctacctcactcttttttttaagatttgccttttaaaaatggatactataaatagatagatagatagatagatagatagatagatagatagatagatagatagatacacacacacacatagttatggggtacatgtgatagtttgttacatgcatagaatgtgtaatgatcaagtcagggttttggggtgtctgtcaccttgggtatttctcatttctatgtgtcaggaacattgcaagtcctcttttctagctgatttgaactatacaatacatttttgttaagtatagtcagctactctgctatacaacatcagaacttattccttctatctaactgtatgtttgtacccattatccaaactctcttcctctccactcccactctctgctcagcctctggtaaccatcattccactctctatctccatgacattaacatttttagctcccacataggagtgagaacatgtggtatttgtcctttgtgcttggcttattttacttgacataatgacctccggttccatccatgttgctgcaagtgacatgatttccttatttttatggccaaatagtattccattgtgtatatgtaccacattttgtttaccatttcatctgtggatggacatttaggttgatttcatgtctttgctatggtaaatagtgctgcggtaaacatgtgggtgcaagtatctttttgatatactgatttctttttcattagataaatacccagtagtgagatatctggattatattgagtcttatttttagttttttgagaaatctctactgttttctatagtggctgtactaatttacattcccactcacagtgtagaagagttcccttttctctgcattctggccagcatctgttattttttgtctttttaataattgccattctaactaaggtatgatgatatctcattgtggttttgatttgcatttccctgatgattagtgatattgagtattttttttcatatgcttgatggccattcctgtgtcttcttttgagaaatgtctattgacgttctttgcccactttgtaaaagttttctttttaattgttgagttgtttgagttttgtgtatattctggattttctcttactagatgaacagtttacaaatattttatcccattcaacaggttgtctcttcactctgctggttgttttctttcctttgctgtgcagaagtgttttagtttaatatagtctcatttgtctgttttctcttgcctgtgcttttgaggtcttagccatcaaatctttgcttagatcaatgtcctgaaatgttttctctattttcttttaatagttttataatttggggtcttaagtttaagtctttcatctaccttgagttgatttttatatatggcaagagatagaggtccagttttattctttcgcatatggatatccaattattccagcaccatttattgaagagggtgtctttttcccaatgtatgttactgatgcctttgttgaaagtcggttggctgtgaatatgtggatttatttctgggttatcaattctgttccattggtctatgcgtctgtttttatactagtatcatgctcttttggttactagagccttgtaatatattttgaagtcaggttatgtgatgctcccagttttgttgtttttgttcagggttcctttagctattcaggctcctttttgctttcatataaattttaggattgtttttttctattcttgtgaaaaatgacgttaatattttaacagggattgcattgaatctgtagatttatttgggtggtgtggtcattttaatgatattagttcttctgatccatgaccatgcagtgtcttttcatttgtttgtgtccttttccatttctttcattagtgttttgtagtttttttgtagagatttttcgcttccttggttaatttttttcctagatattttttccttatacctattgtaaatgggattttcttcttgatttctttctcagccagtgcattattgggtatataaatgctactgatttttttgtatcctgcaactttactgaattttttaattaaacctaagagttttttggtggagtctgtaggtttttctagatgtaagatcatgtcatctccaaagagggacaatttgacttcttttccagtttggatgacctttattgctttctcttgcctgattgctctggctaagacttccagtcctatattgaatagaagtgataaaaatgagaatccttgtcttgttccagttcttagaggagagactttccgcctttccccgttcagtataatgttagctgtgggttaatcatgtatggactttaatatattgaggtatgtttcttctgtacctagtttgttgagagcttttactatgaaacaatgttaagttttatcagatgccttttctgcatttattgatatgatcatatggtttttgtttttttctattgatgtgatgtatcatatttattgatttgtgtatgttgaaccatccttgcatctctgggatacatcccacttgaccatggtgcattatctttttgatgtgctgttggtttcaggctactaatattttgttgatagcttttgctgaacaaaatactagaaaacttatattcaccagaaatattggcctgtatccatgctgaactgaagtgatgttcatcaggaatatcagcctgtagttttcttttttgttgtgttcttgtctgattttgttatgagggtaatgttggcctcatagaatgaattaggaagaattctctcctctttaattttttgaaatggcttggtgaggattggtattagttcttctttctaagtttggtagaattagtagtgaaaccatctggtccttgacttttctttgttgggagattttttttcctatccaatcttattacttgttattggtctgtttaagttttcagtttctttctgattcaatcttggcaggttgtatgtgttcagaaatgtatccatttcctctaggttttccagtttgtaatagtctctgataatcttttgtatttctcactcttctttaagagcatcttgtctgtttttgactctgcatttccatacatattttagaatcactcaagtttcacaaaaactttgttgaaatattgaatgcatctgcattgaatctattgatcaatttgaagaaaattctacctttgattattaagtttttcaatccatgaatatatctatccatttattttggtcttcttttaataatattttgtagtttttggtgtagaggttctgcacgtattatgttagatttatgtccatattgtaaggtatttttaatgctaatgaaaacagtatcacttaaaaattttgatttctattgatgtttatgctgatatataaaactaaaattctatattgaccttgtatctagcaaacttttaaaactcatttattaattctaatgacttatttccaaattctcttggaaattctgtgtaaaaaaatgatgtcatctgtaaataaagttttatttactttttcccaatcctttaacattgcatttcatttccttgccttctttactaactaagactgccaattcaatttcagacaaatgcggtaatatgtggggcttctttgtcttttcccccaacttcaaatgattaaattttaaagttttgacatgaaaatgtgtggtttactgtaggtttcggtagattccttttatcaatttgtaggatttataaacttcctctttatttctaatttactaagaatttttaatatgaatgttgaatgttattaagtgcttttcttcttttgtttaaagttatataaattttctttacaatgtaaatttgattatttgattgaaacaagctttcattcttaaaataaatccagtttgttcacaatatatattattgtcgtatatactgttgggttttgttttctagaattttatttaggattttgcatctatgtttatgtatgaaattgacccataattttcctttttaaataattttctagctacattttggtatcaagctttcttttcttttatctgaaaagcttatgtaagagtggcatccttttttttttaaatgcatgttagaatttgctgataaatccgtctggcctggaactttctttcttttttttatttttttatttttggagttgtcctttaagaggtctgagatttttcaatcaatgtctttaataattataggagttcaggttttgtgttttttcttttgacagttttggtaaattatattttccaattatgtatttcaactaatttttcacatttattgataggaaattgatcataatattctattatccttccaatgtctacagcatctgtagtaatagccccctttttattgttgactttggttattttaaccttccctcttttctctctgtaatcaccagtgacttacacataactaatcttttcagagaaccagatttggttttgtttatcttctctaccatattatttacaattttctcaattttgttctcatttgttatttttcttcttctttctttgggtttttctaactttttgagattgatgcctttgcctctttcctatggaagctcacccacagaaacagtaacattattatgtgctccacttcatatttactcttctgttttatttgcagaaccaagccttgttcaagttagtattaaaatataaatgactcccacagccatctctttatgcagtgccataaaatgtgctctaatcagaaggattttatattacgtgtttttaattattcttgtgaatcctcaatgcccaaaatgaattggcaacaaatatttgtctgtagatgtcaagatatttcctcatactgatatacttctcagcataacctcccatttagtttctttgctccttgctcctttcatgctgaaacaaatcctttacccaatttcccctacaatctgaatattccctgtttttggggaactcaactcaaatttcttttgtcctagtttctttttttttaacaagtttcacttgttatcttactaacagtgtatttaataaagtcgatgctcaataaatactcttgtctcaatgaataagcttcaacctctttgtagctatattaatatatttatgtattctataaagtctaattggtagcctattattattatttttttttttgagacggagtcttactctgttgtcaggctcgagtgcagtggcatgatcttggctcacggcaccctccgactccctggttcaagcgattctcctgcctcagcctcctgagtagctgggattacaggcacacgccaccatgcccagctaatttttgtatttttagtagagacagggtttcaccatgttgcccagggtggtctcaatctcctgacctcatgatccgcctgcctcggcctcccaaagtgctgggattacaggcgtgagccactgcgcctggcccgtaggttttaattaatatatttaaattttcttggcatttcagtatttctatattataatgtgaattattttaaaatactttatctgattacaaaggtagcacacacttgttttatcctaaattttctcaactgtttgacttgaaaagggggcagttactccatgatccaaacctcaaaactgaaatttgtattttaagatgttttctctgcatatgctaatatacatatgtgataattttctaaaacttattatactttgaatattttctatgcagtacattaatatctatctcattcttaatactgtgtagtataattattcaatatctgattgaaagacgtacagtgtattttcatattttactgttactgagcagtgtaatagcagacatcctttgtacttataactgtctattgtgagtatttctaaaaaatagatttctagaatatcaattgcggagacaaaggataaattattttattcccattatacacgaatgtcaatgctttttcctccacattcttgccaatacttcaaaatattacattttttcattgttgttatctggctaggcccaaatattgtgtggtggtttatttatttttattttctttaatctgttttcacttttcttggatggtttacacttatggatagtaaactcctgtgatggtgactcgtggtcatccaggttcttttgcattgtgtgggttaggatgggcaggacacactcttgtatatgtaccagctgttggtttatgtgattttttcaggtcaatctatcccatctgacaatataccttccattaggctgacagtctgtcatgcacacagtgcacacacacaattatattacaaggctgataaaaccgaattgctctgttccagtggttctcaactgggacagtttttggttgcacctttagggacagttggccatgtctaaagacagttttggttgtcataattggagtctgcgaggtgttactggcatctagtgggtagaggccaggaatgctagcaaacatcctgccatgcacagggcagcccccacaacagataattaaccaacccaaaatgttgatgctgccaaggttgagaaaccctgtggtctattgctgtgacattttagtgcttctgttgtatcacaagtgtaccaatttgtgttaattttaacacatttattcttgcttaaaaattgggatgtatcttaaaattgattgattagaaagtattacggtgaattttcattggcagaattgttttttctttcctagtgatactttaaatcatgatgtgctttacatcttaccacccaaagtcttagatttgaggaaatatgatatgattgtgtcttatcttttatccctacatatgtgcagtctaatttcagtgtaggaataggaagtctcgtgtagcatgacagtgtaattgctgtatttgtaggtattaaacatcaatcaatgcctagctttgtacccataggcattccactttgtgcctgctctaaggcaaaacacaatattcaatgctggaaataatttcatatttagttttatgttaaagtagttcctcttagatttagtaaatagacaaaatattgattgaatgttcaaatgtagggtggaatgattgatttattcatttgggaggttgtgaatcattcctatatctattgattttgttcttcatttatattcattacctttaaattcaggaaggttattgaaaattcagggggaaacatttgttaggttgctaactccttcacactaaaccttctatgttttcttacatttacaagcagtctaataatccagtgaatcccttacatactgaatgttgggaaaaggtcatgacaggaatatctagttttcaaatcttggtttgttaaagatcagaaatcttccttccagatcttggtttgttaaaggtgatgatcacctaaactaaagcatactcagatgatggctgcttgatataatggagtgagcttttattcctggctcttataggagaaaatctgtaagtggtcaggggaaaatcgatttcaatgtgtactgtcaattcctttttttgcatttgtaagtgagaaaaaaattaggtggttaaaaggtggcagttttgagttattaagaatgatatggattagcctcaacttccatgggtcactacgaggtagccgctgatacttcacatctggttttggtttgcagtaactgacaaagaagcacaaggtatgtatagccctattgttagtgtcgttccactcttttaaagacaaaaagctccccactccaaaagtactgaaatattttcaactccaatttacagattaggcaaaacctcttgagttaagggtcactaaaggcagctgaaaaatttctttgcaaacttctcagtgttctggctgttaaagaaaaatagtaaaataaaaagagctccccagtgtaagaattccatgaaacagagagtgacgtgtgagacgcattaatgctttccattcctgatgaaaagctcgaacagctttaagtaatgtggaatccagtatctcaaatcctagctccgtctgggaggtgagttttgggtgtcctagctccctgggattggaagagcaacacgttgtctataggcattccatatgtgagtttaattatgataacttgacttctttaaagaagctttttagatgtttggggagaatcccactcaggactgtggtttttctttctcctgctttctttggggaaggagcacacaggaccatggttcccagaaacggagacacactctgtgaacctgtgcacgtccctgtgcccacagcgaaggcccctccagtgatcagccaggcccaccattgcagccttccagatggctctcattagagtcaaaattgactgagggaagcccctggggcgtcctggaagccttagagaccatgctagggacagagcctctgatttctaggagctaatgtttcagagaaaataataacagcaccttctaaacactagagcttttctctttagtaactcaaggtaatgaatccccaccctctccctctgcttctcatttaccacccctatttctctgcaagtcacaaaggggaaaattgaagttttctcacatctccttgggaaagtaatctgaggttgatgggctgagatgtttccagagaatgggaatggggtgccaacagcatggaggagcctggggagctgctggtatcaggcatagagtgaagaccaaagttagggatgggagaggagggtatctactctcatggggcaaagtgaccctgaggcacctctacatttaatgagcctagaaagaaaaagggtggaaaagaataggaaggaactgttgatgttcccttcttatgtcctttctgttgggtcaaaatactgttgtaattttggcatatttttctctctatccaatatgcaagttgtttgtttggctgaatactgcttcacttcttttctgcacctccagtgaccgacaatgcttagcacataggcaatgccaatcaagattgatgaatggatgaatgatcatacagaaggaatattttctgctgtagcaacgttgcaaaagtttcttcttaaggaatcttctgatggtatgccgatgcccggttgctatataacaactcactgcaggactcagtggcttaaaatcacaatgatcactttattatttagaatctctcatggttccagggcttgattgggctgagatagatattatttgcttggagtctcttataggtttgcagtcaagtgccggttggggctggagtgatcttggtttcttcatttatacctctgggggttaatgctggctgtgggctgggactgatgactggaacacctacaaatggcctcgtcacatggcttgggctttctccccgtatggtggctgaggtttaagagtggctgttcccaagaaaatcaggtggaagctctatcacctttccaaggtagccttggaagccacatagctgaacttctgctgtagtcacagcccaactcagattcaaggagtgggaacgtggacctcactttctgatggaagcaaagtcaatgtcactttatagaaggttatgcatgatgggacatcctactgggccatcttgggaaatacagttgccatggtggtatggcaaatgtctagaaatgcaatcaatataccattctaatggtttctgataagtacgtgtgaaaccaacccagttgcctaaatagtttggctggaaataattttaatcagagttactttggaaaattacaaggactaagttgtatacaaatgggagctcttattttatattgaaatccagataaatctgctgtaaaataatcatgatgccagcaaaatagaggatgtatactcatccactcatccactcattcattcattcgttcttacagccggtattttttttttattgactatccacttgcttacaggtactattagctcaattattgagacggaaatcccataagatacagatttgggaggcttcttagagaaaatttaccttcctcactgcccaatgactcaatctaagaagacagcttaaaaaagccacttccacagctcacagggcctgcagctagacttgggagagaggtggtgacagtggggagaagaggggtggggagcagatgacctcctgctctgtctctctctctcatctgttcatagatatcgataccatccattgtgtgtctgtgtttgcctgtgtgtctgtgtgtatatatgtgtgtgcatgtgtgtatatgtgtgtttatatgtgtctgtctttgtgtgcatgtgtgtttgtgtgtctctgtgtgtgtgcatgtgtgtgtgtctgtgtgtctctgtgtgtgtgcatgtgcgtgtgtgtgagagagagtgatgggggagccactggttcctcacaacttaagtcccagctgtcatcttaactttgtggatggtcagcaggcagtttaaaaacaaatgaaggcactgatgctgggcacgttctgttcagaactgagggactggctggtgctttggccacagctgggcctggccacattcctaaagaggagccacagctggctggactgaatgaaactggctgggcctgtcccagttccctcctgtcaactgctgttgagagaacctcacccatcccaggggagtcccaagttcaagtcgaactctgggctcttgaagggctctcctggactagccactgacacagccagtattgctctcccctgatactcctgggctctgtggccggcttcattcattcattcattcattcattcactcattcagtaagtgcttgttgagggccatcactgacacagtcatgagggaatcctggggttcccctcccagtgtcagcactggggctccgggaagatggctgccttccatctccaatgcattttaatttcttctttgaacaaacctgcaaagttactggttgattgaaaaaggaatattggcacaaatgaattaaatgacgcatcggggtcaccgagcagttggggatgaagccaaggtccctgttatcaggatgctgcatggactcttcccttcggagaaatatcacgaaggctccccgcctccagcgcgcgccagtggacccctcctgtgaagcagaggttagccctgcactcagggtcctcagttcctacctaagccagctcatcattagcaattcgtattgtgcatgctggcaatgcagagcccaggggcgctttttgtcgagccagcgtcttttatctgcagttgcaccccagcgaagctgggaccggaatgtacgactgttacagggtccgggcctcctcccatctagtttgcaatgcctctcacatgcaaaggttatgtttgtttccttttaaaaatagcagacgagcaggtgacacactgccttaattatccttctgtagaacacattgaaaactagcctccctgttctactggcagagcgagaggaaaatgtatcctaaaccgcagtgggtgaagcctcttcagatgtcggtcagagccttacccacacccagccccgcccgacagccgtgaacacagacaaacaactgtcacccattgacctcacgattccttggtatatgaaccaaagtggaagcggcgagaaaaggaaatactgcagatatttttaagtagaagcaaaggcaggaagaggaaagttgcaaaattggttatatttctttttgcttaagtgcataatgtttggatgaccaaaaagtcagtgtaaatgtataataagattattttcaaggaaatctgtatattaagttttaaggcctattttacttcatatatacataaagtaccatttttagaagtgctatactccatgcatattccaaaatactacacgttttttttgagaaaggaagggaccgtgaggcttttttcacatctgatatattacagtataatccatattcctcctataacacttagttctggaaaaggatctactggtgtctgagtttaggcaggcactagcactgacgtcagtattgtgtacagagaaaacaaacatactctacatttaccgaatttgatgcaactcacatttgggaacatattgaacaatctaaaattattgtaaagtggtaaatttttcaggctttaaaatcattaacagtggcataaaacaattatacaatttccatggacaaatctcacccccccagatttatgcctttaatcttatattcagatctgtgtaattcatgtttgctcctaaaacgtgtatttctttatgttctataataatgaacaatccaaatttttcaaaaaaaaacaccatttctgcattataaatgttagatcttaattttaacaagtaaaaaatgagaccactttgtaaaataatgtcaattcaaggaatttaaatcaagaattaggcacactagtattctctctaaaggcctttttgaggggcatttagcaccctctagtgacaacaattcaagccgttcaaagggaacttccctgcacgactcatgtctggtttctagctggcaagtcaacaatgcagtgtagttctttaggcaggaggtggttgcttcctaaaatccttgaggcaggattatttttgtagctgtaaataaaggctggaataatctccaccaggcaaccgcgcagtgggaaaaccatgatttatccctatcggctataatattctttggcttatcatggccagtccactcagaaagaacatttctagtactccttgaacactgcagcctttcccaaaacatgtgctgagatctgtgtgggcatcagatgacaacaacaaatttactgatatcatcatttcagttcaggtcggtgcatttaacgggatttaacacattttcataagagtgaattggaaaagaactggcctgccttcacttcagctgcacctctgtgtcctctgcgttgcttgcagtgggagataatacagtgtggagagggtgaggtgtggagagggggcgagggatgaggagggctcaggtggagaggataccatgtggagcgtaccatgtagcagttactgcgctgagacagactcccagtgtcctgtgctcctgacttcaggcacgggtatagggcttcattgcatccgcaggtagcctggtgatactcatgcaaatataaatgaatttgtggcaaagattttttgccttcgcttcatttctgattccatttgtgatggaaataaattagtaaataaatcatcaaatgaggtgatgctgaattaaagcccacctcaaccgaaaactaaaagccaactttagaaagcagcaggaaaaattattaatgcaggcttctacatcaatttctatcaattgaatgctattatagtgccacttatgatctttctttaagaagtaatctgtattttctttaaaaataattcataaaatagtgacagattaagacaaaaataagtgatgctgtttagtatcttataggtgagattgacacacttcttaaaaaatcatttaaaactctgactagaatcaaaatcaaaattaatttcaacaacctgggataaattctcaatttggccaaggatggtgacaggggacagtacctgggaaaggatactttggatctgagtcgggggtagagtgggatgccagtcagatgcttttgtgaatcttaattatatgccctgtgggcatacgaagccttatgggcaccaatggcaacgtgatgtctgtagcatctatgctcagatatacccagttatacggacaaagaagttgaaactcatttaatggtttccaaattatatggagaagcctaataattggaacaatacatttaaaagttattttaagctaaataatggtgacaaaataattactctcctcttaggtttctttcttaaaaccacagataatacattgacctatttggagtccttgataatggttttaatattcctgcatttttaaagtcatatggagttgagtaagagcaaaattggcctaaacttgagaacgtgtgggatgcttatgaaattgtgtttattgaaatcattgctccatgggagcttatagaactgaactgacgtgtgcttcagtattaaggaaattgcaacttggtgttgagaagttgaggatttggtatgtgataacagtttccttggtttctattagttcagatcaaccaagagactgaagaatacattcaccacttagagaaagtgttgaaacaatggttatttaaattgtaattggattatttcttaatgtgctgctgggggatatggcactcccctacccccccacacacacaccctcatacacacactcacacactcatacacacatactcacatagttgtatccaatggagtgaagctgtaatcatgaagtatgctgtgaacagaaaaaccgtccttaaacagcgctgactgggtgcccttgagggctgagagtgtcttcatgccgcgtatgttctcaggcaaatcctccgactgctgcagatggaaaagttccatggagtgctggagttttccattgtgcggcagccccagatgcttgattcttatctacaatctcaggcatgttcctggcaaaaacccctgggacatcgttcttgcggggctctcatgaataatccaaacactatgcattttaaattcatgtgtcatcttaaggacaatatacagcacttttgtcctattgttttgtccttaaaaacctgcgtttcatgggtcgctcccaggctctgaagttttatgtgtgcagaatttgaggagactgagataggcttcccgaatgccgagacatgcggtgactggatagagccctgtaatcctggcttcctgagtgcccactggagttcctggcaggaaaaggccattaatatcacctgaatggattaatgccgcatagatggcctccacgaaactcttgagcgtttctgggttttcttaataaaatgaaaaaaaaaaagagctctatgcttgctgtagacatttaaaaaagaacaggcatttgggcatgctaaaaggtttgacacctacaagtattgtgggctgcactttttacagaacatgcctgtatttttcagatatttacaaaaatgaacaacattgcatgttacttacatatttttatattaggatataatttatgtttattacaaatttatgttttgaaaatataagtgaaccaaagaagaagaggggaaaaaacaaaaagcttctctgccattggtattataagatatagctgtcaatatttttactttgcctttttatttattttttattttttgactattacaaaaggttattggccgggcgtggtggctcacgcctgtaatcccagcactttgggaggctgaggcgagtggatcacaaggtcaagagatcgagaccatcctggccaacatggtgaaaacctgtctctactaaaaatacaaaaaattagccagggtggtggcgggcacctgtagtcccagctactcaggaggctgaggcaggagaatggcatgagcccaggaggcggagcttgcagtgagctgagatcacgccactgcactccagcctgggcgacagagtgagactcaaaaaaaaaaaaaaaaaaggttatttaacaaaaagtctaatatgaaaacatacatgacctaatttttacatatagtgaaacaggccctttggagaggggacatgggtttttctgttgaacagccattatttatactcattccaaagtttctaatatgatgatactatttccttgtattaccaccgttccaatactgttctgctgccaactagttgacatctccacacattcatctatgacaagattcataaagggatcgagtccccataatattccttggacatgtctgccaccattgcatttcatttttcaactcgggaaggttagcttcgctcatggtgtctattcctcaggttcacagatgctttggaacagaatgcacggccatccccaactgcctttttatttttaacaaaatgagtctatggatataattctcctatatactgtgattttttaactaaccaggtaaaatatcagagcagttttccatattgctaagtgttcatctacgacatcattttcctgcaatgtttttgaggaggaagggcgttccattgtagggatgtatagggcagggataaagacgtgaatgagtcatgagtgaatcttctgttgtgtccccacagatgtggaggttcagacggatctcctctctttgctctgcgcatgtattacattgagaaccatgtggctgtcattcagagtgttcttagctcctaaccttcctccccatattccatacagagaagttagtaagggaacaagaatgagaacttgttcgatctttagaaaatgggaagaaatgattttaggataaataaatactagtgtttcttttattgtgacagtgaatttatggtatatttatgttatattattttgtttctttctttggagtaaaatgtgaggagactagtggaaggttttggcagattcacaggggatgggtttgtggcagagaagcatgcaagggaaatgtgtgctttattcataggttctgctgtccacagctactgtatgggctgtgctggtctagtgtggtgattactgcatctcaaggagagtgaaaaaggaccctgccctgataggctcatggcaggacgggcctcaggtaggggccgtgtgccagattgccccctaacttggtccgcgtggtggcttggagggcatatttccctagggagaggaggtatcaggtgggaaaggcagcctggttcttaggctgctgggtggtgtagggatgaggccatttaataacatagacttggggtacaagtgaggaaagctagagtgatatctatatcttcagataatttccccataggataatatttgggaaacggtttctgcactgctatattctagttaatagatgtgccttggccgggcgtggtggttcacgtctttaatcccagcactttgggaggctgaggcgggtggatcatgaagtcaggagatcgagaccatcctggctaatatggtgaaaccccgtctctactaaaaatacaaaaaaaattagccaggtgtggtggcgggcgcctgcagtcccagctactcgggaggctgaggcaggagaatggcgtgaagctgggaggcggagcttgcagtgagccgagatcgcgccactgcactccagcctgggcgacagcaagattccgtcccaaaaaaaaaaaaaaaaaaaaaaaagatgtgccttgtcctatcaagagccaaagatttttttaaaacactttacattaaatagtcagagattaccaggcttggatgctatgatgccatttgaaacatcaagaattattctctttgaagacaacaggaatcaatcaaacattttgtcattagaaatgaggaggagtttcctttgtaaaattttggaacagaatttaccactcagtatccccaaattaactttttattagatcactttttatgtttgtatgcatttccaaaattagacgcagtaaaacttatggatcgaatattgatcaaataatagcatctgtttttctcttttttagtatccaataaataaatttgtctcttataaaacaatatttttattagttagaaaatgatggatatatgcatgcatgtatgttatacataaataaatatgggagagagagacagagattgagagagagagagcatgtgtgagagaaagcagagaaaatgatgtacattggcaccagtagacaatcagagttaaccaggcaaagggtattaggagtttggtgtattatcttgtggcttttctgtaagttggaaattatttcaaaatagagaggtaagaaatcccactcttcacagtttgatttgcattaggcaagaaccagggagttaaggccaaatcatcactgaagcattaggtcccagtagaaatgctgatctttcctgctgcagggaacaactgagggctggattagcaaccacgaggcgtgggtgaggcgggaccacacaggattttcttccgtggctatttcattagcaaagcgttcatcttatttaaagctggtgtttggtaaaggcataatcaggtgccatgtgttgtggaggccacagttaacattttacattgatgcttcttaggagagaacaaaaagcaaggacactcagggaagctgagagagcttttctcctccgcactccagaattctagtggaagctgcccagataaaacagctcaggactttgaaattttcggggaaacagaattttaatcagcctgccatcttattcattgttcagagatgaaaagagcggaaatcaacaccccctcataatgtaggtgctgagaacttaggttctgatttccacagaatgattttcttacaatatactctctttcttttcttttccttctttctttccctccctccctccctttctccttccttcctccctccttcctcccatcctccttcctttctctctctcttctgtccttcctttctccttctccattttttctcgccctcttccctccctcctcctcctcctctccttcctctccctttccccccttatctttctccttctcctccttcttttgtcctaacatgaggtgataaatcagaggtatataataaaagccagaatgacctgggctggtggacagaactctgacacatgccggcctaaagtctgagtgaaatccatttactgaacgtccagctctgcaaccaggaattgtcagatgactcaggatttagtctattgtgttcttggggtcgcctattgagaccacacctctttatgggtcctgcgttcctgtagctagattcaaagcaaaatgtttcttccaagcaatttcctgaaaatgagtaattaaagtcctgaaaccctctaaggaatgttcaggcctgcattcgctgtacttccttcgaggagaaaacagacctgtgaccctgaacttatagcttggattttagacatgtaatggggccctcacatggcatctctgggtagccaaaagttctatgaggatctgttgtctgcaacatggatgtctgtcagagtgagaccagctcactgatattccgggacatttgtagtcacttcagttatttgggttttaataaatacttgaaaacaagacttaggaaggtttatttttcctctttattttttgtgtttactgtaagcctagagtccttgcgttttcaacaactttgttgtagagcaaataaaaagtgcaggtatttggaaggagaaaatgaaactgttctggaacacttatatgaaatgttgaataaatataggttgttaaaaatcagccaggcaatggctgttactgaacatggccatctattaacatgaaataaactccacctgcaaagtttccttttaggagaaaggagctcaagtcctctgtcctagtaattctgcgaagaattgggctgcgaagggctgacacccagggcagtggggtgccctcaacgccttggctccaaggtgcttgcagcccgtgtgaagccatgcggagtcccatcacatctgcatcctgccttggtctcagtgcagtgtgtcacacggcggcacaccggtcacacctgctgtggcagtccccatcccaattgatgccttttctttttttaattaaaaaaaaaaaatctcctggctgcatatcatcaagaaaaacaacattgttttcagggtctcttatctctccactcccaaatatcctgtttctttgggctggacagccaggaccaatagaaacctcttcctgccattggctgacttcatttcccagacttagcacaatctcatccgctctaaacaacctcatcaaaactactttctggtcagagagaagcaataattattattaacatttattaacgatcaataaacttgatcgcattatggccagcactattaaggtaaggaaagggttccttttaatttgacaaaatcttgttcttgttactcttttctttggtttcctttatcaaggcagataagttagggttgggcaacacccccactgccacaatagaggacaacaagatttcctttgcactgcctagtaaatttcctttttcctactccaaccatccgcaaggcttaaaaacttcaaactcagaaaaaaattggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcccagtggaagcgaagagatactcggcaagtggctgctggtaatgggacgcaaatgttgacttgatttgtgggacatccacgctgagaactgagtgctcacgtaactcaaatgggggtaatttggtttgttccactatatgtttatcttcaataaaatacctactgtctgtgcactgtgagtaagatttcttccagcaatggttaggtttgcggagattggaaagcaatggccggtcggttctctgtgctgtggggtgtttggtctgatgcatttccttgcctaagtttttagtagatagcatgtagagattaatgtggaggtaaatctgcacaggtacaatcctaaatatggcctgattcctggaaatgaagccaatttaatggtgactacaagtcaaggggcatgcagtcttgaatgggggtccgttcagttgttttaaaggccaccatgccttcgtgacatttgtagaaatgtgaaaaatcagcaacaaaagcagatgctgagtggagggaaaagaaaattgtgtttgttgcatgtctttagttttgctgcacggaggtgagaagcatttggtggtgttttcataaggcttttagtttgttggaaagtgcataagaaaatggaagtttgcccagaattgggccaagccattttcaaaaatactctttggtttggtattttcataatttgaaatgtttgtattagaagatttgactcatatgtaccatagaaactgtgtttgagaagttcagcttttatttctcaaggtgtgttcaataatatattaaaaatctgtgtaccaagaactttcaccttatacttttctttctttggcttcaaggattggaatctgctgaaatatggctcctatagacaggaattataaaattgagagttaatgtgccctacttatagctacatgaatagaaattacttgattttgtgacccaaaatgttatttttttgttcttattttcatccttattcatatgcatgttaaatcaaatattctgtgtaaatcttgaatagcttgggtacgatcttatgtggttttttttcccaaaaaactcagtgcattaaaaaggacattgaaataacagaccatcctttagaaggtaggtacattttgcaaaacatccaaatgtgttatactgtttaatttgaagtatacatttatgaatacatgaagctattttgaaagtttgaatattttgtgattttctgaacacttttttggaaataatagtttacacttgtctaaggtactatgcttgatttaacattttattacattgcattatgtgtttattgtatgtacccaagtgaacccttagaatgactacaggtgaatttttttttaatcttctgttaaaataggccctctttataggtgacttcctttaagacatgtttctgttagatttcctgggtaaagtaatgagatgattttacagccttgtttatagagtggaaaaaggaggtcctgagtctgttgactacagtttcaattacgttagcgcaaagcccaagttagcatagggaaaatgatggctgtccactggaattaggaaacagccccccatagaggcaatttccagtctcaatgcactctgtttttttgttgtttcagtaaataaatcaattagtcgattaggtatcagatgctctgaattttttaagttggttttctgcatttgagtggagtttttatttttttgcattaacatttgtaagaccctatgagacactatgaaaagctaaatattcgtatccagtctttgtgattcttaccatcattttcccttggtaacttgaaattgggaacaaaatgtttcaattggaagaagtaaaggaattttgggaacttatgtgagagtgttcatttatctctaagtgtctgtgaattttaagatcagcttaagagttctagtaaagacttggaagcaacaaagctgatggtttgcagacaattcactgattggttttggtgcttcccttgggcattggtgacatctgacaatattgagaggtgctgaacctcaccggccccactgtccccacaaacatctcagtgtttgctacagactgcagggatcctgctgttgcactgaaaactcgattgtgcttcagttaggagttttagcctaatttcccaaagactttcctgattcctttttttttaatgccatctgcaatttgggaagtctagtgaagcctacagtcctttctcagaataatactttctggtgcctaaaaagaaatacatagaattacaacagaaatacagtcctctccccggaccttttaaggagaacatgaaccccaggttgcaagttctgatcctagaaagatacttaatgtgtaaaaagggaatgtgggggattttccatcatcacagagatctgacattgaaggatgtggagagagccagcagccggcagcagcatcaggggaaagcatcttaaaaatcagacaggacatggaaagttactaacaaggcttggtggagacctgagggcaccctagtgctatttccatgacttgcctaaagaagttacttttttttgaattaacagaggttggaaggtttgatggtaattgaaacacgacctgataggactcaattttattaatttaaagacataaagcttgcattatatacgccacgtctgcacatttgcacttcttgaacgtttgctatcacatgtgagggaaacttaattaagactaagagttatatgaagaaagttaactcctcacagaattttgatggatgtgattaatgagtttaatagctacagatttatgatttttcatcaacctgttggctaagtgaaatacgaattgcgtcagtccttgttactttagggggattccgggagaatggaaggaaggccaggggcaaaatgccgctgccctgctgtgcataagtcatttcagagcatgctctgagtgtttgtccttgccgaaaagtggctttacaggcaactactttaaaacaacttgctgcttccgttcttggtcagctctgtgatccaggctgccctctgtggacacagcacagttctccctggccctctgcctgtgtgtgcatgcacccatgcatgccaggcaccctgactcagtgaccctggaaagcaggattgagaatggctccatctgtgggcttttcttcccccatgaaatacagtgcaggactgcaatgctctcagacaatgtgctgagcctgaaccatttcttaattatctacgtttataagtgattatctcataaagtttttgttttgcaaaacagatctttatttaaacacaaacacaggttaacaactcttgaaaaagcatacataaaaataagtaaatgaaacaaccatttctgttgtcttcaggaaaatatgactgatacatttagaactttagaataagattccctctgtgggagtggagacccaaagccattataggcatcccaacaatttggcggatttattggtttaacagctgatacataagagaatcacagagtaagggccatggggaagccagacggatgagagtttctctgaaatgagaaacctcagagaagagacagggacagtctccaggctgttccagcgtttggtagcacactgtgctctggcggggtcttttctttggagctacctcaaggagagccttcttgtcccctcctttgaccccacaggatagaggacaactgctccctggcctggggattctgtcagaccacccctgatagcgcttctctcaccttacgtggccgcagacacacttgcatttgcttccttcctgttgtgaccctgggcaaggtagctagcctgtctgatctcagtttcgtcacctgtaaaatgggatcataatggctaccctgtctcgcacccatcctcaataaatggcagatgccatcagacgcccccccgcggatgtaaccttttctaccgtattgtctttcaggctctgcactcactcgtctcaacatttcccacggcccagcttcagctgtgaagcccacagccatagactgctctgatgtgcggcctcccacacccaggcagggtacatctgggtctgggcagccacaggacagggaaggaaggaggagggagcttgcaggggtgcttgttaaaggtgtagcagggcaggtaccacacacaggggcaggtggagcgtccaggggtcgcccgaggtggtgctggtcagagagggttggcttcgtcctgttctgagccgaggctgctggaggagggcagaggcctatgactgcatcgtgctcctggttagggcaggaacagcaccctggaataccccactctcctctttactcctgaattacaaaaaatacatcttgttctttagcataaattataaacataaaaaattcttatggtagagaaaacgtttaaaagtcatcacaaagtcaatataaattgttcagatcctaaccaaccacagcaaattcctaacaattgggatatgtctctccaccgtgtgtatctgtttggccttgtatctacctacctgtcctgctcttctcagttagcattgttttacaagcattttcccatgttactaacattttttgataagcaaaatttttgtttcattatattctatctaaaatatgtattaccattttataaccaatatcctagtgtataaagtgatgctgcttgcgatgtttcactcattatattgcagtacaccatctatttaattttttgaatactttttattagtattggtgcctagaaaggaattattgagccaatgggtatatatattttttaagtctttgccaaatttaaatatttgccaatttaaaaaataattaccagattattctctggaaggattataccagttctccctttttctagccacatatgagaccagttccacactacacccataacaactctgaatattttactctttgaatctttgccattctgacagataagaacagaatctcatttttatttgtacttctttaattttagtatttcattacatttttttgtttgtttgctgtgaacccattttggctagtggtccactgtgacctctggattttttttcttatttatacttttattctctgtttggtctagcttactttccacatatttcccctactgagcttggccaagacatgttttataaaatttcacatcgattcccatctgtccactctcccactcttcattttctttcctgtcagcacattctcccagctttgcttgtgtttgttgttgagtgtgaataatttatgtatacccactgatatcgcagaagctgtttttagtgatatcttatccatttcttctgtgtcctcaacagtgactggcaaagagtagaggttcaataagcacttgttgaaaacataaacttaaattttaattatttgaaatcataaagaggaagttaagatatcagagtaatgtaattatcattgtagacttcaaatagaattcttatgtttttagagacatttctcctagtaaaataacgttaattaaaattgacttaaattgatgtttaagaaagtataaaaaatgtagctgtagtatcttgaattcataatccaaactaacatcatcctaataactgcttgttatgtgccaagtcctgtgctaaactctcataatgtctcatgtgatcctcacagcagcctgggtactgctgctttcttacagataaggacaaaggattagagaggcgaagtatcttatacaagtcacacaaatctgtctcccttctctttatcatctgatctcttttttcctgctattcaccctagctgtacatagtgaattactgtgcagagaaacatgatgtattaagtgttatggagacacatgaaataattggataatgaaaattattatcgctggttactttatgttatctactcttctgggaaaaatcccataggcagcaattcttatactctaggtggctaatcaaaacaaagttctagaaaattcaagaggtaaaactctagcactgaattctatatttgctcagtgacaagaattctttccatatttggcgagatccaaggggcagtgcttccagattccagatcagctgctgatttaaatttcctcatcccaagtatcaacttccttgcactcgtcttgggcgtcaataatgaacacgcaggtcagagttttccataaggccttaacaagtctttcagcagggtgttcatggaattaaactctgggaagaacggtaatctgctgttgtacacagataagtacagagacattttgaaaagaaatgctaaggccaagcaaaatgatttatttttaaagtgccacatcagaatccaatcataacattaacctcagggctgttactttaaacacgtttggtaaaaacaatgcttgtcgaatttttgaaaatataataactttatgcaaagatcccgcactcttgcatttaacacattccactttttaaatccttctgccttgatgatttaaaatctcccttgctggtttttttgttttttaaatttaccaagtattgatacagaatcaagcactgaagacaggacccttctgctacctccacattcacattccccccaaggccattcattcagatcgtcagccagcagtgagtttctcatctccatgctctttgggtttcatcgggttttattgggtctttttttttttttttttaattttgacagtgtgcacatgatgctcacctttgaggaagaagaaactgttgaaacaacactttagaatctgtcaacacaattagtttgtgtctcaatttgaggtagatgtcccaagacattgctccaagttaaaaagaaaaaaaaagtatgtggttttgcattgcgtagtcctctttggatccatacgatatgtgtgccttccctgaccttccagagagcatcaaaaacatgaaggttgaatccagagagcacagcccacttttatctttggcccagggaggcacttggtactctgtatttcttcgtggcatccttaaaatagcctctgtggaaaagggattggccttatcttccgtgcaacggatgggaggcatagatatagctgctggcaaggggaagtggaaagaggcccatctgggagagggtggcccggagctttagtttgatgctgcaggacttccccaggtgaacgcacctctcctggccctagctcccttataggaaaatggaggtggtcagctccgccttctccacagtgaccatctgctgactgtgctgctgccaggacgcagggggagctaacagcagtgcccctatcggatcttcaaaccggggaggggtctcgtgcagtgggcaggggaaatgggctcccacctggcttttggggttcactccctggctgttctacttcctggccatttcacctttggcaagccacagcctcacaggagataggcttttccatcggtgaaatgggtagagtgatagttcctacttcacagggttatagtgagattcaccaagtcgcaagagcccagaactgtatatggcacacataagctcctcaatcaaagttagttaattttactattcattcaagccaaatacatttttcttctaagactaaaatcagggaatctatgaaaagcatttccccctaccttttttttttcaatttctacaacagtttgtgaattgaattttgttttcaattagccaatttgtccattttcctgtgatgaacatgtttttatctcttcattataaagtaagaactctgacagacacagtgagctcccaattattcacgagcacctgatctgcattggagattgcttaaaacagggctgggaaatgcttgctggtgagttcaccggacactgcacagcaggtcctggaaggagacattcagggcgttgttaacttctgtgtctccctattcttcttattctccttccatactctttctctctcattgcaatcgctatccacctggaaggcggcttgaaaaacacaaaagacaacaaggatgatgagggggacccctcctgagcctcttaaatgctgagggatccttcctggacctgtttttattcattccaagctgcctctcctagacaatcacttctcttaccccaggaaatctgggacggtgcaggtttgcaagcttgatctggaataaagaaacaaaggaaaagacggaccaggaggcttggcctacgccaggcaaaagtcagcaaaagcagccactacacatctccttttgagttctaacttttcactttgtcttgtgtgaactcctaaactggaagcatatttatagtcacgtaaaaataagaatattgtccaaggccaaatgtaagtgacttttatgagttattggactttgtgaattactcattctaccaacctgaattaacatagatagttttgttgactttaccttctttgtaagccaaacagtatgaactcggttaagccggtcttaggagaaaagacataaaatgtgtgttgctaggatagcattctagtgaaggaagccacttctttgtttcttgtgcatccctgtgagggtacctctgtccatcccaagagctgttttcatggactcactgttgaaagcccaagcctattgtaaccaattttgataagctggttacaaaataagcacatgtatacattttttaaagccttgttcttctggagatggaaaacatctttttttagatcacatgtttactgctttggtaaacagtaaaatgctgctacagcaattaccttgaggataaagggtttgtagacagatacttcctgcgttcacttcctacacagatagccagcccaaccagagacgcactgatgcaggaagggctcccagtggaaacttcctctctccgaatgcgtggtccattattcgttatctcctctccaaggggaataagcttgttgctccagattttctaggagaattctgtcttgaaacaggtaaaaatataaagtttctaaagtaatgattacagtacctcgttctcatcctcggtgtcatctactcggtgatttttaaggggacgtgattagactagaatagacttgtctatgagtaacatgccccgtaggcacctctgtctcctttgaatcatggaaaatgatgcataattcgaatgtttttatatttggtagaaaaataagtctctttgagattcaatggaaggccttttctatggttagttgaaaggtcattttagattttgctttctttagtcaagcagagattaccagatttgggtacaaaaaatatcagctcacagattgttctctgtgctgattttacagcagttactaaattccaacgaatgcattgtttaggccctttgaaccgaagcaaataaaaccacagtgcacacacactaaacaatagggcatcatcaattagccatctacaggatgtgtccttgcagactggcccctttgtaggagaaaaaaaaatagatcaagtcaacaaacaataacactgaacaataaactaaacaaaataaatagcacctgggagccccttaagcactggcgaagcaccaaagggtgatgtttacacactgtacacacggaaacccacagctccacccagatctcctgcaggtccctaaaatactcaaagaactcagcagccaatcattgctgggtcacctcatgttgaagggtaccccctttggcgatcagaaaatgctgagcctcttaaatgctgttttcattcactccaagctagctctcatagacaatcacttctctcaccccaggaagtctgggacagtgcattgcgaagggaagaaggcagtatctaacagagccttctgcctggcctattccataagtgccgatgactgccaggtggggggcagagattgcatttgaccccgagagactgccagacatggtgagatgctgtcatgtctcacgtagatgttattgcacgaatatattctagtgattttatccacatattcaatatatgtattttgtatttaacatgaaattgaattgaagtgaaattgcccaaagagatattttcctttagggactcatttcttcacatacttttgcttatcttgttggaagacacactatgtcaatctcagtatcctgtttgaatgaagactgctttcctcctatgtatctgttgcccctagacagtcattgtgcagcttgttacctttctgtgaaactccatgagacagctccagcattcatccttacaggtgctacctcctgacacttctgcttctttgcaaaatgacttccctgatctcctgagtctgtattgtttccagtgctgcctgaaccacatttgggtgatgctacaggaccagacagcagacagatttgtcatggatgcctgatgggataggaccctgttggcatcctctctgaaaatctcccttgcctggctagggattgttttattttattttctttagcctgtagcaaatacaggttcagtatctccattgaataatatattgtagaaagaaaggcagtaataaaaacttcgttctttttccccatttgaaaaacaattattataggagtttagaaaataaaaattttaaaaacaaaattaaaataattgatgttacaccatcaagggtctttgaatactcgattcttttttgattttttttgtctttactcctgtaccaatgtatcctttttaaagaataataaaatttgagaaattaaactcattgttattagtacctttctatccacttcttttttttttccaggatagtgaaaaaaaaaaaaaaaagaggagtgagggctgaacttgttacgatttagaaattaaggcccattttccttcttaagaacccagtttctctatatgaagcagatccagaccgcaggtccctgtcccaccacgcctttcacttccctgtgcctcgtttcctcatctgtagaagagagtcagtcatgataataactcctacttcttggtagtgttgcaaggattaagcagcttaatacttgtatgtgctttgaacagtaacgtgctgtagtgtacaaaagatgtaaattgcagaccaggcatgctggcagctgcctgtagtttcagcttctcgggaagccaaagcaaaggatctcttgagcctcagtatctgaggtcagcctgggcaacctggcaaaatacctcatctcataataataacaacaataataataatgttagctgttatgggctgttattggttacttatcctagtcacagtcttcttatttaatttactctcatatctcaattgtttttttgaagtaatcaattatcttccttgattgtgtttgtttccagtatttgtctttggaaaggaatcctgcatttatacctggttatttatagcttcttctaaaggggtgaaagtatttccctacacagtcatgcatcaccatgcccggtcagttctgagaaatgagttgttagatgatttcatcgtgcaaacatcacaaagagcacttacacaaatgtacatggcatagccggctgcacacgtaggctacaggctataagtgtagcctgtgctcctaggctacaaacctgtgcagcatgtgaccaggctgaatactgtaggcaattgtgacacttaacacaatggtttttatgtatcaaaatgtgggaaaggtatagtaataatgcagtagaggccaggtgcggtggctcacacctgtaatcccagcactttgggaggctgaggcgggcagatcacgaggtcaggagatggagaccatcctggctaacacagtgaaatcccgtctctactaaaaatataaaaaattagccaggcatggtggcacgcacctgtagtcccagctactcaggaggctgaggcaggagaattgcttgaacctgggaggcaaaggttgctgtgagctgagatcatgcctctgcactccagcctgggctacagagcgagaccccatctcaaaataataataattattattattaagaagggaaaaaaatgatacacctgtacacctgtataaggcacttaccatgaatggagcttgcaggatggaaagtggctgtggatctgggtgaatcagtgagtggttagtgaatgtgaaagcctaggacatcactatctactactgtagacttataaacactgtatattggccaggcgcggtggctcatgcctgtaatcccagcactttgggaggccgaggtgggcggatcacgaggtcaggagatcgagaccatcctggccaacatagtgaaaccccatctctactaaaaatacaaaaattagccgggcatggtggcgcatgcctgtaatcccagctacttgggaggcggagggaggagaatcccttgaaccagggagttggaggttgcagtgagctgagattgcgccacagcactctagtctggtgacacagcgagactccatctcaaaaaaaaaaaaaaaaagactgtatatttacactaaatttattaaaacatttcttcaatagtaaattcatattagattactataactttttttacttattaattttttaaactttttgactcttttgtactcacttagcttgaaacacaaatatgtggttcagttgtacagaaatattttcattctttatatccttactcaataagctttgttctattttttttttaactttctaaactttttattaaaaactaagacacaaacacatacattagcgtaggtctacacagggtcaggatcatcaatatcactgtttttcatctctacatcttgtccctgtgccactggaaggtctgcagggacaataatctgtgtggagctgtcatctcctacgataacagtgccttattttggaatccttcttgaaggacctgcctgaggctgttttacaattaactttttttttttttggaaatagaaaaagtacactctaaaataatgatgaaaagtatggtatagtaaatatgtaaaccaataacatagtcaactattatcattatcaactattatgtactgtacagaattgtatgtgctatactttatacaactggcaacacagtaggtttgtacaccagcaccaccaaaaacatgtgagaaatgcattgtgctacagtgttactacagctgtatgtcactaggccatagagatttttcagctccattataatcttatggtaccctcgtcctatctgcagtctgtcattgtccaaaacatcattatgcaactcctgaatgtatgctaattgctttgttctcatgctattcctttgaggacagtagagaaaacataagagagttacaactgttattccatttggtggctcaactgacatgttaaccaaactttcaacagctgaactcaactgcatttttgtgagcccagaaaatcagtagttttgataatttaaagttggagaaatgaaggacgttcattgtttcctcccattcttatgctttgggtgatgctgttaaataaatgaatgtgtttgtgcaatggggagagaccactgttctctggagtggatctagaggttaaaaagtcaagctattttgaaccaactacttagagtggcacattctttaggggaggtgagcagggatctattgaattatcatattgctggttaatcatgattaagaatctatagaaccccgaccgggcgcggtggctcacacatgtaattgcagcactttgggaggttgaggcgggtggattgtctgagctcaggagttcacgaccagcctgggcaacacagtgaaaccccatctctactaaaatacaaaaaattagccaggcgtcaagaccagtaactcaaaacgtgtgttgttaaagttctatgccttaagttctgtggctgttgtcatgtaacctttcagtcatgctgatggtgcctattaaaaagcaggctatcagtaaatgtccatttcataaatgaataaataacttcctgcatgacaaatgcatgagtgagtgcatgaatcagtgatgtggctggcaccctatattaaaatcacaaagaattgctgttttttaaaaattttttatttttttgagacagagtctcactctgtcgcccaggctggaatgctgtggtgcaatcttggctcactgcaacctccaccctctcccggggttcaagagattcccctgcctcagcctcccgagtagctgggactacagacgtgtgccaccatgcccggctattttttgtttgtttgtttgtttgtatttttagtagagacggggtttcaccgtgttagccaggatggtctcaatctcctgacctcgtgatccacctgcctcagcctcccaaagtgctgggattataggcgtgagccaccatgcctggccgagaattgctttttatatcatgaaagatggagtccattttccccagatgcatatacaattgttatataccacttatattaacaaatccatacttttccaaaagagtggtttgaactatgactttttgatttattttttaaaagttttattttatatatttaaggtgtacaacatgatgttttgatatacatgaagatggtgataaggttctgatagtgaaggcaaattaacatatccatcatcttacatggttacacattctttttttgtggggcaagagcacctaaaatctactcttaaagcaaaaatcccaagtacagcacagcacggtattattaagcatatcccttatggtgtacgttagatctctagacttgttcaccctgcatatttgctactttatattctttgacctacatctccccatttccccattgagtctttgtttgtttgtttgttatagattttacatataagtgagatcatgcagtatttgtctttctgtgtgtggcttatttcacttagcataacgtcctccagattcatccataatgtggcaattggcagaatctctttttgaaagctaaatgggccgggcatggtggctacgcttgtaatcccaacactttgtgaggccacggtaggtggatcacttgaggccaggagttcgagaccagcctggccaacatggtgaaagcccgtctctactaaaaatttaataattagtggggtgtggtcgtgggtgcctgtaatcctagctatgtgggaggctaagacaggagaatcacttgaacctgggaggcagaggttgcagtcagtcgagatcatgccactgcactccagcctgggcaacagactgagattccatctcaaaaaaaaaaaaggctaaatgatattccgttgtatatatccaccacaatttattttatgtattcatccattgatggacactttggttcctttcatatcttggctattgtgagtaatgctgcaatgaatatggcactgcgggtatctttacgagatagtgattacatttctttgggaaagtacccagaaaagggattgctgggtcatatggtaggtctatttttaatttctttaggaacctccatacttttttccacagtgtctgcaacattccatgttcccaccaacagtctgcaaggattcccttttctcacattctcgccaacacttactatttcttgtctttttgaccatagccatctgaacaggcgtgaggtgatacctcattgtgtctttgatttgcattttcctgatgattagtgatattgggcaccttgtcgtatacccattgttcattattatgtctttttgggaaaatgtctatccacgtcctttccctatgtttgggaaggtcagatgaccgggggctgcccagaatctaatgagtgctgccgagtacatgatggtcccttccaggccatggatgggaatgtttcacttgtaaattaaaagcaggaatacagtttccaggcaacccatagcctgcattttgctacatgacacttgccttgatgagcaaaaccaaacaccactttcatttttattgagcagcaacacctaccagcatttatccaggatttgcattgggtcattgaaatattcaactttgacaatctattatataataagtctttctggacatgaactagtgacaagttgtattaatgtgctatgatagggactattcatttttcttcttttgttactacagtcacctctttgaaatgtcagtgaaactgtagcaatcttttaaatatgtctgctggtgtctagtatattgattcacactgagggtttctgtattcattggaatcaggcaaattacaacacagtacttattatataaataacatctctaatggatatgagatagcataacattttcaataatagctacgtttgtttttgtattcagtttcaagatgatctgctttataataaagattaattttagcaagtaactaccagcttatctaagccaaatagtaaaactgaaaacccttctgtaaatttaagattatccagcatattatttaacttagtgagccttactggttaaaacattatatataggccaatgaaaatgtaatctttcataaaatctgaagtattctattatcttgataagatttttagtggactgtttctttaatcatttaagaattcatatcaccattgtttccacagcgtccgcatgtaaagtgctactctgtttcctgaatgaatgaatgcatgaataaatgatgcatattgaaatctttccctgagtaaagcatgcatttggcaatgtatgtgattaaaagaaatctgacttggttcctctcctagaagaactataatctagtttttaaggagtcaaataaaaggaaatgacctttatttgagaattaaaatgttggaaaaaacttgattggtcatttaggagttcattgtttctcaacctaattatattttggctcagtatactcttaactgtttttaggataattaaaaggaactcctaagagagctaggatgctgttggaggagtaagtatgcatgaaacaatcataatttaactaatttgcccacaaatgttagcaggaaaatataccaaaaattagattttgttttccattcgttatttttcttaatttctaacataatttttaaacaaaactgagagatgtttgtcaaaacacctcccaagtgatgatttccattagaatatgaactagacacttttcctccagtgggataagagccagattttcctaatcacaaaaattagggcatggtcaggcaaaggagtttacatgaaaagttttgcaaaattagtattactttgaaaatttcaggctatttggccactgcaaccagggagtcacttaattcttggcataaactccagcacttttggaaattgacctaactctataaggcaaaaaaaaaaaaaaaaaaaaaaaggccatatagtgccctaaagtggcaaaatttttgttaaaaacagcatccacaagtactgttaccagtttctcaggatagctgtgacaaattattacaacctagtggcttaaagcaagagaaatttattctgttatagcttgggagtccagaaatccaaaatcgaggtgttggctgggttggtcccttctggaggctgtgaggaaggatgcatctggtgcctcctccagctccgggggttgcctgcaagccctgtgttccttggcttggacagtagtcctctcttatccgcgattccactttccatggtttctggcagtttcatctgctgtctgaagatattagatggccatttctagaaataaatgaatcatacgtcttaaattgttcaccatgctaagtagcatgatgaagtcttgtaccatcctgccctgctccacccaggacatgaattccccttttgtccaccgtatccatgctacagatgctacctgcctgttagtcaccgagtagccctcttggttatgggatcgactgtcacggtatcacagtgcttatgtgtaggtagcccttcttttattcagtagtagccccaaggcacaagaggactgatcctggcaattccgggtatgttaaagagaagccgtaaagtgctttctttcagtgaaaaggtgaaagttctgtacttacaaggaaaaagatcatatgctgtggttgctaagatgtacagtaagaatgaatcttctgtctttgaagtttgaagaaataaaaagaaatctgtgcttgttttgccgttgcacctcaaactgcaaaactgatgaccacagtggatagtaagtgcttagttaagatggaaaaggtattgcatttgtggatggaacagaaagtgttccagttaatggcagttgggttcagtcctgtctgaggtttcagacatcccctgggggtcttgtagtgtgtcccccgtggataaggggagactgctgtagatgcatcccttccgtctctgcttttgtcatcccacgaccttcttctttatgtttctgtgtgtcctgctcagcctcttatgaggatgctctcactggatttagaacctaccctaatctatgatctcattttaatcattaattacatctgcaaagatcctacttctaaataaggtcatattctgaggttccaggtggacgtgaattgtggggagacactacttagccagctacaggtgggaaggagaccaggcaggtctcaagggtggcagcttcaccaacaaacaacggttgcccattggaagagccaggctccattcactgatatctcccaacagaccaggtcctgatggcaagattgttacactcatacttaagtataaatcatttatgtgcaaacaacattttgaaagtgccaatgcaattagttttgttgatgaaaaaataaaactttatagcatggatattaaccattatattgttaaatccagcataatagtcaaaataaaatcactgtaaggcaaagtgtttactctgcaaccatttcagtttcacaagatactgagtatgatgttgtggttttccttatctcatcattttacttggtaagtgtcgagacatgcaaaagcttagggcagcccacacagttcgtcagaagcacacgtggggagtttgttacttaggcagccagtcacccccattctatgtgtcaagcctggactaatggatgacagtggtgattacatcctatgaaaaatgattcatgtggctgtcttcaggaaagtcttcacgttgcacctacacagtcctaagactgaactcataaaacggcatcctatactaatattattgtcaaacactatgatttctttttgtcttctgtctttgatatctgcacctaaatattcaggtgttactcattcttatgaaatgggtcagattccaaataaaaattgaagttcctcttatcactgaccatgagggctctgcaagattgtcttgggaaagaagatttacattaggagctaggtcatggattcttgtcatgtctgtgtgtgcccttgtctacgtccaatgcacacaggatgaaaaactggtcagctcacgtgcccatagcccatcttcacctcacctcaagctaagacaccaagaaactcccagtgttcctgggagaaccaggccagtggaatcctgggcttgcatctaatttggctgcaaaaatggagatggtgcatatccctgcaatgtgagagtcagtcccacttgctctattttcacagttccttctctgtacagtaaggattttcttagtcttacaaaggcaggaaaaggaacagttaagcatgtaaatgcaaaccatgaaaacaagacctgttgccaggatatcttgtcccagggtacagtagtacttcccatgtaacacacatcctctaccatgccactctccaaaactgttattggggccggtctggagtccagcatgagtgagatatgtcatccttataagtgagataggctcagcctcgttgtgtgcaaacacgtctctgaggcctggagtattatgacttacctactggaaaaagagaaactgggttcaagggagagataagatcgaatgttaggatggactattttgatagctatctcaggtcatcatgaagattgcactaaaaccttggggagataaatttgtttaggacatgctaaatatatgttttccttttttctttctatttaaaaaaatctgagttgcagtcacattaacaggtcagtaacatagaggtttggttccctcatatgactttctgcatgtactttacatttttttcttgtttaaatgctaggcatattgtgtaccccacattggtttgtagccagctctatgtcatagggcccttaccctttacctatttattgttagtatcatgtccataaacaagccaatggctcagcatgaactgatgctaaagaaagctcatgcctgagtgataaattaagtgacctcagctatttctcttcagtgttgtgaaagttatttttaacagtaggtttcctggtagattctctaaccactcggtatttcacatggcccaacttggttaactcgactggttacggcaaatgctgataaaggcaagatcacaggtttgctccccatgaaaaccaataacttctcggagattaaaaaaaaaatctcccttctgtgaccacaagcagcatcactcatgcaaatgtcggaagagaggaattgggagtgagtgagagtctagcccagtgcaaatatttctactgttgaaaaaagaagtccaggcgcagtgactcacgcctgtcatcccaacattttgggaggccaaggtgggtggatcgcttgagcgagaccaacctagccaacatggtgaaaccttgtctctacaaaaaacagaaaaattagtggggcatggtggccttcgcctgcggtcccagctacttgggaggtggaggtaggaggattacctgagcctggggaggtcaaggttgcagtgagccatgagcgcaccagtgcaatccagcctgggcgacagagtgagactctgtctcaaaaaaaaaaaaaaaaaaaaaaaggaaagaaagaaaagaaaaaagaatctctcaagcatcaagttgtgttcctataggacacatgggtttctgcatgaaagcaactatgtccagtcccctaaacctggtgattttattggaaatacctccagttaatttttacgctaataacctcagcccactcacaccaaggccaaaagttaccagagttatgaacagagccattgcccaccttttccccctaaacgttgttgttggtgcacatctgcagaaagaggccgtttacgtggaatttcaaatctggttgtttagtctacaaggaggggggaaggattctgtctctttaatgtttataacggttggacagagcttgtcgggtgaaggttaattgctctccagtttaagcagttctgtgcccagatgggttatcagggctgaacactcgttacaagactaatctcatttccgacaagacttccctttccttcaactgatttttgcatggccattggagccgtcatcagccgttaagaggagggtggattactctgggatattaatgctggtatgtggtgaaacaatgcggagtggtgttgtatctcagggaacatctttaggagaacatgtttcgctggtgttacgaagagccaggctcctaaacctaaacgtggagacaatgggacccctgaagcgaggcacttggtgaaaggtgtaggggcgattgcagcccgcctctctctgaggaggaccctgccctgataatacacagcgacacttagggctttgtttgcttttgaagatttttttttttaacgtactacgttcagattttcattcctaaggactacacctaagcagcgaggagttctgtttgctgctgccacacggagccctgtggcagggagcacctgtgatgcagcaacttcatttaattcctgtgaaacgtcaggcttctctttaatttcagagatttcatagatgtcatcatgacatatttgcctgaaaatagtaggcagatttttaaaaatttaataacaagtagcttcctttctttagtttgtctcaaaaaattcttccaagaaatggcagaaaggcaatgtctttttatccctttgggatttggtgtgtggaaattgactcattcatttactcactaaggatttactgggcacccactaggctcatgggtgctgaggggcatgagcagcaggacagctgggctcactcagtgctgtcaatcagggggatgcagatgggggagactgacaaatagatcacagctcaacgaagacagagtgtggcaggaagtcaggagccttaggagggaaggtagggaacatgatagagccaggtggccggggggcgggacctctagtttagagaacatgatcaggcaaggcctgtcagacagagacccaaagaaaaggtgagaacaaggtttgcaaatgcctcggaggagtgatgcggaccaggggaatggcaaaggcaaggaccccaaggcggggacaggcagagggtgtctgagagcagcacatcctcttataatctagtttcacagaggaggctgtcagaagaacagccctaccctaaggaagggtccatctgctttgattgtaatcgggcacagtcctggacaccgagtccctttctgtcaggtgcgaaaagcttggggaatgcatcttggtcatgggttgctactaaaatgagcgtgtcatcttcaggggacaggaattaaaggcacagagaaaaactgaaattatttagcttcccttcccttctcccttcttcccatctcccatcccttgccactgattatggtggggctggctttatatattctctagtttctcatatgttgacttatttttgcagtcgtttcagttctaggccatttggtgcattatgttccgcgtttatgggcatgcgctttggaaccaggcagctggcttagaattctggtgcattaactggcaagatgctctaggcaacttatttaatttttggagtctcagttttcctcatctttaaaatgggcataatggtagctagtgtgcaggttagatgcattaattcacatgtgcatgtcttttagagccgccacgctgtgatcacgttattaaatgttagatgttatcaggaaggtcctatattgtctacgatgcttcactttctttgattcatctgtttcactgagaaaagtgagataaattatcattaatctagagacatttttgtaggctaaaggcttcttatcacaacgttttctccaaaaaataacgaacagacaaaaaaaaaaaaatggagccaagtctttcaccgtatttgtttgtttatacaagggctatatagtcaccaccttccatacaggtaggagtctcatgactttttggtgaccctttcagagcaagggttatttctgccccacaggcatcatttgacttagtgagattttcaacacaccctcaaagcacatgttttttagggcaaagagttgaggagaagagaggcagggtgaaagtctgagcctttggtgcagcacctctgctggcttctgagactctgtgtcacccaggggtgggaggacagttctctccagggcactcatcaggaccctgctgcctgtggtcatgagacaaggagatcatgtgtcacaaaggcactcaacatgcagaggcggtgtcgcctgtcacctggaggggctgcacgcaatgaacttccagtctccatgtgacctcccacttcttggctttcctactgaggaatttgccatttcctgtcgagaagtccagggtatacaggagcagtaaatgccgtggagagggtgggggcgggagaaccacaggaagtcctcagatatgaccatttgggttggtggagtcgggaccaacaatgggttttacctctcacagttaaactccattgatgatgcacagttgacaagaattgcccctccaagatctcattgctgtttctgggaagtaaacgctccttaaaagatttacttgtgagtaaacttctaaccactcttctttagctgtctaaggaaaaaaaagtcagttggctcatgttttccaacttacttcctattatatacacacatacatatacacacacatacacacatatacaacacttacacacacatacgctcacacatacacatgcatacatacgcaaacatgtacacatacacatgcatacgtacgcaaacatgtacacatacacacacacacacatatatatatttatgcctgtttagatccaaaatcacacactttatatagataaaacttaagtgaactttaatatctgtaccatacatttaacttcatttcacaaaatagtaatatgtccaaaccacgtctttcaaaaaaaattttccctctctcaattattttctctgagattacaaaggatatcttctcctaggatttgtaaatgcatcttaatttttgatgctcccagatttgagtcaatttcccctacgtgaagtgaggattaagtttgaatcattattatttcaccactctctggtatctaaaataattatttttttcttatttaaaattgtctttaaaaaacagctttgtatatatatatatatgtatatatataattgaatgcaaggtcatattaagatttaaaaccatgggctcagtttctgaaagagcaatgaaaagctggacaagataaaggaaagaattcactaaagacagaggatcccacggaagcttcgcctgcctaggcagagtgtgggtaatatccagatgaggctgaagtgatgtgagtcaaatttgggaatttatttgacctggctgagctcctgtgcccttttgacgtgtctctaagccttttttttttttttttttttgagcgcatcctccatttcattttgaagtatgtatttgtagacggttttatgctgtgaaaatgaaaacttgctacacctcagaactacgtctcagaaggcagcggactggtcttgcaggtcccggaagttctgccccgcagtgcctgctgcctgcctcatgccgggtctgcaggcggggagccgaggtcagccgaggagccaagctcaagggccgagatgggctgcaaaactcatttcctccaggccctgctggggctccttgaaatggaaaaataaaaaagtcaggcccagcatgcaccaagacagggcagacaaacgacaagactgcaggtctgagctccaagcgcacgaattgcccacgtgcagccattttctgctttgagcgtcatggaaaagagaaacttagtagctgagacacgtttcttccccttctcctgtgatttgggaatgcccttttccaaacgttcattttcttttttctccctcctgactctcagggcttcatgttccttatcgtagagtgtagctgccctgtggaggcctgcgcaatgtgatgagctcagcgggggtaaccaatattgccacctcacgtgggagcctcaccactcttaggacgtgttttcaggggagagttagagttttagaagttacaaataccacactcgcaagcaaactttggggacacaacctctgtctttatctctaaactggtgatcctaaaatatgtcccgtatactatgtggagtggcatggaggagcaaatgagacggtaattgaagggtgtttattaaattataaagtgcccagcgtataatcccgtcattgactttacataatggctagtgtaacacccattgcatagagtgctggcatgcagtattttctatgagtgacttaaggtggcatacaataatagtgcaccgtttcatgccttccttccttccttcctttctttcattctttctttctttctttctacaatgattttacatctggtatgtgccaggagttgttctaggttctgggaaaacagtctctgccctcctgggttttacattctggtgtatcttttgtttcaggtaatactcaaatcaacaaatgcccgcattcaggctcatcatacacgctatacgatcaaatgaagcagcatatggaatagagatcaacaggggagggggaagcttttggagggaggatccagtgatctcataaagatcttgtctgagcctgttagttctgaggtgtgttttggacattgaaaaacctgaaagtaattaaccttcccaatctaaaccgtattttccacaaataggtttgttggatactagtattttcacgtgtaattagaaaaggaattactttccattattaacaaatagatgtgactttgactcatgttcattttttttggccacaaattctcagacttttgatcttaatggtcaagtgcaggtaagaggaaatgaaacaaaattaagcaatgatttgaatacattttctcccttgtagaagactaattatagtttggtcattgagtaattttctcagctgcttaggatctttaattaggtttgatattcactatgaatgtgtggcagggtttcttgggaaagtagagacgggataaaacataaatgatttatgtaactggatatgtcccagagtgaatgagactttggtctcaagaactgttccagtggtttgtcgttctttgatgagctccgtaagtgttgctcttctcaacagaaggttgaattttaggtgaacagcctttcctgattgtgtagatctggaccacagtttgaaggtgcccctccctctccctctgattgccagagaacccctgcattatcacagcaacccaagtcaccccacgtattcccaaacacccatctgctcaggacagaagaggcattgcctctagttgagaaccaagaagtggtcatttccttaaaagctttgtcttgtcttattttaatatttaaatcaaatgacagaactgtttatctatttttatcactaaactccatagtccaattttcgtcttcatacaaattaacatgtttttacaaaatctctaatcttatgcactgctcactggcaacctctgtggtgaactaaaccgtaatgaataataggccagagagccaatgcagcctaggttgcctagaggacagagaaacccagtggcaatttctgcagctttgccaacagccctgagtcacctcgaccctcccctggctcctggtccagtctgatgaaacagtttacaagatgtcttccaggttagcttttcttgttagtatctgctttcaactcaaaatgcacacactcaattaaatcttctacttctgtatgacaatgttaatagactcttggaaaaaataaatgaaacagaatttaatggtgccaaagttgattatacttttagttttccatggtcggaaagctgggtcaattttatttggttcctggtccaggacttcgcctgtgaagcagtttgacaaatgtaattataaaatgtaaatatggaagaaaagagataccagtgcagagtgaactagactttactcatttctgtggcccctctgctatccactgtgtagatggtcaatatgtatttggtaaggtaaatgcaattatgacagaaaaagcagcacatggaatctttacaagtaaataatttttactagcttaacagaagtattttgaaaagagaaaaatcttacgacttagcttggcagattagacaaagctaggatcagcatataagatccctgatattcctttctttctgccgtttattcatcaccttcccccaaatgagttaggtcatctttttgaactttaattcaattaactccagataattataacaataataataataataataataatagaaaacactcatagagtgcttattatatgctagacattgtattaagtgttttgcttaatacaattgggacagagaagacaggttcctgcaatcattatagccatttcacagatgaggaaactgaaggacacagaggttaagtaactagatgtgtatccattcagcagctgtgcagtgggttccggagatacagaaatgaatcagatacatccctgccctccaggagcttacagtttaatggcctgaggtagatgcataaaccataggagtacatagctgcatatacaaactgcagacatctgtttgcaatatagattatacaattaagaagacaaattgctggggaaatcgttgtaataaatatggcaagtgttaatacccataatttatgcagatcatgttacaactgaatgagatcacatgtgtaaacatattctgtgagctgtaaacaggagggaatgtaaaaggttataatgactactccaacacagctttattaacatagacaataaacctgtgaatttgttacttttccaagtaacagcaagacttgtttaagagctgcctagaagttctgggttttttgtttttttacttctccatgtatttgatagtaaaaaatgaaagataatttattatatcataaaatgtgtttgttacaaattaatattgcctgaaaggaaagaaggagaatagcccaaagcagttaatacaatgattccgcaggaatcaaggtgcagctaattatatttatatgtactcatcgatttttctaagaaagtaggatattccaaagcactagagcccagcccatgtgatggtgttcgtgagcatttgtggcagagtttctgtgaagtttgcatccaaacagatgggaatttttcaggtaatggcatacaagtaacaggtaggtagactactcatgtcttgtaagaggcgtttaaattttatcacggggagagatagactagtcagtcactcagtgtttgctaagtgcgttaatgagtcacagatggatagacatggcattaaaaacaagcatgcccagagttctgaggatgaggctggactttagcataagttgcttggattctctgactgaaaccattcttcttagaagcccttctataatgtaaatagataaggggacccccagtggcatgtcaaggccatcaggggtctcgggggctatggtttttttttggacaaagggctagagttctggtcttgaagccacattttcttttttttttttctttttttttttttttttttgagacagagtctggctgtctcccaggctggagtgcagtggcgcgatcttggttcactgcaagctccgcctcccgggttcacgctattctcctacctcagcctccctagtagctgggactacaggcgcccaccaccacgcccggctaattttttgtatttttagtggagacagggtttcaccgtgttagccaagatagtctcgatctcctgacctcgtgatccgcctgcctcggcctcccaaagtgctgggattacaggcgtgagccaccgcacccggcagaagccacattttcatagtgagcatggtcttttcaccgacatggcaggtttgttggggtggcttgatgaggtatatggtgaaggctcccctggcattccagttgccagaggggactttagaatgttcaattctttcctctgctgtcacatgggttttagcatcatcaactgtggtgaatggagcatccagatcttccaattcatcccatgattcttgtcaaggaaaaaaatctttaggatttgaggccagcactatgggaaatttgaaaagctttgctcctttcaagtttaatttttgctttcagaaaacaaataagtttacagtatgcattccatgtgaactccaatttccctctctatattcagagaaatacatatctattttctattgcacagagctacggaatagtttaccaggcctggtagcagcccaacaggagagagaaaggagtgagacaggctgtggcagctgggagataagtgcaattgatgagctgacctgccgggtggggaggaaggtgccgacctataggaaccacagtctcattccacctaagggctttctctggctctccaccacagccctttcacttgaagcactaacacgtcaccttgtggactaagaggagttttcaccttttctccttttctgcacccagcttcaatcattggttgatgaccagtgaaatgttttaagaaggcaggaagctggagggagaaagacaaaggcttacatatctcccagaatgggtaacaggctacagcatgcatggccatgagttggatgtgcacatgacctgtgtacataaatgacaccctcatgcacacatgccgtaagtgtgcatatacattttgttaggtcaatttctacatcatattccagaaagtcacataatcagttttcttttttggtattcacaattcacttggaattcaccaatttattatgtgacttgaatatgtatggcctttctgctgagtggatcctgaaatacaaatacttactgttactggaagccccaaagtcaagatgcaaattaatagatttctatatggcctcagatctgagtcctctgaaactggcgatttaacaagagcacatgtacagttacagaacctccgcgggtgtgtctttcagggttcctgtttcttatttccatgtctctgtacccaacacacttcctcctgacccttctttctctcctcctcctccacacccgcagaagcacctagccccaccacacataacttgctagtataatgcatttgttcttggaaaatgtgtgtttttgcacactttggtttccacctgcttttttgggaagatgtactatatgatgcataaaagatccggagctagctaggaggagggaggtttgtttgaggcaacagtgcaagaatatcaggtcattctttcaattgcacacttcagagtatggatacttcccttgaaacatttgcagcacaagacttttgcattgacaagcctcttgcttttgaatttgagctgtcaaatgttgtttctgctttcatttgttggatgtttctgcttgaactacaaggtaggacctcatatagataaaaaaccaagtctttaacccatgacttgagggccgagattggattctgattctcagcacatccaaacatgtcttgaatttgtagccactccttgccaaattaactacctctgtgactttaagagtagctaataagagtaacaagctctagtccctctttgcaggatgtaagggtttctaggggccagaacatgttgggcttcttacgccaggtgaaagatgttggatttcattttggggaaaagtgtaacatggtaggattatcattccagtagagaaaccctgtttttcagtttgtatatgacctcacatgacttcacagtttggggctcccaccctgttgtaagttgtccacatttggaagaaactgtagttccaaccaactgaatcaattatctgtaaagttggttcatgcaaatcagtgcatacatgagactgtgcctgtttggtttgtcataactattttatcatatgaagaactgaccatccataagaataatttcccagacctgtcattctttaaattccttttatttttgcttccaacatagaccccccctcactttgggagtatatcttccaggatcatgagcccacgagaggccatcttagtacactgtgtaggaattaaaccactcctgcaaatgtgaaacaaactgtacttttcaattaattaaaatcatattccagtgtgcctacctaaataagagtgatattgttttgagcaagatgagatgatttatatatatataaatcatatatacatcatatatatcatacatatctatatcacacacacacacacacacacacacacacacaccccagaccatcagacagcctaaactgttttaatgtatggaccattattgtagtgatggattttcttcttggttctagtttcattcatacaagaatgctgatacatggacaacaacaagacaagaatataactatttgcagcctattatgtattatttcaatataacattaaagtctctagtactggggacaaatttaaacgtagctttaaaattatataaataataatgagcatttatcactagtccccagaaatacaaagtctagcactcatctctccaacaccgtgctaactgcagacagtttcacacccagcatcagaatcccacaggagtccttagctcctccccattccagcccaggcacctcctctgaaaggcacaaggcggtcagggagggccatctcatctccttatttcaatctctagttttgatggggatgggatcaaggaggatgagatattcacagtgacatattcagtatcggagaaccaaagtaaagtggttagggccgtcattgcacgtgtggcaaaacttataaattaattggaatacttcattttttaaaaaatagactttatttctcagagcaattttagtacgcagcaaacccgagaggaagatagagtgatttccatacacctgctgcccctacacttgcgtagccttgcccacattatcaacattccccatcggagtgcatttgctacagttgatgaacctatattgacaggtcattatcacccagtgcctgtagtttacattagcgttcatttgtggtgctggacattctgtgggtttggacaaatgtatatttacatgtatccaacattataggattatacggaatagtttcactgccctaaaaaccctcagtgctccacctgttcacccctccctccctctaatctttggcaaacactgatctttcagtatctctgtagtcttgccttttccagaatgtcatataattggaatcatataatatgtagtcttttcagatcggcttttctcttgggatgcttaatttttcaaaaagtctctgtgcccatctcttttcatggggaacttgattggcacatttaaagtacaattcaactaacaaaaacctacttacatagaacacttcagaaacacaattacagacagcagggtacacttgtaacatcccacaggcaaaaacaggacaaattatttggagtctagcctcttacagaggaagaatccatgttgcactggggcttgcattccttggaggtggagaagatcattcctaggactagggagcaaattgagattttaaaacatgaacccagaaccaactcaaatgctcatcaacaatagactggataaagaaaatgtggcacatatacaccatggaataccatgcagccataaaaaaggatgagttcatgtcctttgcagggacatggatgatgctggaaaccatcattctcagcaaactaacacaggaacagaaaaccaaacaccacatgttctcactaataagtgggagatgatcaagagaatacatggacacaaggaggggaacatcacacaccagggcctctcggggggtaggagggtaggtgagggatagcattaggagaaatacctaatgtagatgatgggttgatgggtgcagcaaactaccatggcacgtatataactatgtaacaaacctgcatgttctgcacatgtaccccagaacttaaagtatatgaaaaatagcattatctaaaaatgaacatatcctgtagaataaaggcaacttcaaagaattcgtcgatatgataggttagcagttggaatttagacaataaaataaatgcagttaattatgaattgtattaatgaaatgaaattgctttccacagtgtgtctgatgttttaggacttcttgtccacaaatagtttgaagcactgctgttactctctgggtactaggcagaaaagcctttgggactacggatggatgtgtgaggcttttatttctgggctttggaagtaagaaatatgacctattccccaggaaaaacacggaaaccagaaggcatggtaattcagggttcaaccacaagaaaacaaaaagttcagttacacataattacacttttctaagatagaatccaatagtaacatattaacaaatagttgtttaatatttaatttggtttgccaagggaattcttaataagttctgaattatttcataaaaaaaaaacatgaacccatccccagtgctcatcctagtgttcggagtttttaccatttctgaatcacaccttggaatcaatggagaaaatcctgctttgatgcacccttgctgcttagacgacaggacttcttaacccatgaccccagtagcatcatagataaaaagggtgtgtgaaaaaggagtgaggggatacgggaagtgggaatacaaagcctggattacgtgcagactgaaagtcaaactctggacggggcatcccaggcctgtggaaaccagaaccaggctatggatccaatgggaatttcctcagtttcagcttccccccaaccagcacacataccctgggccctccccagctcacgaggggtggccccacttctatgcttttccttgcagtttctccatctggaaatgctccccaccattttgatttacccagtacaccccattcttcaaggctcaggccagtgcacaccagttcctttaatccctccttccttcttctgtcatccagtcgacacacttagcatgacatttggcacctgcataccaggagctcatgcaacaaatacgcactgcatgtgcatgatatgtggacacttacaggctctgaaaaagagaaaaaatagaaaaaagtctctgccctcatggagccagtattcccccagccctgacgaatctcctgctcctttctcccagtgtatttcttcccctctgttaaagtagttcctagagtcaaccacatgcagaatgagccttcaccaccatcaggctcctgctctgcacatgatggatgcccagccacttgatcttagtattaaatgcctttgagactctgttttataataaaatgagacacccaagcacagaccccagcaagcaggtaaacagggaggacctttcagtgtccaagtatgggatacacatttaaaaattaaaataatctggttatatttaaaacaagtggcccttaacattaattggggagtgccacttgccaatccagagatgcaccaggtgtaccaagatggacacactgggagataggcagggagtctgtgcccgggctctgcagtccctcagccccagggaccagtgtctcaagctgcctctgatccagaaaagcacagttagcttggcaacaggttggtggtatgcagttgctgctcatttcctggtccgctttacaggcctgccccttgattttgccataagacaggccacttgcaagaaggttcatctagaagcagatgtgtgctgtgtagctgatgggtgggggtcatgatgggcagcctgcttctttagtagactgtgtgcagtgttagagagccctggggcagcactcgtcagttaggatgcacaaaaatgccaacccccgactctcagttttttaagttgcataaattccaaatttaacatatcaccatgtgcagtcttggaaggctcaatattggctttaaaaaattattttcctaaggactctctgttgtcaacttgaggaaatggctaacaagcttccttttctatgacacttagctactgaaaatatgttcttcataaagtgtcttattactgtcatactgtgggttacttcagtaagtacagactgtgtcctagccaagcttaaaacctcgacggcagtgattcttaatcttttggtctcaggacccctttacgttcttaagattggttgaggattcttaaaaaaaaattgtgtatatgcattatatctattggtagaaacaaaaacagaaattttgaaacatttacttataaattcatttaaaaataacaataacaaggccaggtgcagtggctcatgactgtaatcccagcactttgggaggccaaagcaggcagatcacctgaggtcaggagttcaagaccagcctagccaatatcatgaaaccctgtttctactaaaaatacaaaaaaattagccaggcgtggtggcgggtacctgtagtcccagctactcaggaggctgaggcaggagaaggcatgaacccaggaggcagagtttgcagtgagccaagatcgcgccactgcattccagcctgggcaacagggcgagactccgtctcaaaaaagaaaaagaaaaagaaaaaaaaattagccaggcatggtgggacacgcctgtaatcccagctattcaggaggctgaggcaggagaatcacttgaacccaggaggcggaggttgcagtgagccgagatcacaccattgcattccagcctgggtgacaagagtgaaacttcatctcaaaaaataaaaataaataaataaactcattgcatgttaacacaaatgagatatttttatgaaaagtaactctattttccaagaaaatgttaatgagaagtggcattgttttgcattttttgcaatctctttaatgtctgggctaattggaggcagctggattctcagatctgcttatgcctgcccttagaggggtctggggaccccagggggttcctggacaacactttgagaatgactgacctacagagctccggagaatcactgacctacagagcatagtgtggtacctggcactgtgctaggcagggagatacagcagtgaagaagagggacacattctctgccttcctggaggatggtatgggttgaatagtgttccctgagttatgttgaagtcctaacccccaggacctcagagtgggaccttatttggaggtagggcctttacagaggtaatccaattaaaatgaggcccttagggtggtccttaattcagtgggactgatgtccttataaaaagaggtaatttggactcagaaacaggcatgcatagagggaggatgatatgaagagacagggagaagatgaccatccacaagctaaggagggagtcctcaggaggaatcaaccccgctgctactttgctctctgacttccagcttccagagccatgagagaataaatgtctgttgcttaagcccctcagtccgtggtacattgtcttggcaaccctagcaaatgaatacacagactatgtatcgaatattgaaattgggttttaaggcagtaataaggcccatgctgcttccttgaggaaaattcagccgcaaaagaggattcactgcttattaatatggagacacgttctaccagatagagctctgggaatccaggttctccataggcaagcacagcagtgaacagtttttccaaacgtctccttcctaagcagaaaggaagtgacaccattgtctgccatttgccattcagagctcgttaaaacctacagcctcacacccatcaccggtccacaggtaaacagagatttcagggcaggggaatactttggtgccgttattcctttcagttgccacaagtcagtttccctaaaggctgccctattagtggatgggtgggtgggagcctcagtgaggtatttcctgtgtgagtcaaagcctttcaaaatggccgtgaccccttgcagactctgaatgaaaagtacagattctcagttcccagagtttctgcatgtgatgatgaatggaagttcccgttgcatgtgggacaaaggatggctgtaacattttattaggtgtggcttttggtgtacacatggcatatgcaatatatgcattctcatcacatttagttttgaaaataataaaactttaaagatagaaagaattttctttgcagaacccttatgagatggaaaatattagtgcaacacagaagaagacaattcccgggcttttagccaagacggctagagagactccacttctctctgagtcaacacccaggttcctgccatggcctgcaaggctctaccacccccagcctttcctggttcacctcctggttctttctttcgctcctttccagtaacccctcctccctggctgttcttggtcccattgttcctcgtgcagcccccgcagtccactctggccttgttctagctgttgccaaggctggaaggcctattcttcatgaatgcatgggggctcacaccctcccctccttcgcgttttctcaggaccaccctggccactctaaatgaaaagcagcagtttacctctcttttcctgagtctctagttctgccttctgtttcttcatacttatcacttaccaccttctaaccctgagatcaggcttgaaaaacaaggttataaatttaccctatcaattattggttgattaattgattttcaaaaattatctgtggcttgtagtgctagaatacaagccttatgcagataggtgtctttgtggttttgggtcatggatgtaatctagaagcagctagacaagtttctaagtagaaaaggtgttcagtacatatttgttgaacttatgactaagagaatattcttattcctggaagatatgtgtgatttctagtggagactagaaatggcctttctctgaggcaaacttctaaatcctctgaataaaggtatctctagcccatctgactcagtcccacacccctgggctgtggaataaccagtttagggggtgattaaaatggctacataggtacagaaatgttaacttcaggttgtcagtgtagcagaagcaaagatgtttgtcgtgttgtctgtgaagacgtgctataaaatcgtcccccaaagtaaattgtaatggcaaccatgccctcagattgttctggaggatatagacagggaatcagacactactttcaaaactgttacataataaatcttacattggaaaactgtcttagacctgtttagaaatcttgcattctctgtcttagaactttccctcttgagctgataattatcatccagtaatgacacttatgtggccttgggaaacaagttattaagcatgcacctgccatccctccaaggcagtttcacccttcaaattaaatgcgctgcgcttcctggcagcgctgaggccattggagtggctcctgagtgatggcttggaagaaatgatagcctagtagagaagtggcccaggagagtgcacagaggaaagctgacatttagagaatgaggagagaaaaaggagggcataaagagatgggggatggaattgtcaaccaaataggaggaatagcaggaatatggaagccaaagaaaagagggttaaaaaaggggagagtggccaacagtatgaactgctcttgagtaggtaacaaagagaccagctgggagtgaatgtttgagggaaccccaaaaagctcactcctaatcgtggcaggacagtgtcagaaccagacggcaaggttggagaagagaagagagcaggagatgagaatctgttaaagagctgtgaaatatttaagtaagtaagtatggccaatttttggttccttgcatcaccagctaccacccccaccttcggacacccagaccaacacacgactcttgcttgaaagcaaagtatgaaggttagagacactgacgtgagtgaaactagactgaacgtttgcgagatcctggataaataaatattggatatttttgttggataaatattgcttggataaatattgcgaaagtgcattgtgattgcagaaatactgaattggcatcagattcattaataaaaattctgcctgacatctcacgtgtcaaggcccatgggagcctgactggccactacttggtgcattcttttttttttttttttttttgagccagagtctcactctgtcacccaggctggagtgcagtggcgcaacctcagctcactgcaacctccacctcccaggttcaagctattctccagcctcggcctaccgagtagctgggattacaggcacacgccaccacacctggctaatatttgtatttttagtagagacagagtttcaccatgttggccaggctggtctcgaactcctgacctcgtgatctgcccgtcttggcctccaaaagtgctgggattacaggcacgagccaccatgcctggccagtgtgctcttttacagggcccagggagctcagtgctccagtcggctggttttccagttcaggagcttaaggcttcagattcagcagtggcagaagtggtttcccaacttccagctgccctgttctttgcacttttttttatttttaagtcaatctaaaatgagtctgtgttcacaaataaatagcgacaagtgcaagtctgctagagtggaagagagcaagtgcaaattctctttccctttagctaagttgctctttgaagtaggcgtagccccatgacgctcccataaggcttactgtgcaggttggatgagtaggcaacttggaaggccccacctgctctgcaaggaggtagtcctgcacagcgcctggtggtcagatgtccactactcacctacccgcccaccccacaggtggctctgtgctgctcagaacctgcacagtggtgcatagcatttcccagctcttgaagcttccttttcttcctgggaaagatagatgtgaacatccatgacctcacttcctccacaaggatgaatcttaataagtaaagaggtccagtaaggaggcaatctaaagaccgaggtttagactctgtgtacacgtcaagatttcaagtcaccaggctgttgggcaggccttgatggtttggatatgaatgactctgcacactttcaaagagtatttgtgacttttttttttttttttgagacagagtcttgctctttcgcccaggccagagtgcagtggcatgatctcggctcactgcaacctctgtcccccaggttcaagcgattctcctgcctcagcctcctgagtagctgggactacaggcatgtgccaccacgcccagctaattttttgtatttttagtagagatggggtttcaccatgttagccaggatgttttccatctcctgacctcgtggtctgcctgcctccacctcccaaagtgctgggattacaggtgtgagccaccccgcccaggcttgtgactttcaaagtagacatatttatagaggggctcaagccagatggcaaaagagccctattggatgtgatgtaagtatgtgtagtttgaaattgttggagggattgctctcctagttcaaatgtattaggttttgaggtcagcactcccagagtcataaaaatcaagtctcactggcaaccaacttgttagtgcatgaaaagtgttaccaggacggggtctacccagtgctcatctatgtcataggaaaagcatgagctcagcgtataacattagcaaagggctctgatgacctggctacttagtcccctttccatgcagcaaccaggatatatttatgtgctggaaaaatcttctgaaaagcacaggcttagcatcccagccccagggagtcagacatcatcacttaccaagctgaagaaagaccttggcagggattggaccctcacagtgggtgaagactaactctttctacgtaagtcagcgtctaagaaaaagaaaacgtctgtgttcatgtctgcgttatacagtgtgtggcccatgccaacaatgatggggatggggatagaaagcaaaagaaggagacccctggaccatcatgtgaatagtggagacttattcatgtgctcctctgtctgccagaaccccagtttctacaagactttctgttggtattaccatgttgccatgtgttttttattttttaaatttttttatttattattattattgaagtgctttatgtgtagaacagatgccatattcccatgcaagagagtagatcctttccacacttaaaaacataacactagctctcagggtgctgactagcttcttaccattagcacagaaggagatacctacaagattgaggaaaattaaagtctgggggcagcagggaaagaccctgcagttagcatctaacctggatgcataggaactttttagcaactccatacatggtagatttctaccttatctgcatgtctgctcagagatggaggaggtagagactgcagcctggctatggctgaaagaggatgttactagttaaacaaatcgatctcattttggtgcaaaatggagtcttagaaaacatcagtagaccagaccctcattttagacgaggagcttgaagacttggtacatgaggggcacggagtggtggagccccatggccagtggccctgtggtcttgcggcttcttcttaaagtgcccatcctgcatcctggcacgtgcatgttgaacctggtgtgacacacctgtctgtggggaggggggggaccgtaccaattatttaaaaaattaaggctgttttgacacccccaccccctcacccccgtcttatgggaaattttgaattgagtgtttgaaggcatgagagtgacacctgatgaaaattagctaaaagcagagacagagttgtgggtggaggccaggacatctgctgcccctatcttttgcttgccagggttttccattgtgccagaattttctcatgaataaaattcctggaattttatcgaaaacaatgaatccatgtgtcagagattcacagatgagacacattccagatgcgtagcacactgtatttttagcctttgtgtgttttgaaagggccaagcataaaactgccgatttttcacggagctccttctgaagaggagagaggtggtgcaccaccccttccctggtgttcagagaaggaccatgccaatagaaaaaaagtgcaagcaactttgctactccttgagcttggcctttgtgtttctcaagccttgaatcacctgagtttcaacctgggcttgtaagtttcaaaaatcaccaggacagaatgatggtgtgaacctcttagccagactgccatggaaacacttcctcatagaagtttatgaaaaattcaacaatttttagggaaagttaacatagaaagcattatggattccacatcctggaagaaaagacttttcttcagaagtttgagggctatcaactttgtgccttgtgctattctaggtaaaaaaaaaaaaaaagaaagaaagaaagaaagaaagaaaaagaacattatgttataagaccatggtatatctattaatttattatcttgttatgtagagaataccaacagcacgctggggagtgtaccaggattcattccttcctgcacaaagctttgatttaattgacattaaacaaactaatgtagaatttgaatggaaaacccacaaaagaactggaccagggaccaaaaaggctataaatcaaagtgacagacgtgctcttgaagtaaaagatgctagatctcccttcccctctgttaggtagatacttggtttgaaaatccagtacttacaaaaaataagtgataatttgcacacaagagactgtgattttccttgcatctggcttgttagaataatatgactagaatggataattctgatggttcacatgcagaggtttggagtcagtcacatcacccttctatcatatgataatttaaatacaatattaagatttatgaaacctgttacacacactagattatttggcccatttaactgtcctgggagagagctgctcggcagctggttgccatcagtaccacctttatagttgaagaaattgagagtcaaaaaaggataatgcagcacttgttgaagtgagcaggcacccagctcacctggggaagttgttacaaagcagattctgactcagcagggctggagactcggaatctgcatttctggcaagctctcagctcacacttggggcaggaaagggttaaaggatttacccaggtgattcccagagcaagggcagagcccagcttgaaactcacatcttccatcttcagatccctatccctggctcccgtgctctaccagacggtctcctatccattggtacagcttcatgttcatcctccactgagtgattaaaaaaagcaaagaaaaacttctttttatctcaaatgaattatttaaaactagataaaaaataaggaaaagggttttgatgaatattcgtgagtaacgtataacagtgattagagaaacaaaaacaagtattgagtgtcaagagtagaaacagccctcttagaaggatgtaaaggaatagtgagtgtattttttgcacccattccaatgtaaaacatacaaacaggaggtttccacagatgtttttatactttttgctcatctccaaagaaggaaagaagcctactgggaagaaaaagtgattcttcttcttcttttttttttttttttgatggagtttttctcttgttgcccaggctagagtgccgtggcgcgatctcagctcactgcagcctccccctcccgggttcaagcgattctcttgtctcagcctcctgagtagctgagattgcaggtgcacaccaccacacccagctaactttttgtatttttagtagagacagggtttcatcatgttggccagcctgctctccaactcctgacctcaggtgatccacctgcctcggcctgccaaaatgctgggattactggagtgagccactgcacccagccaaaaaagcgattctttaaagaagaaaataagaagctattcacatcacaggcatgttgtttcttaaacagttaaatggcatttgccagggcaaagagtcccagttcattgtcctttcaaatgcattcgaggtttattctgcatggcactgagaaaacagagttgttttaaaatgatgttggttgacattcttgatctcccaaggctcatttaaatctaattttcattatgtggacataactattctttctttaacatttttctaccatgctccaatctttcacaatatttctagagtttctgctttccagattgaatgctccctccttcttttgcaaacgttcattttccagtaagtcttattttgttcataggttgcttagctataggaagtccctatttaagcctatgtggattgaaggtgaaactctgcaataatacgctctttggtagtatgactgcagacatattgccaatggcaattattttccaaactccctggaactcctgggcgttggctacacaatccattcatctcacaaaaacacgtctcttcatttggatgtaatagaagtttgtggatcccatttatagcattatgatggggctgtaatatcacctgatgtcttagtcctagggctaatatgaacaccaacaagcatttgaggttaagaaattatcttatttctagaggcagacatacagaggagccagccctgaaaatgcttatatttgaataaaggcaaggccaggggagaagtatgtgggcaaagagaattgctggcaccagccaggccttctcagagccctgagaaagtctgtgagtccagagccgggaaaattggctgaaggacatggaggggatggatccccagctaagtctgttctgaagggatgtgctgagcatagggaaaagcaccttctaggatgagagaggaaggagcagaggtgaaatgggaagaagccaggttctctgtatcttttaggcaacatttgccctagtggatatgattaaagataaagaatatctgaaagtcctctaaagcgttctattaataaagataataaggataaagattttcatctctccttattatcttagtatgtatttagtaatatgtatacatatgtatgatatttttgtatatacattatgtattgtatatctgcatgtatttctgtaggtatctatttgcatatatgcatacacttatatatgtatttgtgtatatgcatgtgcgtatctgtatatatgtgtgtgtatgtatatatgtatttgcgcatgtatgtatttgcatgcatgcacacatgtatatgtgtacatatgtaagcatgtgtatgtgtttgtatatctgtatgtgcaaatgtatctggacactagttctgggtctcatttcttagcactggactagtgttgtgagtggtgaaattatttgacactgaagtgataccatattggagaaatactctctttagatggacttcatttgcctacatacatttttcctttgaggttaatccaagattttttttatagttttgaaggactaaaattgcaatgtgttaaattagaaaaacgtgaacacaaagctagatgctgcatttaatatacgatgttaatacttccttctctgaagaattaagaagaaaagaaaatcatatcaagaaggggcaaaaatgatcatacccagctttgtgaagcttctttcacttaccacgtttcgcttttttgtgtgttgtaaataaaagacacactggtcagatgaagattcttgtttaatgagatactggtggcatcagaattgcaaaagtgcacacatttagaataaaaactcctgaaggactggagtatctttgtcaggcttatggtgggagagcagagctttctctaagtgcattgtctattttgtttgtgttgttttttcctcctccaaatacaattagatactagaccttttagaagcatctactgcatatgtgctgccttgaagagaaactataaacaatagagcctgcgacagcctaatagatagatttccaatatccttaggtctgcagacatccactaaaggccgcccaaagtggcataggctccagcatatttataaatggtactcctacctgtcctagttttcctgcatagtactcattaagagaaggcaggcatccacctgcaatgaacacatcccaacacctggccatgtctttgtgtctgaataatctgattaatcaaagaaaagaacaaggttgttgatttaagccattgcaaaagaaatgattaactgtatgcagggcccattgctacacatcccctaggctcatagaagagcatggtatacctagagaagtccttactggttcccagcactctccgtttaccatccagatcctttattccatcccagatccagggattctggacacttatcccttcatctttcttctgtctcttccctctaccagcctctctctctctgtctctctctaggtgattccatctctcatggcaagagcaggcaccaaaacactccaccgtgtgacttttcttaatccaacttcttccttccagtaacagccaggtagtggccagtctacagccttggggaatgattccattcacagacacaaaccctgtttctgcctcatcctcactgttgatgttacttctctaatcgcactttctgatgggtgggcaagaatcacagctgaccttataggacaattgtaaggattaaatgatcatttttcataaaatgtaagatgtcattggatataaaatgtcccattattttatctgccatcagagaagaagaaatgctgcctgatacctaggataagcctttcattttcatatttcagagctgataaaatgtgacaagtggtgtatcttgtaatcaacaaaatagaatttaagaggatattgcatgaaagtgcttaaggtaacctggtttatttggtggataagctatttatgaaagtggttaaaagatggcaatatagggagttaagtgatgtaccaaattctgcgtggttatatgtgagggaaatttaaggaagggttttgtattggattgtaatgggattaaaactgacagaaaaagtaggctattgattgaagatgatgctggcttcctaagtgaatgatctccacactgtgttgtgatagcagcaaggacttctttaagatttttttattttttatttcttattttattttatttttttgagatggagtctcactctgtcacctcggctggagtgcagtcgcgtgatcccggctcactgcaacctccgcttcccgggttcaagcaattctcctgcctcaccctcttgagtagctgggactacaggcgcccaccatcacgcctggctatttttttttctttgttttttttttggatttttgtatggtctcgatctcctgaactcatgacccacccaccttggcctctcaaagtgcttggattacaggggtgagccaccatgcccgaaccaagatttttttttttttaagcatgatcatgatcatacaattcttgttccacttagttgttccatttgtttttcataattatcaaataattatagcatataagacttgaaaacattgaaggtgggtttgataatccaattctcgagaggcctagttctggccatcttcctaatttttgaaaaccacgaaaggaccatggatgcctttgcttactccagatgtgaaattcacctgaccattcttaaagattttctcagtttcaacactttaccactcccaaattttcaaaagaggttaagtatgatggattctctgtattaacaatgtaatatttttatgagctataaggatcacaaattagaatcaattttgggcctttattttctaatactttggttgagaaataggcatcttgcaaagtattcatctgttatagaaaggcatcaggattcctgaaatactttgctgaaaatgtcagtatgcattcaactttgttagttttctttttcagtgttctaatgtattttggatccttttttgtactctagttacttgaaaatagatgcatattttagagttataatatgaaatataacctggtgggacctcccttcatttctggaactgttatcccatgaccaaaatccaaaggaatggtcctcatgtgttattggtatattccgtattgaaatgaaataatcaatactacagtactaacacagtagtaccttttgtttgggggtaatttgcttagaattatgtgtttctcgtaagttatttaaaaatgagcttggtagcctgccatttgcctgatgggaatatcccaactttcctggagctacagaaaaaaacaccccacacattggcaaacaccaatctaaagttcaggtctttttatagtaacatagaagcaggcatatgaaatgattatgccacatatctgccagattttgacgtttaaaatattctctgttataaagccactgaagcagatcccaagccttgtggctggccagagtttctgcaataacaatctatacatgctaactaaggcagctgcctaccttggccggcaggtaggcaggcaggtaagtaggtaggtgagatctgctagttataaagaggaggagccaggctgcagggaaggagagacatgtcagtcaaggccaggaagtctctcccagagctggagttaaagaactcatgtggtcctgattagcagcctgtgttcagcactctttttctggttttaatcctactgggctagatcctctctcccctttgaagtcacagggctgccaggcagggagggccctatgcagcagcgtgtgtccattcaagctttaaccgaagggatgatgaaacctgccaacagccaagtcaagtgggaggacaaagatgtggcagggctgtgccttggtttgcttctgaagagcagcacttaactttagtgaccgctgttgtgggaatgggtctgtgaaaacccctcagcttcttcttactcccaaaatgtgtatgtgagagagattttctttattcatttgtttccttttcctgagctgtacttcatcctaggtgttcagcagcctttgttgagtgacaatcaacaaagtctttggggcatagtttgggttgctctgtcttttcaaaatgtggactgtatttcacctcttttgaagtgtttatcctgaagcttccttattttcagaatttttcccttctaatgaacaaaagcaactgaggggttgctttcaatattctgaattatattcccttcctcatttttgtgcaatattagctgtgagaagaattttaagatgcaaaaaaaggaggcatgcctcccccatctctagcatttctgagggttttttccttcctaaatcgatctcaattaactttgatttctttctttagaaaaccatgtgctgaaataatgctttgccagatgtgagaatggattccttcccctacaaacacacacttaagcttcattttagttctaatattttggtcttttttttattattcaaacttacactacatttttgtggctattggctttgtttgcagaagtaagcttactttatcttggagaaatactaatactttaaagttattgcttgtttgttattgttgcagccatttcctttttagtttgtaattttaaatttagcctgtttcttatatatataacctgttttcgccaatttctgatataaatcacacatttgttcatgtttctcatcatgggtgagccaaagctaacattacatagtgtgttattcccctgcgagccttggtcgagtctcaggcccaggaaggagagaggcagcagccatcagctctgtttcctgttctgagcctgtaaaacacactagccagtgccaccatgggaagggagtatctgttttgcaaaaattttttaataaggtctaatttttgtcttaattagcatgactaagtctatggtgctgattttactttgaaacccacatctatgtgtttagattccttgttttggccactcaattgtgactggaagagaaagccatgaatttcaggttccctaacatctaggatgccgtttctgtactgtcaacttctgtgtcactgcctcgtatcatttttggttgttgatgagtttgattttgctgtctattcaagatgacttttttcccttgtgcctgattctggttctctgtctggcctacctgactctttggtacattttgcattactgtttggacagcaggcttagtctttcccagggtgtcacagggctgtaattctacagatacttatggagtccaggatgggggcttttgctttagcacagacacctgaccaccactttgagagacagaggtttgagtttgttttgattcttcctccttgctgattctcagtgccgtgtgtctggcaaagaagtttgtgcacttgggaagctaaggaaaaaacttggtcctgggacaggtggaggatcgagcgacagagtagatgtggagttgggggtgattgtttcctaaaaattctgatccttctgggtggagaggaagctctccatctcagaagggctgcttctagggtgtgattactgatgggaagcacccttatttatgtaaaggtcatctcagagaaggggaagagggtgctaatttaaacacatgtcccaaaggaaaaaaatgtcacaaagggcatcatagggctgtgggggcaaggagaaggcagatggtaatacacaagtcattcccatcactaatcccctggttgatcatggccagctcattcaagattagctctagacctttctgggtctcagatttctcatttggagatgacaagtttggactggaagggtctgcgcagcccacactcccctgcctcccctgctctgcctccaaagttcttttctttttctttttttttaaataaaaatgtgtggcccaactagcctttgcttctcactagttgatgtcaatactgaggatgccaaaggactaatataaaaatgagcattcatgtggaattctttttgtctgttataagaaccaaaattggattgtatcacaacagctctgtgtcattgcagcacaagccatcatttaagtcgttgaaatttcccaaacttgccgttgctcattggctgtagaatataaacatagccattggctaaccacttgtttgacttaaaaccacgaaaaatgattgatccaacaatgacaaattgctatttcttctcaccaaatcatgcaaaagagcgaagatattaattgaaagtaaggggaaaaaagagcttgtcagtgatccagatattttaaacatcctgctgtttggaagcatctggatacttcacagctttttttttttttttttttttttttttggttcatttatcatccagatgctcaccatcatggaagcaccacttgaaactgtacttcggctaataacttagagtggaaacgtttgtatctttggttggttgccctttggtgctccattgatccctctgtcttcctctaagtccctcttccgcaaaatccccaggaatgtggcaattttgccagatgcttaggtgttggccttcagatttcttttttttaatcctcatgaccgctctgtaccctgtctgcttgaattatagattgcatttgtcaaatagtgacacatgcaattggatgtcttctaagacctttgaaattcaacttccttaagttgagattaaagtggatattctgctgccctgccacagtcaagcctgggatgcttcgagacctgcataaaagtttttctaggctggcatttctaactcttactgtcccgaggaaagaaaaacaagctacttttttcttctgaaaggtagaaatggagaccataaaaacgatctaaaatgtggtcccagttagaaaggactctgaaatcaacaactttttgaaacatgactgtctgttggagtgtcttgaattatgtgtttctttgggcattcaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggtaaggagacttccgcccctttctctccctgacctcccattttcctatcctttgcaaaggcaaagtggaagtcagtcatgcttctctaaagattgacttagaaagcaaggccactgtgcctgtaatcccagctactcgggagcctgaggcaggagaatcacttgaatccaggaggcagaggttgcagtgagccgggatcatgccactgcactccagcctgggcgacagagcaagactctggctaacaaaaaaaaaaaaaaaaaaagaagaagaaagaaagaaagaaaggccattgaacggtgacgttggacagcgctgggaaaatgtgttctccagtggtttgtgtagaggatggagtttgtaaaattagtagtatatttaccaagaactctctttgaagatgtgttcaattctatttcccaggcacgagggctctgtgggaggggagccttgcccacatatggcagaattcatctgaggtttgattgcctggaaaataatgccgtcttatgttttcacaaagggagagtgtcagctagtggccaggcagtgcggcgtatgtccaagccacttgaatttgctagtggatctccattgtctgccctccaccctcaccccaccctctgatctctgcggtcctcttctcttaatgcctgctgtttgttttttttttttttcctcctcttagcttacacataaagccctctccagtgtctcccataattattagcttccctgagtttgtcatgaacatacaactgtcacgtaaaatgtattaccaaatgcagaactgtccctggccctcaaaaagtgttgaattctgtgtagttttgaaaagtaaaattaatttcaattatgatctaataccccatatatattcaggaaaaagaatatcaaatcttaggataaagaacagattatttcttcgaaatgttgcataatctaccatcaggtcataagaacagctcacattttcggaaactttactgtgtacaaagcccttttatatccagtagcccctcagtcctccgagcagcccctcatgaagtatacttgaccccatttgatggatgaagaaacctgtgatcaggcatttccagtctgaccccaaatcaccacttaaatggaatcagagtttggatttaaaccaggagtgtttgactccacaccctgagcattttccactctgttgaagctgtaatggggcctttttgttacatatatgttttaacgctaaaaaggtttattataagtgtcatagtttataagtctggaaacggttgcgtcaattcctagtgtggtgttaatgaaggtgccaagtcacagtgtcctagagggaatgtcaacggcaaggctggacgtgccagatggggagatgggagatgccagaacactcctccactctgagaagtcagtttgcgtctgtgcatctgcttcttgaaagtgcactggctctgatgctacatattgccaccgcactggtcctttaagtggaactcgaggcaggcccatcttgaatctcatcaggagattcattcctggagttacagaaggacctgggtagaaaatgcaatgatgggtccaggacaccaaagttgtgggaaattaatgattacatgtaaatatttttgaatctcatcaagagattcattcctggagttacagaaggacctggatagaaaatgcaatgatgggtccaggacaccaaagttgtgggaaattaatgattacatgtaaatattttttacccataaatcctatgcatttgatacaatgtttctgttgatcattaactatatatatttctgaaacacagaagaatgcagggtaatcatgttctaaagaatgcagcagtgtttatgcagtagatcagttggtggaacacagcctggaaacactgaatgaattctgttttgggtggggtcatatgatcccatatatgccagcgtgatcacggcggagacactaagaccgggacacatttctaaagcttttcttctgcagaggctaatttctacctatgagcaattcacctgcagggaggagggggatgttggaaggtggggagagaggaaggaaacatctcagacaaaagggcactgagatgatttccgatggacaacaggcagagtgagccatgtcctggcccttgtttgagagtctggcctggggccagtctggattcagcaagcctccgaagggagactgagtgaggaggcgagaacagtgctccagaaatgaaagtttctattgttctcactgtgttactcccgaatttaaaataaaataagcattctggccgggcgcagtggctcacgcctgtaatcccagcactctgggaggccaaggcgggtggatcacgaggtcaagagatcgagaccatcctggctaacatggtgaaaccctgtctctactaaaaatacaaaaaattagccgggcgtggtggtgggcacctgtagtcccagctactcgggaggctgaggcaggagaatggcatgaacccgggaggcggagcttgcagtgagccgagatcgcgccactgcactccagcctgggcgacagagagaaactccatctcaaaaaaataaaaataaaaaataaaaaaataagcattctgtttgtgggagaagtgcaaacactgttttccttagtgtgagcctgtgatgccccttggtagctgatgtctcctctccctcctggccaggcatggggaagcttttccagcctgtgttgtgaccccaggggtacaggttgggagtttggggtaaccctgagccccaggcaaggggctacagtctataagaaagaaagacaccaggagcttcagtccataagaaagacaccagggcagttccgccccagggccctcagcgcagcagactggggaaagctcttgggtggtttttctgtcaggcaagtgaaaggctggtgctgcgctgagggtctctttccgggaaacatctttttcaggggaactggacattttctttcttttttatttttcttttagatggagttttgctcttttttacccaggctgcagggaagtggcacgatctcagcttactgcaacctccaccccccggggttcaagcgactcccctgcctcagcctcctgagtagctgggattacaggcatccgccaccatgcctggctaaattttgtatttttagtagagatggggtttcaccatgttggccaggctggtctcgaactcaatccacccatcttggcctctcagattgctgggattacaggtgttagccaccgcgcccggccttgacattttctttcaaggaaacaatgggaactttaagagttcctctctcagggctcatagaattctaacattgcccagattgctgccgtcataaactttcaatgctgttccagctcctaaagcatcggtgatgtgttttggtgggtggataccgagtgaagaccatcatgtcatcctcttcatcctccgggtcctccggtgggttcggtgatgtcggtttggcaggtgctgttcatgaagggaacaaggtggacctcatctgccttcaatccaggcctacgtgcctcctttgaggaaaagggcagctgggttgtaataggcaggggaggaacactggctgcagaggctgcctccgctttgaggcatctagcaatgtacagatgtcaaccagtcaccaagtgtcatcgtcccctacccacaaggatgttccagggggagggagaggagtggctgacactaatcccctttgtagaagagaaagatacagagctcatgcccgtctcccccagagctcagtgtgtctcctggcattgtgtctgggtgctggcctggtgtatcagttgggattctctagagaaatagaacttataggatatttttacattttaagatatttatttgaaggaattggctaatgcagttgtgggagtgggcaggtctgagatctgcaggggaggctggcaggctggaaagtaggcagaatttcttctgctctggaaaccgcaggctttgttcttaaggccttcaactgattagacaaggcccactcacattatctgacatcatctcctttagtcaagttcaactgactagctacctgtgcaaatgccttcccagtacaacctcagttagcatttgattaagtcactgggtgctacggcctggccaagttgacacaggaaactgacccccacacctgacttccagggatgctgcactcatcagtgactggtgacccattgtactttttagatctccaaaccagtgtgctctggggggccagttcaccgctgctgctggagctcagcctgactggacagcgggtggtaaagggggtggcgtgtcaggtcagaggttcactagggggctgctcaagctcagtgatctgaaagaattgaaacataagtggtgagtcagtgttctgctattaacaatccaacgggcttcctgaaggggaatgggggaaaagaaagctgaacagttatcagtggagctaagactcatctcagccagaggttggaggcagccttggggcagacaaaggactgcctgggatcccatccgcaggctttgctgactcactgtgggcttttttttttttttttttttttttttgagacagttttgctcttgtcacccaggctggaatgcaatggcacaatctcggctcactgcaacctctgcctcccgagttcaagcgattctcctgcctcagcctcccgagtggctagttttcatatttttagcggagatggggcttcaccatgttgtccaggctggtctcgaactccttacctcaggtgatccacccgcctcagcctcccaaagtgctgggattacaagcgtgagccaccatgcccggcctcactatgggctctttacgaatgtcaggtgcagctccataaaagggaacatgggcgtgattcactctgctttattttggacaccgtgaaccagcaccgggctgtgtcagcccagctcgaggggccagggcagaggcagggttcacggagacgcagattctgccacggaggggctcacagatgagatgctgcagagcagtgtgtggctgcctgcctctggaggagccccgccaggagtgcagctcctcaacgctccactacctgcacctgcatccttccagactcggaagccccaggccagctgtgccagggagttagcccatctcctggcccctggcccaatagcttcttctaattgtccctcctcttagcttatgcataatgggctttcctgtagtgcacatgccacttgaagtcaagtccaaggggaagttacgtaagtcaaatattactctttggctagaacttgtgggctgttacctttgtggcccctgactatcttgcagacacctccacgggagaagtgcactctctgcagcttaggtctttccagaacatggcccacctccttctgcctagaatacccagcttgggaatagtgccctctgtccatccctatccatccagtacccacggagaaaaaggccatgtgctttgagagaaaggaaggacttagttcccaaccgaatagtggaattctacaaaacctcagtcctaacgtgcttacaagctcctgaaatgaaatacaagtggtgaaacgagatctgttgccattataatagagtttctgtaaagcataataaaagaaaaacaggagagaaaggaaccactgctttgcgagccaactgggatgtccttgtgggtttggcttggccactgccagatcaaacagcagcattcttgcagacagtaatctaattgcacgttgtgtagacacaggacatcatttttcagcttcggtggtccacagccaccctctccctttcttcactctagcctcacgcaccagaaagccccaagtgttcacacaatggagaactgtcagtgtgtggccaaactaaaaccagctgttttcctgtgccatccacaccaagggcctggctgggagtttcagcgcctgctcagcctctcgtgagctccctaccaatgccctgaatttgctgtgaggtccccaaagctcaagtcatgatagactagcaggataagccaagaggtaacacctgctcactcatggtccacaagcaaactgtcttctcgtgagcaggctggcaggtctgtgcagagcaggctgcttttcctccatctgagcatccccagctcaggccagccagatcacaggcagcttacactaagtggcaccttcccctttccacaggcgatggcgatttcgtgaagcccacctggaggctcactgcaggtggaactcagtcaatttatgtgccatgctgtgagtcccccctcagcccagtctgcaggccacctggagccattgccatgtttgattctgttgagtgagggttcccccggtgtggtgattctcagcgtgggctccgggaccagcagcatcacctccacctgggagcttgtttgagatgcggcttcttaggccctgccctagaatcggaagagacctgggtggcagcccagcacgctgtgtttgaaggagccctctgcgggattccgatgcctggtagtctgagaaccactgctctgttgcacgatccaaggagatgaaaaatgagaaagcccagcagctgggtaaaggtgacccacccagcgaatgatctgggaggatctacgcggaggtggggttgttccccagaagtccttgcctgagttgagaaatacctccttccctcccgccacattggcgctttgcccagctgggcctgtgcagcgagagacaatgctatctgggccttgcctctctctgggatagattcattgcatgccatgaataactccagcctcgggtcagatagcaggatgttttatagatgttatttaaaaaacatgccatttgtcatgtgatggagatgagaaaaagtagggagtatctgctgggtccatcagggccttagacatactgtttatgcgtggagtcattcattcattcaatgaatatttattgagcacctactttcctagtctcttgggatagagtgataaaatatacaaaaaagttttgcctcactaagttcactttctagcagtgaagatggtcatgacatcagaccacttatgaaaacacagcaggttagatcatggtaaatgctaaggagaaaaataaagacgtgaagcggatggcagctctaaagaaggtggctggagaagatcacaaaaaagtgatgtttgagtaaagctgcaaaggcagttgagggagaatgcccgtgattaaacagcagaaaatattccaagaggagggaatgctaaatgcaaaggccctgaggtcagcttgaggtgttcgaggacaacaagcaggccatcgtggctgctgtttagtgtccaagaagaagagtaatagatgatgagtttggagagcccgtggggccattgccggactttgactttcactttctggtgagttcagaaatcattaggggacttgaggcaaaggagggatatagtgttacttagattttgcagggcctctctggctcctgtgttgaagtcttcctgagaaaatgtgggtgtaggatgggagacatctgcgtgagagtgggtgagagtggtagcaagggagggtgggagaggcagtcgcatcctgggtatagttggaaggtggaattaacgtgctttgctgatgggttggacatatggcatgaggaaaagaggaagcgaggatgggccaaggcttggggaatgtaccccaaacaaggtacggacaaaccataactaggaatcctcatgagcatagaggcccctttaagggccccttttaagcatcaccccagacactggggacaggaacttctctctaataaacaccaggtaaaacaagaggctcttgcctccttgcctgagctcagtggatcttaattcattagcccagtggttctcaaccatcgtgatgtggcccccagaggcatttgccaatgctcgtgtttctgctggtcacagctgggaggtgttactggtgtctggtgggtagaggccggggacatcctgcagtacacagggcagcgcccctgcagcccccacccccacctgtccaaagagtgacctggctccgagtggcactagtgtcgaagttgacaaatgctgcaggaaaccaacgtgtatttagtgtttaatctgcatcatggactgtgttagcttcgatggagatggattaagaattaagtgaagctggccgggtgcaggtggctcacacttgtaatcccagcactttgggaggctgaggtgggcagatcacttgaggtcaggagttcaagaccagcctggccaacatggtgaaacccccatctctacaaaaaatacagaagttagctgggcatggtggcaggtgcctgtagtcccagctactcaggaggctgagacaggagaatcacttgaacctgggaggcagaggttgcaatgagctgagatcacggcactgcactccagtgacagagcaagactctgtctcaaaaaaaaaaaagagagaaagaaaaaaaaaaggaactaagaggagctcatggtctaccaaaggtgaaaaagattctgtgagatcataagacacattcagtacagagcgatgttcagggcccagcaataacagatatgagggtaccatcaactctacctgggcaggagaaaaagaccctgaaagggataatattaacccatatttctaaaacccacatgatttattaatagattttggtatacaacatattgtccagttttctcaaacatctatgagatgacattattatgattattcacatttacggatgaccactgagtttccaaaagttttcgtcacttgctcaagtgaaagttagtgaaagtgaaagttggccatttgaccacaggcctggactcttcttcactccctcagggcttcttagaagaagctgaacgtctttcctgcattgagagggatagcaaggttctctccacgtgtcagacaagcagtgacaagatgcaccaaatccaagtgccaactgcattttgattttttgtatatgttacacattttagaaacatttattactatcttactttatcacatcaggtcagttcacctgcactcacctttacattaacctcaccaggtgtttccaaaacaatcacattttaaaaataataggtgggtcaggagttcgagaccagcctggccaacatggtgaaaccccatctctactaaaaatatatattaaaaaaaaaattagccaggtgcctataatcccggaggctgaggcgggagaatcgcttgaacccagtgggggcggaggttgcagtgagctgagatcgcgccattgcactccagcctaggcaacaagagcaaaactccgtctcaaaaaaaaaaaaaaaagaaaaaaagaaagtaaaattgttttggttaccaggattcacctggcctgttataaaaacatgaagcaccatactggctattgggctcaatcctttcttctctgaaaaaggagtctttcagacaaattaaaagacgtgcacaagatagaaaagatgtcacatctgatctttgtcatgtaactgcttgtagagatcttatgctacagaacattttgttttcaaatgatgaatcccaaaatggtgcatttccctccagttttcaagatctaaaagcaacacggtcttgctggcattcgtttttggctgtaaagagaaatataaacttaaataatgaaactttctcagggaaacatcgagcccctttaaggggacaaagaactaactgttggtgagctggtggtgactttttaattaattttgtcttcaactgcttcagggaagggggagggaacaggactgttgggaagaggctgaaattccaggtgtaagagagaatatttagtaagggtaaaaataacacacagctgtgaagacaaacatctacggtttcagtttgagcccggagttctacatgaatcactgctgagctccacccgctgctccagccatggggtctgaaacagcttttccactgcctctgattcagaaataaaacagacccacaaattaccctgcagcgctccagacaatcccctccttgtctggggtcctaaaaataccttttgtggtgactgacctccgattcacactatgaaacttgattaggagcttgctcagtcgattaggactaagtatatgcttttaggatccttatgaagaaaaccacctgagaagggatttatttgtattcagacttgagacaggcctggaatgcttgtcccgggccagcctccttgtgggggttctctcgcagaactgacccctttgccctcttagggtagagctgccaaagaaagcctttccatttcttccatgtggcttcctcaccaagttcttcttaatgtgaactaacctaataaaccaaaaggaacattcagaaagacagtgacattccaaaaagcagttgcatgctgaacactgcacaatagtaaaccttagcttcctgacctacctaagagttcaccgaggtacagttatgaacagttgccaagaacaaaaagcctcacatttacacccacatacacgcatgcacagccatgcacatgcagtatgttgctgtgttaatctgtatagtgcttcacagtttgcagactttcttcacaggcatcatctcagggatgtcctcacagcaacctcaagaaagcatccattcatttttatgaatgaaggagttgagcctcgaaaggttaggtgacccatctaaggtcaaccaaggtcagcaatggttttctgactgcaacacgaggggctttctcttgcactgcaggtatgagataaggaactcaatatttaaatggaagattcattcataaatgtactcactcatcctgcagacacttactgagaaaatacagagaatggtgcaattggaagggagacattcctctctggcggcccaggaaaggcttgtagagaacctagaggtgagcatggacaggtgaatagagcaggtaccaggtggtgaacaggtgaatagggcaggtatcaggtggtcataggccttgaaggcagagggagtagcaaaagtgaaggcctgaagggaagagactagggggtgatgtggaatgtggtctttgagcacagagcacatggagttggggagaggggctttggctactcaaatgccagccccatgttaatagagacactgatataactccagtacctggggcagtgcttggcctagaaagatgctccacagatatttgctaaacaaatgagtgaattgaggggctccagagccagatcactgaggagaatctagggaggggctctgggccatgatgggggttaggttggacatgggcagcttgcatttctgtttgggggagagcactctggtagcaggagggagaaagctttggaagagttcggggacatttcaccagcatgtgatggagaacaaggggttggaaagtcgtgtccaggtgcaagaggaattcagaggattaggaaggaggatggctctagaagaataggtagattttcgacaggattagcgggtttgcctccactgactcaaagaagaagacatattgatttccgcaattacattctgacttgccttggactttctccaaggagtgggcccctgctaagtgttctgaagtgagggtgaatcagatttaatgtggccagcgagcttggggctgcccctctgggatgtattcagtgccgttcttggataaatgaggcccattcacactcacaagggctgaggctccatgcttgtcaagctaatggccacggctgtgccatttcattgcgggttctttccatgacggaaattgcctcgctgtaagtagactctgatgtgagaaaaccaaagtcagatgccaagtttattttgtttttcaaagactaaagaccaaattttacatttctcagtatgttttttcagtaatattagtccccaccaccaaccccgctttttttttgtttaaggggtattatgtatggacgacagctcaaggaggctttcatcttggacttattttatttaatcttaaaaaattagattgactgcttccccagtggtccagctcctgtcctggtcctcacctccatctttttgggcctgcagtcagagtcagatgcactcccactcggctgtctcgtcatggggactttttgtctggtttccttttgcacttaagaatgtttgcccatcatctgtgtaaaacatgcaccctgctgggcacagcaatgaagttttggggagaagcatagaacgcttaactgcaaattgagatgactatttcttttagaccaaacttatcaaaacctatttatatctctacataaacattgccaccttccaagtctcccacggggccctgccttgctccttcgtggctgccctgctcagctcacgtctgtaaccctcatccatgactgtcttcagggccactctgaagatgttcttttagaatacttaatagtgatgaaattaagttttctgaggatccattcaatggtgctttaggtctatgaaagactcctcacacggatttaccaagcaagggcatagagtggggcggtgaagtacttggagtcgagaccatgactatctaggttcaaatcccaattcttccactactggctgtgtgatcttgggcaagttatccaacctctctgtgcttcatctgtaacaaggctcctgctttcgagtatttctgtcatggagatgtgcagatgaaatgaactaacagcaatagctgacacctggcgtggtcatgtgccaggcaccatgttaaatgctttatccatatgtttattataacataaacacgtggaaagagtctggagccatgctcatcattagtcaacagtgaaatactggttggaagattaaccaactgaggcctggaaagagttgtttacccacagtgcatttggtgctcttgggagacataaacatgaccctatttagtgttggtaaatttgaatttaaaatctagaaattaggggtttcagtgcagcagctcatgcctgcaatcccagttcttggggaggctgaggtgggaggattgcttgaggacaggagttagaggccagcctgggcaacatagtgagaccccatctatacaaataattaaaaaacagctgggtgtggtggcacgtgcctgtagtcccaactacttgggaggctgaggcaagaggatcgcttgagcccaggagtttgagactgcagtgagctataatcatacctctgtactccagcctgggtgacagagcaagaccctgtctcttaaaaaacaataaaatcaaatcaaatctagaaatttgggagttatgaaactagaggcatgtataacactgcatctctcaaggttttctccttttttaattacacgtttttttcatgtttttgcattgacttctctgacaggtctgatctttccaatggcagccagtaaggaggagaggctggggacatgccgtctctcatcctctgtggctgcagcatgtgagcactgtgtgcagggagcgtcctgctctgccaccagctacgcctggcacggtgcgggatggtcttagatgtattatgagatgttgggaacgatattgtttactgcataatccagttttcttcatgagaagccccgagaaaaactctcaaagcttaacccagggagagctttatttctgctgaataactggtttgtatgtagcttattaatacctcaaaccttgtcatcagatgcacttgtgtctttgctttggctagtagaaagctcagagttgaattggtatcctacctcagcaggataaatagtaagcttactcagtgggctgctttcatctcttaattcctttttggcccttgtttcctcatttttattctgttaattatttatgttatcattttgtcttatatgtatttttataagccaccccaaacttcacatagcttgcacacaggtaggggaataatggctatttaaaaccactatacatatttataaatagaactctggagttgcagaggaaaattacgaagcccctccctaaaaaactgttaacgaagctaaactcttgttcatccaagtggtttccagacagtcatgtctgggggcttgaaaatggggcttcttccagccctctgattcagtaaccctatgagaacccaactgggcttagcaacgtgtctgccttctctccttaactcaaatttaacaaaatttccaatgtatttgatattctttgccgtgtccttttctcattaattcagaatactagtatgttttaagaagtcagtgctcatgattttaaatgattagaacttaattctccaactgctgtttaagggagattattgtttgaagctcaacaagccagtttcattgggcacgtctccagttactagaagaaggacaccagcattctggttttttttatttccatcatgaatgtttggttgtcttcctacactatttctgtgttcctgtgagtgaccacagttatgaccaaatgccatggaaaagtgtgagattgctgcagaggttacactcctcaaggagtgtggcctgtagtcccagctattcatagggaggctgaaccaaggaggattgcttgagctcaggagtttgaggctgtgtggccccaagggtgttgctagggagttgtgaggtgttatggctggctttttaatatcccagccattgggctattgttcagttctttctcagaattctgaaccagccccccacctcttggggccccctggctaatgtggaatttctgctgctgtgagcagagggaagtatctgtcttcccagctcctgtttactcttgttgatgccacatattgcataggactgtcaagactaatgtctgtgggtgacaaatagaacctggaactgaaaatgtaaatttgagaataacagttcatgaccaagaatccaaaagcaaatgcaacaaaaacaaagataaatagatgggacttagttaaaccaaaaactttcttcacagcaaaagaaataatcagcaaacagacaacccacagagtggaagaaaatatttgcaaactatgcatttgacaaaggactaatatccagaatcgacaactcaaacaaatcagcaagaaaaaaataaataatttcatcaaaaaatgggttaaggacatgaatagacaattctcaaaagaagaaatacaaatggccaacaaacatgaaaaaacactcaacatcacttgttatcagggaaatgcaaatcaagaccacagggtgataccattttactcctgcaagaatggccatcattaaaaataaaaaaaaaatagatgttggcatggatatggtgaaaagggaacacttttacactgccaatgggaatgtaaactagtacaaccactatggaaaacagcatggaaactagtacaaccactatggaactagtacaaccactgtggaaaacagtatggaaaattagaagtaaaactaccatttgatccagcaatcccaccactggttatctacccagaggaaatgaaaaagacacttgcgcatgcatgtttatagcagcacaattcgcaattgcaaaaatgtggaaccagcctaaatgcccatcaaccaatgagtggataaagaaaatgtggtgtgtgtgtgtgtgtgtatatatatatacacacatatatatagacatatatgcacacacatatacatgtatacacacatatatacatatatacacatatatgtatatatgtacatgtgtatacatgtatatatacacatatgtatatatgtacatgtgtatacatgtacatatacacatatgtatatatgtacatgtgtatacatgtacatatacacatatgtatatatgtacatgtgcatacatgtatatacacatatgtatatatgtacatgtgcatacatgtatatacacatatgtgtatatgtacatgtgtacacgtgtatacatgtatacacacatgtttatatgtgcgtatgtacatgtgtatatgtgtacatatatatgtatatgtgtacatattatatatgtatatgtgtgcatatgtagatatacatatatgtgtatatgtacatatatacatatgtatatgtgtgggtatatgtgtatatatgcgtgtgtgtatatacacacacacaccatggaatactatgcacccatgaaaaggaagaaaatggcatttgcagcaacttggatggagttggagaccattattctaaccgaagtaactcaggaatggaaaaccaaatattgtgtgttctcacttataactagaagctaagctatgaggacacaaaagcataagaatgatacagtggactttggggactctgggggaagcatgggagtgggtgagggagaaaagattgcacactgggtacagtgtttactgcttgggtgatgggtgcaacaaaatctcagaaatcaccactaaagaacttattcgtgtaaccagacaccacctgttcccccaaaactatttaaattaaataaaaagacaaaatgatttttgtttgtcctcaaaggagtctgtgagagcaatatcttgaaccacgcttatttgcaataaagaaatttccaccccaaacaaaaagacagatacatttaatatttactaaatgattatctgtttgacaggcacctgctgaatagcctgagaatattctcaggaactgctgcaacacacatatgcaagtatgtgtatgtttaaaagtatgtgtatgtttaaaaggtaactagtcttcatttcaggaaggcatcagggactccctgacccatacactactctggtttaaagtgtacattgcagcactcatcctgacacactgtcctacttcaggactgttcattccctgcacagcatactctttgtcatgtgcacaataaaacaatgcattgaacgtccaaatccttatcatgtgagaatggagaacacgtggtcctctatgctgggcagcgcttggtgcaggtgacataccaagctgtttgcgggaactttttcccggcgatgtgtgagcctcggaatgcctggtgaaggtggggttgcagtggagtaatcaagacacacatttgtgcagtgtggatcttttcttgggcacagagctagaaatgtatttatagtgagactttcaaatgaacacttttcagttctctgaattgtgataaaatttccttttctttttttctctcttttgttttttttttgagacacggttttgctctgttgtccaggctgcagtgcagtagcatgatctcagctcactgcagtctcaacctccccaggctcaggtgatcctcccacctgagcctcctgagtagctgggactacaggtgcacaccatgcccgactaatttttgtattttttgtaaacacatttttcatgttgtccaggctggtcttgaactcctgagctaaaacaattcacctatcttggcctcccaaaatgctgggattatatgcgtgagccactgtgcctggcgtccttttcttaagtaaagcagatatctctgaaaattcttttcttctccaggaatcactcctctttcttatttgcatcttgtatatgtgccctgtttgtgtcatgcacatgcttttcagggaatgaacagtcccagggtaggagagtatgtcaggatgagtgctttagtgtacaccttaaaccagagtagtgtatgggtcagggagtccctgatgccttcctgaaatgaagatctagttacctttgaaaagacattgtcttgcctttactttgtggagtcattctgttcagggttaagaagcagggatggagagttcgggccacccgcactgaagtctcattctacctcctcctggctgtgagtcctggagccagccccttgtgttttgagtactcagttcacacctctggaaagtggagacaatgccagcaacacagttcgctgtggtgaagactgataactattaagctcccaaaacagatcccaaacatgttaaggctactcttttgctgttaaaatttgcaagagaaacctgggtgaagtggctcacgcctgtaatcccagcaccttgggaagccaaggcagaaggatcaccttaggtcaggagttcgagaccagcctggccaacatggtgaaaccccgtctctactaaaaatacaaaaatcagccaggcgtggtggcaggcgcctgtaatgccagctacttgggaggccaggctggtctcgaacacttagcctcaagtgatctgcctgcctcagcctcccaaagtgctgagattacaggcatgagctgccgcaaccagcctgaaggatctactttaatgtcacagagaaactcttgtgatctatgcctagagttcttgtcctcggatatgaaaattaaactagaaagaactaaaagaaaatgaaaaaggggttggtctgaagggttcaaaatcctcaatgtcccctgtttctataattctttttttttttgacatggagtcttgctcttgttgcccaggctggggtgcaatggcgtggtcttggctcaccgcaacctccgcctccctggttcaagcgattctcctgcctcagcctcccgagtagctgggattacgggcatgcaccaccacgcccggctaatttttttttttaagtagagacagggtttttccatgttggtcaggctggtctcaaactcccgacctcaggtgatccgcccagctcggcctcccaaagtgctgggattacaggcgtgagtcaccacacctggcctgtttctataattttatacatctctttgatcttttacttttcaaattgttaactgcgttgttggagaagaaagaattgatgggacctggtatacggccggcacttgataacagctgtctaaatggatgagtgaatgattgaatctgaacaaaggttgtctagattttatagttgttacttgagttactcacatcatctgggcaaagtctttttcctaaagaacctaatccctctaacttctcttccctggtaacttctctccttgagacaaatataccaaaacatatacactctactcaactgatggaattttccagaggaataggaaactcagtctaagtgaagacactctgtgttttcatattaggatgggtcttttagagataaatgtgtgaagccaggaaaaatagcatcaagaggaaataatgcatgtgtaggcagcggtggaaatattcaggatctacttcatgggaactcagaccattattattttaaaatttccttcatgttagcacagctgtgaggatgccatcaggcagggctgtgcattccaggcccatgttagggcctgagtcctgcgtgaccctgactgtaacctccatccgcagatggcagtgtaccctcttcactgccaacacctaagatccctccataggcttcagacacatttgtaagtgatgctgagaacaaacctatattttcaagttcccacatgctgaacaaacactttcccttcctgtccacatcccagctatggctttcaggtgtggaatgaccttctccatctcaccccactcagaaagtgcgctcctgcctcagatggttttgacctccttagacttgaagttcacatccatgccaagcccatagttttttgattgtccaagttctctgcagaactccaactaacaagaagtggaggagataaatgaggcttcattggcgtggatcccacaaccagaaacactgggatagaaatctaaaatctagagaaagcgaaggttcccagattccaaggaatatgaaaaaaatgtatgcattggatagagcctgagaggcatttctggaaatccgccttagacaacagaccctaaatattaatacttctcagctacagtgaccctgggtttaccatctacgtgttaaccatctaagaaggcactgacatgtattttctgttttctgcttaagctggattttctctctcttttctttctctctctttctctctctctttctttctttctttcctttcttctttttttgatggagtttcactcatgttgcccaggctggagtgcaatggcgccatctcagctcaccacgacctcaacctcccaggttcaagggattctcctgcctcagcctcccgagtagctgagattaaaggcatgcaccaccacttgcccagctaattttgtatttttagtaaagactgggtttctccatgttgatcaggctggtcttgaactcctgacctcaggtgatctgcccacctcggcctcccaaaatgctgggattacaggtgtgagccaccactcctggccctaagctggattttctttttagcatttccctatcagatgcgatttcaccaatgtcctgtagctttcacaactcactgtttaaaatgttttccttttctttttccagaaaggtaggtttgactttatccaaatgacagtgactgccttactaacagcagccctgtgacctgttgcccacggtcagtagtcagtagctgacccctctctgcatccacacagttccttccctatccctttcccaagggtcctctaggactgctggagtccactccccatgaggcctcccctagcgtcagtcctcacccttccctgcccttcctgtctacacctaagcctggaacactgtgagtcttcaaagctccatatgtaaagattggctgcagggatttgaaattgagcaggaggatttcattctgaggttttgagaaggaacgtcgttccaggataaacctcactgagcagcgagtgtccctggtgccgccccacagcatctgtctactctgcctgtttgctgtcacaccgcgagaacaaagagcagttcactgttccctgcaagtgtccccaatcagttgtcacagatggagttttgacatgacagtttcaggaggagctgcttaagaaacagaagccaggtggtagttccgcctcccttgtgcgtgttctgtgcatctagccagtatgggcactgtcctagcctgtgcaggctgccttcacagagccccacagactggctggctgaaacaatgggactcgagcttgcatacttctggaggttggaagtctaaaatcagacaccagcagggccagtctctggtgaggtctctgtccttgggttgcagatggcctggccaccttcttgctctgcccttacatggcagagagagagagagagagagagagagagagagagagagctcgagctctggtctctttcttttctaataagggcactaatcccatcgtgggactctaccctcatgacctcatcaaactgaaattacctcccaaaggctctctctcctaatatcatcacattgggagttagggcttcaaaatatgcatttcgggaggacagaaggcaaggcctgttttcggcatttcttttcttttcttttcttttttgttttgagatggaatcttactctgtcgccagtctggagtgcagtggcatgatctcagctcactgcaacctccacctcccggattcaagcaattttcctgcctcagcctcctgagtagctgggactacaggcatgcccagctaatttttgtatttttagtagagacggggtttcaccatgttggccaggatggtctggatctcttgacctcatgatccgcccacctcggcatcccaaagtgttgggactacaggcatgagccacggcaccccgcctgtatttggcttttcacacttgtcctttctcccccagtctcttccgccttgcccttctttggttctctctgtgtattgtgagaagtcgatggagacatgctctttgattgctgttataatggaagaatatttcttctcctccaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcaggtcaggtgcccacagcttcactgccctcggcagatcgcaacttccccaaggctaggctgagcctcagggagctcttctcccccacctgtggcattgatcacatctcctttgtccagagcagggcttgtaaatgggagctggcagaggtctatgcatgaggacatgttcacggatcgacagcaaagcaagaaaaatacacctgtatttaaaaatacaaatatttaaaaaatatgtgagacagcagtatgtagccccagctctttattttgccacatagagaaaaatacacacacacacacacacacacacacacacacacacacactacgtatggagagagacagagagaaagaggatgtccaggcaaacatgcagccttgcttgtgtgcacacacatatgcacacgtgtgtatatgtctatgaaaggtgacctttctagggaggaattgccacttcttggagattattgttccaaatatcctgtccttcatgaggtactatttatgatagatgatagacttgtttgtttttaaaattctcttatctggaaaaataaacatgtgggagccatatattatatggctgtcttacgtgttcccttaagcatctaaaattccagctatcactggcctgtaatacagattctaataaccagagtaactctttaccacaaacataattcaaaaccaacccaaaggaatagctcttgaacttgaaagacgtgacaagaacttatttatttagccaaactaaaggtaatagaaaaaatgacttaaagctcctcagaggatacatgctacctaaagccagaaatataagaacaacagcaacagtcaccagtcagtgaacctttaccctacaggaggcatttggataaatgctttagaaacgtgatctcaagcaatctttgcaaatggacatctttctcatgatttccctgatgaggaagatgaagttcagagaggtccaccaacttttccaagggcattaggctaataagaggccaagttaggactcaggcaggtctgccttactcctttagtctctgcctgttggcattggattaaatctcagctgcttacagcaatttctgtgggttccctcctgttacttgtttcagccatctggtcaccctgcggtcctgcctcagggatttgaatttggcgtcagctcagcctgaaacccttaattccaggtagttccatatcattttccttcaccaagtatccgtgccaatgtcatggcctcagggaggccagtcctgagcacttccgtctggaattgctctcgtctccacctgtgactgccagtctcctgttggcctgatttttcttgatttcattcattcccttctgccattatattgcatgtttatgtaaaagttttcttactggccagccatggtggctcacacctgtaatcccagcactttgggaggctgaggcaggagaatcgcttgaaccagagaggcagaggttgcagtgagccaaaattgtgccattgcactccagcctgggcgacaagagcaagactccgtctcaaaataataaaaataaaaaaataaaaagttttcttattatcctcttccctgaatggaacataagccccacaaaggccctatctccagggccagttgcagtgcctggtaagtgggaggtgctcagtgaatattaagggaggtggagaatggatgaacggacacctcaccactgagctgcactgtacaagttactccttgttggcaaagtagccaagggcatgcatgggtgaaatctgcacaaactcaattctcccttgctcctggggtcacctaaattaatatctgcgaagtgtgatggcaaacaggttagattccctccatggtgtgactttccctttacctgagttggatcatgcccagtgggcttctgtcaccttctagacagaagagttcaggagtgcagggtactttgcaaaacatctggcctggatttgaatcccaggtttcagcttagatctgtcaccatgtgactttcagcaaacacgtaaagctggttcgatgcagtggggtgtgaaagggaccatcctttggggttgtgcctgatttcaaagcattttttaagacttacaggagacactgatggtagattacgaaagggagaaaaccgtccttagtatttactgaaaggcagttgacaggtacagaggccatgcatttggtttgatcttgacaatgcacctgaatgcctgagactgcctcacttgctgctgtgcctcagaacagggggctgttcctgttggatgggaaaaatagaaacacaaatgtcccaggtgcccactccagatgtgtggcacataagaaaaactcgaaggctaggatgtgcctggaggagaggcaggagggcagtggtgtgttgcccagacactctctgggcatgaacaaagtgaagtagacacccaaaggaagccccctaacccatctcaccctttgccctcctccttaagaatgtaatttcttcaaaggagacaaaacaaagtgtttagatctcaaagatgagagaatccatctgagggggcctgcactgaagattccttgcttggttcctcattgaatcacagatgtaagaggtaatgcctggtaccatcttctaactggtgaggctgtatttccatgaggccatcaatatgctttgatgtcataaatatccttttcagtagggccagacttgagtctttctacactaaggaaagtatttagaaaataagagagatatttgtgtggggaagagaacagagaatcaactgaagtcagagcacccaggattttttatacatagtagctgctcatcaaatattagctggatggatgcaaggatagctctgcaaattggcttatagtaagctttgatgtgaaggctgtttcctttctttggagcaaagtactcttctcttcagctcttccctccttcagttgcttcacgccagtgtaggcagttattcagttaatagtgtttgtaagagagctagttgtggctgattttgcaagttgtgagtctttcagttattggtcaagcttcatgtatgtgtgctcatacacacacagagatgaacacacacacacacacacgcacacacacacacagcttcattgcacaatctggacaattttccaatgtggccatgaggttgcaggacctcaggcagctgtaccagctgctgtatccatccccatggtatccaggcacctcactaaggcagatttggggcacggagtaccccatgtgtgcaaaaagaattctccagacctggtcctgagtggttcacatagaccttactacttagagacattgcttggcactaatgcaaatcacacggatagctgagtgaaaaaaaaaaaaaccatcagttattcctaaacatttgtaccatcatcaatacatgccgatgtttacacactagagatagcagtggccctaataaacactgatgaggaaatttgtactgtacggagactgagagataaaaccacagaggagctggggggctttgtccgtgttcagattgggttctggtacctggaacccacttttgagaagcgattccctcaaccctggttttgatactcatgatcttgagttaataaagaagcccataaaaaaagtgtcaaaaaaaagcccataagaaagtgtcaactagaaaatgtccctgaaggataaatgtagactgtcacttgatatatttacactgcctcctatttcagaacagatttaagaaagctcacatagatacatatgaaagagcacggtagaatccactttttaaaaataaaggaatgtggagaatggactaaagtaaaaattgaacagagagagtaaaaccaggagtgaggtttacacgcacgtgtgtgtgtgtgtatgtgtatttttaattgcaacatttaaatattgcagaattgcaaaaggtaggtgttatttggcttcgaggtatcatcaggcagtatgaaagggataattcagtgcctacaggataaaaagaaagcaaatgtgaaaagatggtccagctattaattctgagtctggaggaagatgtgttcctctgtttgtcctaaggaagataaggggagtcatgagcaaagcattcaaccagtagcgccaccaggcattctgggcagccctggtttgtgcctgttgttctggcaagactgttgattgtgccttcccaaagggtactggttaggccataattcccatctctggtttttatctatgtatttggtgcgagtatctgtaaatctaggaggatctctcatagggcagggcagtctcttacactgtcgtaaacccaagtgtcattcagtgaaaccagttgtaataagaggggcctgacaagtgtgacatcccccatgctggttacatggctcttttttggccgagcttaatttggaggttgactagaaagtgtttttctttttctttctttctttttttttttttttttttttttgagacaaagtctcgctcttgttccccagactgaattgcaatggcaggatctcagctcactgcaacctctgcctcccaggttcaagtgattctcctgcctcagcctcctgagtagctgggattacaggcgcccgccaccacgccaggctaatttttgtatttttagtagagatggggtttcgccatgtttgccaggctggtctcaaactcctgacctcaggtgatccgcccacctcggcctcccaaagtgctgggattacaggcatgaaccaccacgcctggcctagaaagtgtttttcaaagtatggtcagaaccacttgtatcaagattacctggaaaatttatgattaaaaatacacatttcctgccagtcacagtggcttacacctgtaatcccagcactttgggaggccaaggagttcaagaccagcctggacaacatagtgggaccccatttctacaaaaaattttaacattagccaggtgtagtggtggttcctgtagtcccagctacttgggagactgaggcgggaggattctttgagcccagaagtttgaggctgcagtgaaccatgattgcaccacttcactcccaccaggaagccagagtgagaccctttcccagacacacacacacacacacacacacacacacacttccaaatgttccaaacctgggtgtggggttggaaattttacattattaacatgcttattgtgtatgtaattttcatgtacaataaggttgaaaagttctaatctagatagaagatataaattttactttaatagacttgaattatttttaataaagatatggtttatcacttttagaaaaggcaagtagacaaaaaggaaagatagaaatgattaacagtatcacattaacattccaaaaaaaaatgaagaatcactcattgcagtagttactgttactctttaggtgttggctgtgaacatggagatgtgctaaccaagtggctaacaaagaggaaggcacaggctccattcacttcttaaaagttgcaaaatgctgaccaaaatgcaataggacctctcgctttagcagcttatagcattttgaaagatttctctttttctgtttttttattattattttttatttatttatttattttgagatggagcctcgctctgttgcccaggctggagtgcaatggcgcggtcacggcttactgcaacctctgtctcctgggttcaagcaattctcctgcctcagcctcctgagtagctgggatctcaggcgcctgccaccacagccagctaatttttgtatttgtagtagagacggggtttcaccatgttggcaaggctggtctcaaactcctgacctcagatgatccacccacctcggtcacccaaagtgctgggattacaggcgtgagccaccgggcctggcctctttttctgttttaattccttaaaataggtgctaaagtgttgagtttttcaaatgcctctgcttctatttttaaaataattcactttcagcatagacccttgcaataatcagtaatctcagagataagagtagccacattcttctcttcactgtatctcttcactttcttcattattaattcattcattaaactcttactgtgttccattcaccgtgaataaaagctctaatgagatttaaaatcaccttttcttgcccaccaaacatgtgtggctgaagctacatgacttgtgtcttactcagacccctgtgctaggacctttctattccgttagaaagtgttcatggagttcccattactcttaatcactgaggagatgaccgaaggctgtcagaagtagctaagacccacccatgtggggtaagtagtttttgacagacaggagaaggtgtgattgagagctcaaatgaatgactcagaccagtatttcagagcatgtgaggaatggagattgctatgacaggacgaatcaagaacagcttcatttatacccacgatgatgtgatttcgaaagccctttgcagcctctgccgttttcctctgccacatccccaactcacgcgctgcattttcaccacccggtgtccttgtccctgcggttccctctctggaatgctcttgctcattcttccagacatcttcaaaatctgccctgtcaagggagccatgcttgatcctctggcaaattaatcactcctcttatgacatcttaccaattattttgttatcatactttattttgtttcatattgtattctcaaatgcatgtatatacttacttaaatgtggatattctgcaaaggatttgaggtgccgtgtgaactaaactactgatgggcttatacccaattgacttatcaaatggaaattaggaatcagtgctaaggcagttaaaaatacaaatgagaagccaagagcatgtgagggaagaatgcagccattttgaccacaagcttgcccaagatgctgtacttaagtttctagtatggctttgagcttcctggcagccaaaatgaaaagagttatttggggaaataatttttcctttcaaaaaagaagtttcacagggaaggcaatgtttatcatagtgtagaatcctaaaagaaggatcccttttggggccactggggccatagacctgaccatcgaccgtcttcctgccacagttgcagcactgcatttcaacagcttatttcttgtgacatcttctgtgagcgctgagttacattagagaatagctcagcacaggtagaggacagacacccagcatgagtctttggcagtctgatttcatgtaaagaagggatcttgagttctcagagtgttagaggactgcatagtttccacatgatcctccctaaatattgacattcccccactgggctttgaaagccagtgaataacaagtaatagaacataccctccgaccaagccctgatggctgatatattatgtttccaatcctcttagcgtgagttatttataagcctgtctgttctattagattgtaagtttagtgaggtgatgatcatgtcttttgtgttctcaatcgccagacaacacagccagcacttggattctgtgtggaggagagtaaatgtgatttatcaagttaacagtaatctagatctaactagcaggaatcgcagactcgcaggggttgcaggattcttggtggtctaagttcagtcttcctttaaacatgagaaaaccaagactgagagaggtgaaatgactttcccgggaacacttgcacaactgggtgagaccagagcctattctcaggcccagaacctgctggtgaaatgacttgtgtcttcatctttctttgttacgtccctgaacacacccgaggatctcttccactctgtcgatatgatgggacatgcttctttaatcttctgtttaaattcctgctatgctcaaacaactaaataacaaaacccactaaaatagaaatgctaacatcaaagtttattatgtgtattttaaagttatcagctgaatagcggttgaggaaaccaccattgggttaaatgtgaggctaaaatcaagtcatttttctaaaaagcaacgacagctactatctattgatatgcactgttgtcaggcacttggacatgcactttgtagaaaaggcattatctcatttaaatcatgcgaccaccctatgatgtaggtactcattatcattctcactcgacagtaaagaaactaaaactaggaacgctaagagagttgccaaatatgtcacagccaatcatttgaagagccaggattcgaacccagttctttctgactccacagtctgggttcttcttcctaagctgtgctgacaaaaatacccaggggagaacacaggaatgggatgagagaatgtgtttgttaaattgttgtagacattctgcaacagccttttcaaataagacttaagtaaacaaaggaggtggagagggaattttgtaaaataatctactgtgttgcccagggctaatttttacatttctacagtgctaatgatgttatctgtttttcttgaaagtcaaagagaagaatggaattgaagacagcttagatttagcatgagcagctgggtaggtgttaatgaatatacaaaaaaaaaatgtttaaaataggtgatttcagtttggttcatcctgtgtttaagatgcttctgggacacctgtcaggcagtgtggtgggcctagagctcaggatggaaagtccttgatcgggagtcacagcacttgagttctaaactctgccatgtactaactgtgggatctgggaagctacttaatcttgctgtttctcaggtttttcatcaccaaaatatggatgataataattcctacttcatgtggtgctatatggattaaatatagcaatatgtgtgacatgcttaaacagtacctgggataaaaagtgcagttcttctgtttatatttgggtctggcatctgtgagagtgccctggggactcaagatatagactggcagaaacagctgcctgttacaggttaaaaaattgtgcctccctcacaagatatgctgaagtcctaacccccagttccttagaatgtgaccttatgtggaaatagaggttttgcagatttaatcaagttaagatgaggtcattagggtgagcctaataaaatgactggtgtccttacacaaaggagaaatttggacatagacacacacagagggaagatgatatggaaacacagagggagaactccatgtgaagacaggcagaggttggactgatgcaactgcaagcaatggaacattcaattgctggacagcaccagaagctagaagagccaaggacagattttatccacagtctcggatggagcaaggccttgctgataccttgatttcagactttgatcctccagaactatgagacgatgaatttctgttgtttctaagccacacattttgtggtacttggttacggcagccctaggaaaataatacagcatgcatgttatagttcaaacatgagagcaaataagaatgcccaaagatacatatggagagaggagaggggtagaccaaggatgaaactctggggatagcaacatttaaagagaagacaaagaaagaaaacccaggcagggagaaacctttatgtggaacaagccattgcatttctaaaacatgatgagcacacacaatgttgtcatggaataacaggaggcaacaacaacaaaagaaaacaaagaacaataacgatcattatccaaaaacaagatgattacttgagaatggtttcatccagagaaataaatcagtgtgtcagaatgacaaagctatgtttagagcctaacaaaaataatttagtcatgtatttttaaataaaatacacagaattgtagattctcaaacaagtagaggacaggcactctttcttgccatttttgaatctttcatagaggattatacaattcatataagtaatttttgacaattgattaattaataaatgaatgaagtaaagcataacatgagttaggatgatggctgcattaaaaatgaaaactattcaaagtaaataggtaaaaagtatgcagagagggctcttggttctagtaaaatagagaggttactataaaaggacctgagaaacattccttttgcaaaacacctggaattgctgcatggagtttaacatccttttaaatgcacagctgaactgggaagaaaggcaatgaactccttagggactaaaataaggaaaaaagtgagaatagagcagagcagcacattcttatgttgacacctggttgtcctaggttgctataatgcagagatttgggttttaaaggtcaactaggggcaaggaatgaaatcttgagcttccacaaagcagagaattggaactgagcctgtcattacccgagtccccaccccatacacacaacagtgtgtgccaggaactctaaggctgagaaattaatacagaaaaatggtcatgggctagtgataatctgggaaacctggcagaagtaaatacgaaatcttcatggagagacatgtcttcaacctacgctgtacagaattcctgcagatagagacccgctaaagatgactctgccacccgcaaattacaaaaaaatagctgaagagagatctcccccaaccaagatttaacagaaacaatgaacatgattaagcagaaggttaaataattaaagtattggataaagagtataaaataaataaactttttaaatattaaggaagaacataaaagaaggagttaaaaagagagtttgttgctaattgaacctcacttcagataataacaaaagatttaatttaaaaaatggatcctagaagaagggagtgagatacaggaaggaaatgggagcaatgaaattgattaaggtgagggtagatctagaaagaaatggctgtaaaatgacaaccacagcctccctaagtagggagtagaaaattcagtggagtaaaaatatgagggaacattgtcatgtaaaatcagagatggatgattcaagtataagctttctaaattactggtaattaaacttagattttgtttaaagattaacaggaaagagaactagaatgtcaaagagcaaaaccaatacagaaacaaagaaaaaaaagtgaatgaagaaaagtagatcaatctgattagacacttggcaaggagaaatagagaatggactaagaaagtttaacataaagcacaaaataagatggtaaaaatcagatagatcagtgataataagtgtagatagaccaaatttgccattaaagacagagagtgatagactagactaaaaaatactccacaatcagttatgggttgtttacaaaaaaatcttgcacaaacaaagattgagagttgacagaataagatacgctagtgaaaattgaatttttaaaaagctgacaaaaatagaaatagaaagcagactaaatatactttcaggcagaaagcataactggagataattgagggtcattacatagtgaaaaaaggctaaattcatgacaaatatataataatgataaacttacatgtacctaataacatagccttgaaatatgtaatgaactgcaaaaagaaatagtcaagtccaatttagtgagatattttaatttgcatttctcagtaattgataggtcagtgacattaaaattaaatacaccttaccaagagttttttttctagaactctgtactcccaaattagagaatatgcatttcttaagcaatcaaggaacatttataaaaactgaccatgcactaggccgccaaaagagtaacaaaccggaactttttaaaaagctaatttcagctgggcatggtggctcacgcctgcaatcccagcactttgggaggccgaggtgggtggatcacctaaggtcaggagttccagatcagcctggacaacatggtgaaaccccatctctattaaaaatacaaaaattagccacgatggtggtgggtgcctgtaatcccacctattcgggaggctgaggcagttgaacctgggaggcagaggttgcagtgagcccagatcatgccactgctctccagcctaggtgacagagcgagacactatctcaaaaaaataaaataaaataaaatgttaatttcatacagactctattcactggccaacgtgcaataaaattagaaatcaataccaaaacaataaatgaactctacatataagttagaaatttaaaaggctcagaaacagtcttgaggtaggctctttatttgagatcaaatttccatttgtgatggagtgaatcattgctcaaatttaagccagttctctctattgggcctgctttataaatgtaacttctgtcctcctgaggatgcaagatgttaaatcttatttttgcaggcttatgagtgtcttggacagcagattggctgacttgcccagggcctggatttataaacaaacacctcactaggcttgtgatatggcttagaggtacattttagtttttattttttgatgtttttttcataaccaagagtaatttttttcttttgggaagccaatattttacgttgatattatttaagaaaaataacattcaggactttcattatcaccagtttggcttttatttaatcttactttattcatttctctagaggggcctctgaaagaagatgtttgcctgtgtgaggcattttgtttcacaaaggcacagtttgtctttggcgatgcagtgcccctttgcctgatttaaatatctactcaatattttcctggcaacaggggaactctactaggtcagaatcctgtttcatggaaatattttttttaaatgtcagccttcctccctccctcccactgcttatacccccactcccactccacatacagagtacattaacagtacaactccagaactctgtgtgtaatggtttacttttatttgttttttaaattccaatttaccaaagtagatttcataataaccatgtaacttaagatacaaataagaggcttcagagagtgatggcttctgtttagcctgtgccatgacagtttaccattttggtgtccatgacatgtagaatgatgacacagatgttttcaaaacaattggaatggaaggctgaaaatgaacaacttatcttcaatggcttatgattcatctgacagaagcatctccaaaagtttcttaaaataaaattataaattggacttttgtgtcttaaggaggaggctgcccctgtgataacagattttgttcttattccattttagcagagtttgcaatgcaaaatcgagtgtgtggatgcattctttttttgcagtatgttattgttggcaaagtgctttcacatccattatctcatttacttttctattcccctaacatttcatttaattacccacagaaaaatataaaacaaattccagagaggttgacgtttacgtccagtaaatggttgaataagaatcccaatgtgggtatttggattcccaataaagccttttattttcatcaccaagttttctgtgattggtgttatttaagatttttaaaaatttcttagaaattttcaattactctgaaatctctaaaaatgaaaatccaaccttgttagcaagactcaaggaccttgttgatctgagcccagctttcatccccatcctcgtatgttgctgtgctctctctgaaatcctccactgcagccacaccaaatttctccctttttcttaaacatgtcagatatttcatgcccatgtcggatgaggctgggctaagtggttcccctaaaccaaagagcttctctctacttctgtcaaaatcctcgctgttaatccaagttcactctcctggtaagcctttcccatttttcctggttggtgctacctctctgcacttccacttcctccttggatcacggagtctttttttttttttttttttttttatgagacggagtttcgctcttgttgcccaggcttctggagtgcaatggcgcaatctcggcttatcgcaacctctgcctcctggattcaagcaattctcctgcctcagcctcctgagtagctggcattacaggcatgcgccaccacacccggctaattttgtatttttagtagagatgaggtttctccatgttggtcaggctggtctcaaacccttcacctcaggtgatccacccgccttggcctcccaaagtgctgggattacaggtatgagccaccacgcccagcctgatcacagagacttagttctgctttgtggttgtggtcataagctgcctctctcagtgggtccttagtgtttctcttggtcttggacactttggaatctccatagtactggtgcatatagccatatgcataatgcttaatgacttttacttgaattaaatctatcttagttcttatcctattcgagtcatttctcaggtcctgaaattctccacattgttttacagaagagaaaaatgaggtccagttataaaattaaatgacaggttccaaacacactgctacctggagacaagaggtgttcctacctagggcagaaggtcgcacctaaacataggcaaaggtgatgcctcggctggggcttatgctgtagtcccctccccttcctcctacacatgtgtggttggggtcaagaaaggaggaagacaggcctgctgaatctcataggaactcatgagcccctttctttgattcctggtgtgacagaagccataaagctttgctgagataccatggagtgtggaggagactagagagactactggggctcttcatggagttaaaaggttaggaccaaaacctgacagcctggacccagtgcactgacctgaactctaaaaaccatcatctacagctgcagcatcattgcctggccaaagtagtggaggtggagttcagtgtgagcagagactaggtcttcagtcttgttatcacttcactgcccagagatttgttaagtgtttcctctgtgagaacatctaggacagatgcccaaaggaggtcgtgagtgtaggtgagggcacaagaaggtgctagtccttcacgctgtgggtggcatgtggcacaggcatggaggcattggctcaggaaatgtagggtggagggggaatggttgggaatgacacccatggaacaaaggactgtgtgcttcatgctggggaatctgggtttttcccctgcaaactgtcctctattgcaacacctccggagtgggtctgggagagtggtgcgagtgctcaggagaaaaggaatgccctcatttcttctaccgagtggccatgttttgttttcaccattgtttgcttagaaatttatagggcagaggtgtggagatcaaatgctaaaaggatgtgggagtgttctgacttcatgtaattttactcttttcagatgaagcagtctatattaacaaaatataaaagaaactgaaacttaactttttatactcttgacagcaattttataaaaatactttcacatatatactatatataggtagtatatatagcatatatgtaagtatatattctatatatattatatattttattattttataaaaatatttttataaagtattttagtagttttattttttatactttttataaaatgctttgcatagtttcatttttttaacttttctttttgtttttttacttttattttttatacttttaaaaaatactttttataaagtatttaaagtattttataaaaatactttcacatatattatatataggtgatatatagtatacatataatatacattaaatatatatataccttttgtaagaccatgttttggctttgaaaaatagagaatacattttgtataaataatttgtaacccaagtattccatatttattatagaaaaatgagaaaatatagtttagtgaaaatgacaaatctaaaattccccatctcctttccctcagtgacaacagttcacgttttgctgtatctccctctgaatttctttctgtgcagatatttatatatctttgcaaaatacaatgatatcataataatattttgaaactttaaaatgcaatctactttgaacattttatcatatcaataaatatatttcaacagtgtaatttttagtctctaaatatcacaggaacattcctaaatgcattacaaaactgcttctcttttgctggacatttagggtgtttccaatgttttgctattataaacaacactacaaagaacatccttgacaataaatcattgcgcacatcctctattatttccttaggataaatttctagaaatggaatttttaagccagggaatctgcacatatttaaagacgtttgattgtattgttgtgttgtattgttgtattattgtgttgttcatcagaaaggctgtagtaatttatactcatattggcagaactccggaactccagaacagccttttaccaactcaaagtgagacttgtagagataagtacaatacaggttgaggactttgtctctggggtcttgcacctgattcccttaaaggaaaactgaatgggccaggataacccttgtcttgatgagcgaaaccaattaaggggcacaccaagggataatagagagattaaacttctcctttcaccattttaacacgaacctagtggctttcagacaatatgtttatgtgtcattttgagaatatccggttccaccatttagagaagaaagtctgttcccagaatgaacttatttctaggaagtacagttgttacattaaaaaaaaaatagtcctcccattttgttaaaagcaaagcaaaacaaaacaaaaaggtgggtttcgctaacatcaaaggatggaacttacagggaatgacttgggtaggatggggggtcttctctctgtgagggctgaacaaactatcctctgcacagaaccaaaggtaaagagaacttgccctaagacctcagtatgatccatttttgtagaaagaggaattctgacatgtcatgaaaaaagaaacattttatctctgaaagccaaattctcagccaatgacgaagagtcatctgaacttcagtgaactggataacattaaccttccatatctacattcagttttcacagactaacaacatgtttccaagtgtttggatgacaaataaatatgtacacttttctgtcatcactgccgttggagtttttgttgatattctctctgtagcaaaaccagagttccctttagttttcaggttctgcgcactgatgatttttttttttttttttttttgagatggagtctcgctctgtcgctcaggctggagtgcagtggcctgatcttggctcactgcaagctccacctcccgggttcatgccattttcctgcctcagcctcccaagtagctgagactacaggcacccgccaccatgcccgactaatttttttttgtatttttagtagagacaaggtttcactgtgttagccaggatggtctcgatctcctgacctcgtgatccacccgcctcggcctcccaaagtgctgggattacaggcgtgagccaccgcgcctggcctgtgcactgatttttaagtgagaatgtgggtgtttaaatattggtagacatccaatgctagctggtcaagttgaagatggatgtgccctgtaactcagaaatcccgtatctaggtactcagccaaggccagcgtgtccccaggtttcatgtgaaaatgtagattctggttcagcaggtctgggtggggcctgagactcagcatttctaattagctcccaggtgatgctgatgcttccgcggttggaggaccacgcttggaatagtgaggcccagggaagatgatctgaaccttggctgctcattagagtcacctgggggagctgttatcaactgtgatgcccaactgccctccagcctaattgaagcagactctcccaggggagaccaggcatcactagtttttcagtctccccagatgattccagaaaggaccccaggccctggaccaatgcggactcattcacgcgtatgcatggagatggacaggggacattcactaaataaattgagattattcacatgggggaggcctaagagctgcttaatgattgagtatatctttgtgaattcatttggctacatcttgaaattataacattgagtgccaatagcaaatcatatatcgtttatgttaactttaaaaacacaaaacaatatatgtagtttaaatggtaaaaatattaaaatatgtataggagtgatacacgtactaacttcaggatagtggttacttctaaccactagctactaacttcaggataggtgtttgcagtaggagaatggaatgggaaaggtagattctactggacctgcaataatttctttcttctatgtagctgaagggaagaaagggagggagaagcgaaggaaggaagagggaaggagggagaggaagagaactctgggtgtatgactggctggctgtttctcactattattacggtttacctctgcaaacctaaaaatgtattgcagcagcatactacatgctccattcttgagtagcctaaaatattagtgggaccaaacaaacaaggatctgaaagtattagctaaaatgtgactcccacacctgactttcattcaagaggactggaacatcctggcatgcctgacccctaagggcttgtcccgggaactgagatcagtgctcttagtttacaggtgggacagacacagaaaggagaaatagctgcccacagcaaggtccagaaagtggagaaatggtgagattagaactcagggctccaactccctgcccatgtgtctctcagggctcggggcccaagggagcagccgccccatttaccacactctgaagaccctaccactgagggtgtttaccacaggacatcccggctggcgtttctgttggagatcacctgctccttctcccccgggccctgctctccctgtcccataggtagcactggagtgtgacgacgtggcctgcatcctgtggggtgtttgtgctcgccatggccagctgtggaatgcaaaaaccactcaccaaccccactcctgcaggtgctggttaattgcaaaaccaaacaccctgcaggaaaagtctggaactgacagctctctatgaggaacgctggctcataggaggggctagagtcttggtgtatctatatttcatttccgattctgtggtcagtatttttcagtattttgcataaatactgttattattatttttgttgttgttgtgatctgtaattagcaccttcctgatatgtgtggcttactcttatttccatataaatatatataaatataccagtagttttctaaggaaaagaagtttcctcttattcttactcattttaaaataaataaataaaattgaacataaatgagaaaaaagaatttttaaaatcttatgcctacaggaaactttagattgagcaaaaacaagggcatgtgatgtgaataatcccaagattccagaactattcactttaaagacaatgatctatggatgtgaggcagcttttgtctttcccccaaaatgttctcctgggtagccagggaggctggctggaggctgtgcttgtggaaggcagctggtcagaaatcccacgtggatggggatctaccccaagatgaagatccctggcttcaggaattgactgaatgtgttcccacccctttcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagagtaagctcccccttcctccaaggatagatggctgtggctatggttcttatgacctgagcttcagagggttcaaccaggtgtgtcgacagcatcctcctgccctcgcccagttcccactggggatccgagggagccacatgcttggtatgtgatgacttaggggagcaacaccctggccacatcacctgatgagaagtagtcagcgctctcaggagaagccaaaattcacttcaacactcagctgcctcctccagggtcctgcgaccaagaagatggaatgtcaaaggggaaaggaagcgttaactggtcacacattagttaagtctccatgataccccgaatcgaaatagaatcattaaggcttctctttcgtaggaattagggggattattctccctaaagctacatgaagccccactttatattctaacctgagcacagaacaagggaagttttcactttgtatcatgtgattcggcttaacctgacagaaagggatggcatgttggcatgaatccagaatgtttgctgcatgctttaatttctacaacgtccagcatggtgagaaggaagtagtgtgacagacagtgaggtggataaattctcctccattgctttgcctggcatcccaaccacttcttccctgaattaaagacgggcccccatgtaggttttaacatgctaacaagtagcaggttgctggaaatagttataagcttcccatgatgttagtgtgggagtgggggaacggttttctttctttctttttctttctttttttttttttttttttgtaagaaaggtaattctctttctctctctctcttttttttttcattttgatgtcgctttttgttttgttttgtagctcctcttccacatttgacttcagatgatgttgataaagccttacaaaactctccacggttaatgcatgctagaaacacaggtaatgctggccccgcccctgcctcccagcaagagcgtagggtcttacgtacaggttgcatgctttcatgggaaaccagtcagcgcgtgccaggaagacagaacgcaggtagatgattcagaatactttcggatacttaggaatgtaccacagcctaaaggaaggtgaagccctttggttttctgagcgcttcccaagcaccccactttgattatcaaagggttcctttttaaccaggagacgtgcagaatttgcctttagccataacttagctcacatttgccggattacagtcttcttctgttggtcccaatatattcgctgtgctgactctgtagacactaaaagcatgttcgatataaaagggcccttagcaacctcctttaattttttccatttttattcttaaagaaatatttgctaggataagttggaattttctttttcctttccaataaacttttaggctatttgatttgttttcctacagactttgtatgtttgcaaaaggcaggagggaatttctgtaacattttgagagcttttgttcagagggaacctctgctataattttggagaatatgaaattagtcactaaccaaatgcctgttttctatctctaaccgttgcctctacatttgacttagttatgtatttattttgcctgagcctaagtagggtttaacaccgtgcctcatcctggctaaccttcctccctcgccccccgctcacagcagaggctgggttttctgtggatgaatgtgttcctggttcacatccatctgctccttcctgatggagagagttccggaagcatggccaccggctgctcaccccactctgttagctgcagggaccctccacaatcactcgggctagggagggagacgggaagtgccagaaagccttgcaagtcagccagttaactcacgatcagccctcacatagaaatacgcaattttcccaatatttaccattttattttaaaatataaaatgtgagtgagtcccggtttgagtattacaatgaaattgctcatttatcatggtcttctatattcaacacattgtctttttaatctgaagttttaaaaaacctgcttcgagttggtagtacactttttcaataattttggttgcacacatcagcctattagtgaccttgtggccagaaataacagataacttagaggaagttacttccccttcttaggaaacacctttgagctatgcacattttctgataatttcacatttatttatgagttctttaaccattgagtgaaagtttcaaaaaagctccaaatatattaaattttgctattgttaaacacggaagaaaccaatgaacaagacaacaaattccaaatggactgaactatgaaaagggaattttctcagctaacagcatgagttttggtcaaaagagagagagggaaaatgcatttgaatagagatgtggattaattattaataaaatccatatactcttaggctaaatacttataattgcttgatactactttccaaaagctctgtaaaatatattatgggtttttatacaagttgaaaaataaaacatgtaccatataattttttaataaaacgagattgcccagtgggaagtgggattgagggggacacagatagggcttcatcaagaagttataaaatcaaaacacaaaacgctttatagcaaacggggcacaggagtacaccaaggctccaagtttcacttccatcttgagaatctgacaggtgcacctgtctgtttctccggagctctgttaaggcaggtttgaggaggtctcttccctttgttgtcatagggaaaagtagatttggcgctgatgttgagatcgacaaccacaacaaaagaccttcacatgtttgtctttccttttgtctgcagggggtgcagcttttattttcccaaatacttcagtatatcctgaagctacgcaaagaattacaactaggccaggtacgaaaacacccctgtgtgatctcttcattgagagacatcccagatgtcctgctgagatccgtgccctaagtcacgtgatacaaagagagctgatcccggagctgaagccagtcccagacagtcttattctgcctctgttgatttggagactaaatccactcaaaccatttcattcaaagaccacactaaaggaattaagagcagattagccctttaactagcttttcagaaagacagatgggcaaagaaggcatcctggatgcctggcagttaggaataggccgacttttgaactaacagaaggatctgtccctcctcgggggaagagcacaaaacaaggacactccccagattcacagtgaccgattatcagtatgtcacaagaagccagtcttgcagagcagaagcatgcaaccagtagtatttacatctgaatcttactgcctgtcctccaaatgatttaattaggtaataaatttacatgccattcatgcaaaaataaacatctatcaagtgcccattagtgccaagcgtggtgttagactctgggaatatatagatgaaccaggcttcagtaagcttcctgtcttcagaaagtttacttcttcattcagcttggtttgttcatttgctgagtgcctcctctgtgccagccacggatggtatgatggtgaacaaaccgaaatgttttgcctccagttctagatgtttcagtagagtgacctagagccagagagacacatatgtacacataaatgttttccctaatgtgatagattttatggtagaggaaccacttctagcaatacagggcgtaggagcaggggtggggaggaactcaatcccccatgaaaggcataaagatgctttccagaggaatggccacatggcaaaggggaattagatgtttgccagacgaataatgagcagggagagagggcatttcccagaagggtatagcttgcctttagcatttgtcctctccctgggacttacatcagcccgataagctaggtatcattgtaccagcctcacagctgatgacattgtgttcagggtggtgggatggtttctccatattcatacatgcttccagaattcatgttaaactctatcacatatccggaatacacaagtctcagttcgaactggttcaagatctaggcttggcaactactctttctttctaatgagaaagactgggggcccagggagctaaagagaatgaatgaggaagcttctcaggctgttcaaatactgacactgccctggttactgcctagtgacttcaggctggcaattttctcttctctaacgtcagagaaaaagtttactgtcttgctcctgggaagcatgatggaaaggcttagcagctaaggggtactaagaggtagtaagtcatctctgtcatgtaaaagatttcacaggccattgaaacatgggcaagacccagtgcctagagtctgcaagattggtcctaaagacatccaccacgtgtattgcgagtggaaaatagaaattcatgtttgactcaagctttagagattttgtaattctgtgagcatttaaaaaatatttccatataaactaaaaaaataaaaactatttccaaaacatttggctagggttttaaaaatttttttactttttaattttgtatttgtttgtttatgttaagacatctcataggtgcctctgactgagttgcaaagccaggggttgtgagctagtattataaactgtgttaaaagatcacaacactggccaaattcattggcacaatctctctgtcagacaagccagctgactgatgctacctggttaagacagtgggtcctggagctgctttgttttcacattttaggatatggtggatttggaaggtatggcccatccaggtggatggagaagagggtgactgtgaggatgttggttgggactccctctctgcccaacccagggaaggcaagggtggcaaactcagacacctcccatgccgctctgatggtggtcttccatgggcccataatttgagcgtgacctgggagagagcacacttccacagctccactactagtcaagtatgttttcgcgactcagtttgtacctgaaataacctgttttgaccactgctactgtgattatgagaaccaatacaaatattggtatctgacctgtaaagaatttaaagcagactgaacaagccagaggactatttactgtaggccctattcagggacttgaacttggagataagaactagttatacacctcgggtcatccattgctaagcgatcaaccttaaaggactgctcctgtggagataaaagctgtgaacctgcaactggagaatgaacgtcgtgatggctgagggggaagagcttttgcatcactaactttcagagctgaacgagctccagagggaggtcactgggaatctgacgatatccctgtggtcagtgggtacctgactactttcagaaaggtgattgttgactgtttctttgaaggtccttggggatacagacccaaatccctgtctcctccactcttggtttgctgtgccatgatcttcatttccataccctttgtctaatcccacatccgagggaaccgaactctggtcagcgttattgtgctgaccatgaagcaagccaggctcctaggtaacaactctacttagaccagaatctgtctcttctctgcatggtggccgtttcattatagagtccctgatagaggagacagtggtgttcagggtttactggttaaattagacagcattccgcaccctttctgcagagactcctacacatgtgtgttgtcctgctgcatccaccttcccagcacttcctcaccacccttccctccttcccttcccactgtgagtcacccatccctgggttactgccccaacctaccttttcttttcttttatcttcttttctcttcttttttttttttttttttttttgagatggagtctcactctgttgccaggctgaagtgcagtggtgcaatctcggctcaccacaacctctgcctcccgagttcaagtgattcttctgcctcagcctcccgagtagctggggctacaggcgcatgccatcatgcccagctaatttttgtatttttagtagagatagggtttcaccatattggtcaggatggtcttgatctcttgacctcgtgatccgcccacctctgcctcccaaagtgctgggattacaggcgtgaaccaccatgcccagcccccaatctaccttttcttctgttcatggcccaccttcccaagtggatcatttattccagagccccctgactgcttccctgtcaggtcagtctcgctgctgctgtgtcagttcagtctccctgcacaattggccgaggccgttcactgacctcacaggggaccacatgtgaacatgccctgccaccaccactacctgccatttgtccaaacctcatcccttttccttgcatgcccgtacctagtattttcccacgttttcctgattcaagatttaccttctttcacaacccctttgttgaattagcattgagacagtcttctctactctcataaagtatcaacccataggcatatcattttacattctgtggttttatgattttttaaatatatatatattttattatactttattttatgatgtttcacgtgtttctcacgttgttgcagttactacgaccagaatccctttctgtacctcctctacaaacacccttcttttttgctgaatccacttcttttggagccatagccctttgaggtctcaggggaaaaagtggcaaaaacagatccacagaatcttgcaagcccctattaactacacagtgcaccaccctgcctgtcctcttaggagcaggtcatgcaaaagctcagttctatcccaaggatgatgttctgcaaccccatcctttcctcttccatccccatgacaacccatatattatgatatgcctctggggtgttatcaaaagagattagagagttaagcctgcaaatgcagcctttgcttctactttgaagctgctgctcttcaggggtttcttggaatcttaaattattcctccattggagctcacagcctagtgcttttcagcacagctaggcatagtgagacaatacaactactgcatagcatctctcagttaggtgttatgtaaagcctgtatcttagcaaatggctaaaattgcattctttgcttccgcttagttcttatataaccacagggatatgcaaacctaggcaagaagggaatgcaaaatgtttccaaaactccatgctcaaactttgatgtagaattttaagaagatctggaggaaaatagagagcaacttaattatgttaaggttgactcaaactttttttttcatttcacagacacttctagattggttcttagcagcagctcttgctcttcctaatttgtgttccccattagcatctaatttcaagagcaggcaaatctcatctgttcccatccagcccagccagggaacctccagagttgctttgcagatatggtgtggatcctgcagaatgaggatgagctcttccacgatccacattcttgccctttaaaaaataaagcgggtaggcagcggggtggcggtgtggggtgtgtggggcaagagctagagcgttcctcctcagtgagtttgatgaagggagaatgtaaaacttggctgaacttagccctccaggaaagggtagccagaatgttgtattaatttagtgatgtcttcaaaagggtgtggtggaggaggagtctcattcagaatgagaagctgatcccagctcccaggaaatcgacacagttgctggtgtgtagtggtcagcactagccgagtccctatttgtagcttcatgctgttttttatactgttgtgatgtaatgtacatctgtgttcacccaagctgcctatgcaatgacttctataaagctcagtttttaaacacagtctcttacagataaaacaacagaaccagtgccagaaagcagccttcccttacatgggcacttctgccaagcatatgagttcattgccttgaagatcaaagtcaaagagaaatggagagggtgttgaaatgatcagcgaaaattaaatgtaaaatatattcttattggaagtctgatgctctattatcaataaaggacacatagcaaagatacatagaggagtgatttttcaagcagtcaagagcagaactacgaaggttttgagatggtgtagctgccaaagaagtcacccctggctgtcccccatctcagtgagcctgagttgaatgtttcccaatgtcatatcccacagggggatacttagtgcccacagcatgtgatcggtagccgataaggaagcattggaccagaatgtcatggaagaaaacaaaagcccacttatcttccgcggcaatatgtttatgaacatgtgaatcattgttcatataactgtctcaaatacttggctgaaaagtagactgtttggtgttaagtttcgacttattttcgagggaggatgggatatggttatacaccatatgaaggattttgtgaataaagagtttcaaaatattttgggaatagtagttcggcatttattttttttcccagtcacatttcatgagcaacaattttatgtttaaggtagtatctgactaacctactgatgctgtctattcattccattagcatacttatgccatgggtaaaagcaatccatctagaactctttcaaccattttttagtttgtctttgcacactctagatagcatttctgaaatcatctgcaggaacagagttcctgaaaagagcaatggtctagagcaggctttctcagacttcagtgtgcaccagagtcacccaggatcttgttaaaatgctgattctgaggccaggcgcggtggctcacgcctgtaatcccagcactttaggaggctgaggcgggcggatcacggggtcaggagagcgagaccatcctggctaacagcatgagaccctgtctctactaaaaatacgaaaaattagccaggcatggtggcaggcacctgtagtcccagctactcaggaggctgaggcaggagaatggtgtgaacctgggaggtggagcttgcagtgagccgagatcgcgccactgcactccagcctgggggacagagcgagactccacctccaaaaaaaaaaaaagataataaacaaaatgctgattttgatgcagtaggtctggggtaagattctgcatttctagcaagctaccaggtattgttgatgttgctggtccacagaccaccctttgagaaacagagatctagaacatatttctgtatttctgtattatcttgctttttttcatttggtaaatagaaggccttagttaatgtgcttttctgctcctaaattaggttagatgtggctaggattgccttgtgagtaggtttttctttctgagacaatttgcaaattgaaactctggctgtccagtttattttagacaaaatgcaactgactgagaacccatgtgcagagtgttcccagagacttaagttgaagttcagttgtaaattgttaggggctgcagatataattcctatgtgtaaccccaacacaagagatgtgaaaatctgaggatctgggtgggaaaagatttacgtccaaaaatgcaaaaatgccagctgagagagaggagtaacatcagtttaaaaagaaaaattatctaattctccaaagctctgaagggtaggatttcatagaccacactagtagcaaagatgcttgcagccaaacagaccaaatacattaaggagattctgtgttgactttcacgttgcgcatcatttctattctctttgggatatgaaaataggaagagacacatcttctgcaacacagtcaagctctttgaagattgacccatcaaattgctggttttaaacaaaattaaaatatttgtttaaagagaagcttaaaaacaattgcattgtcctaccctccaagtgaaattttgtacacatctcctggtgtctggcagcaaagtacctgctgagatatttggccatggccttcacttggcccagaatgacacatgacattgaactgagaccaagcaatccaagaagacataattttgaaacagttatgtaataagattgcatgtagaaatagccttagctatgcactcttagcaagagtattataataaggtttctgtaatatatttttgaaacaaacttgaaatgacatagagctttgataatcattaatagaactcacactgaggatgcagaagtatagttattaaatttgcatatgaaaagtaaatgaaggtttataggacaagtgatacgactttataaatacaaagaaatgtttggcatatgcttaagctcagaaggtcatcattaatgggctgtgggagcaatactatttcagtcctgtaattcatttcatgcaggtcattttagagaaattctaaatttatttagaacattagaaatgggagacatttgcctatgaaaatcactagatcagataagactgatttaatataaattgatgagattataaagggaaaatgggagttggctaagagaggcagctggcaaataaaaagataaggcagcgatcacttcccaggagatgcaagaagaaaaagaagctgaatgtcatttgattgatttaggaacagacctcaaacaaaaatgggctggttcatccaagttgtagactctgctttggatgagtcatgaagataataaagagacagatgtagatcagtcccagtggaagcaggatgaactagattgtaagaaacttttattggggtcttgacttatggttgtaggaaattagaagagttggaaagctctgggagaatctgccaatggaagttttcagacaaacgggtgagaattttagaccactataatatatgaaattttaatttgtaaataaaactcaaatctagtgggatatttctttggattaccagatttttttgcacaaagtttattctaataaatacaaaatcaaataaaaaaccaaagcatctcttataaaaattacatgattgatcttttagtcaatttatttgtctttacagatttaccatatgagccccccaggagatcagcctggaccggtcacggccaccccacgccccagtcgaaaggtacagtgttggctcccatgaccctgagtttcatgtcacaggcagtggatgactgttgatggagtatataataatttctgtggttaatctgtgattttgcaacatgtgatgggtttgttccattgacgacaagagtacaattgatctttcactgcagtgattctttctccatttgggtcatcaggactttcataacaaaaataaaggaatgatgtagtgtatgtcaaccttcacaaatgcatgtttcatgggatgtttgagtacacattaaataatcggtgttttcctgaatcttggccatgcttaaaagtatccctggctttactttatttgactggtggtttccctttatgtgtttatcttagactatgatttattgtaatctgtttggtaagccattccaaattcttttttttttttacttttggaaaaagtgggaggtatccattttttaaataattggaaatgtcctctttttttgttacagtgtttacatttgatttcatcagaaaggaaaatttttccttaccgtgagatgcttctgagttagactattatgttaataactaaattaactgatagaatgattatgcaacaacatcaaagactagtgaccaaatctgttatagctaattgccttttgtatttctggattttcagctgctcaaccatctccttccacagtgcccaaaactgaagaccagcgtcctcagttaggtatgtttcaggggccgtctggataaccataagagaagattcaggctcagcagcacatttctaaaatgcttcactttttaatggaaattaacatgattgtttgcctcttttcgacagctccatacataagatagggcccaagtcatcagcctactcatgcgaggtgacttgagatggtgctaaaacacgtccccaactatgcaataaatagggaaaaaaattctacgtgcacacaggctgcttctttgtgatccattaattttttagattttactttccatgcctaaacaacacagcctgcacggccctggattgatggggcttggcacatgtttgccctctttatatcattggttggtgtgagccttgagctatatgtcaggatcctggggttgaatccaagccctgccaccaattaggagtcccctagcaagacatctgagatgccgtgtgacatcttctctcatagaggaggtggaggcagttgatttggagttggaggacattttcggctctgaaatctgaaaaaacaattaagtcaggcattatgtctgaagtcacatcatactatgttacaactatgtctaggatttgactttgtttctttttgctgtagatccttatcagattcttggaccaacaagtagccgccttgcaaatccaggtgagaaactgctgatgattttcttcttacaaaattactttttggcagtggttattttgaaaagtaaattggtattggtgagaaattccttcaactgaacagattttagttttaggtctcactgaattatttgccttaatggaaagatgggttgggttataaattaagatttcagcttcagcaaagaacattataacctaatccaagctgtaatagttttctagggctgctgtaacaaagtaccacggattaggtggcttaaacaacaacagtttattgtctcgcagttctggaggctggaagtctgaaatcagagtgtcatggtggcaggtttcgttccttctcagggctgtgagggagggatctgtcctgggggctctccctggcttacagatagccatcatctcctcgtgtctcttctcatcatcatctctctgtgtgtgtcagtctctgtgtccaaatgcctcttttgcataaggacattggtcaggttggaatacctaccccataaccttactataacttgattacctcatttaggatcttatctccaaaaaaggtcacattcttagatactgcgggttaagatttcaacatagggaattgagggaacacaattcaacccattatacaagcagataaaataactagtattttttaaaagagagccttgatacaaccacaagacttcaaattcaggctcatcttcgatggtctgtttctgaacttcgatgctagaagaaagtgcagattcttaattagcccatttgtaaccagtgcattgccaaggtttgtcacctgtcctagtgtttcagtgccaaccacatagttttatttgtttgtattcagatcagaaccagctgtgctggcaccagcttcagaaattcatagcctatgctgcatattcccaactgcaaattcaaatgccaagatgttacaggcatattgcaagcacaagatggaatgtgtatttcctaaacgttgaggccaaaataaggttcgaaatggaataattaagatttaatcagtgtacatccctgcaagagaatctacacattgaaaacacgaaatgttatcattattgaacatctgtatttttgaagttaaattttggttaatgttaatgaattcaatgaattttttttacacagctgaaaatctaaagaaaactagttagcctggggcctagactaggtgctcaataattatttgttgcatacatgaatgccaaggataatgagatatagtcctttagctcagggtgcttttggtccgtggagagatggacacaggtagttacaacattgtcccaaacacagagccacaggccctttttgctcatgctggctttcatctagtagcccaggctcctgaggctgtggtctcttctcagccttctgctcagcttttcatttgcaactctgccatataaccattcaaataaaaataatgactatgttttgagatgattattatcagtcatgcttcaggaagactgatctggcagcaatgttcaggatagattagaaaaaagaaaatgacggaagctgaaacactctgggaatgttaatacaatcatgtgaaataacaatcaaacagctcccatcccgcagaatgccccccatagaatgtctgtggtcccttctgtgtctcataacagccctgggaggttactatctccatcctacagaaaaggaattagaagtccagagaagttaagtaacttttcctgtgtcacacagccaatgataagggaggtcaggttagaaacctgactctgtctgcaaagtctacttttgttttcttgccctactctgccactgactaagtatgaagggaagaggaggtcttacaaaatgcggactgtgagaatagaaagcaaggatttcctttcagggtcataactgcttaggtgcaggcgatgaatctgaggtcaggaaggaagaggaggaaagagtcaagctgcaccaaagaagaccaaactggcctttgcactcacacattggccaaatgaaacatatatgtccatgaccacgttgtcacagcccaaaggtactgcttggcttgtttgtagaatagggcctgagtcacttgctcctaagcaaagtgccagctttcacaagggaacactgcatatgccctgggcccagcagcccggggatgccctttgtagatagagggacctgagctcagagcaaggagaccggaaactcatcacaggcctggggaaggaggactgtgcttcataccattaagactgttcttaatgggcctggagaaaatggcaacatcccatctttgatttgcaggcaagtgactttaagataaagatttatttcatttagtttctgatgaatttgactttctctccatctatctttaggtttgtgtctgttgtgctcatgtgaacttttcccctgaaaccagaatgtcttttatctttgtattaatgacaatgcttcttcctgtttgattctatttttctattctctgataaataaatctttcatcacttaaaaattgctgtctttgctcttcatacaatacaaattccttttcatcattttaagtggaaagattgcatcatatagtatgaatgcacaggatgatgtcagcatcccaacatctctatcccaaatattcacttgatgtgtactttggacatcacttttcctgctgagaacagtgtgtccctgcattctgatatcatggatcggttataagcaacacagctcctttacatcccatcagagcagctgagaatctatctaacatggttcctctaatgaaagagctttggtgggttatgttcagaggcttccttgatgctaactggatactcttcaatggtgcacatgaaaatacatcctgcctcttgcagaacgacagaccaggctagggatgttttcccatttgttaggaggtggcagtgtgcagtcttccagtgggagtcccccagggaggggacaacatggaaaggacctgaggaggctacagaggtgtgcataaaccaggcctgaaagcaagtttgcgcagtgattaagcatggcagcctagagtctggatttcaacccttgccaacgctaagcaaaataagtcagtctacctctctaagctccaatttcgtcacttctccaatggactaatcacatgattcctgtggggattaaataaaccaatacatgtaaagcgtttagaatggtgcatggcacacagtaagctttcagaggatatcagtcagcccaagaatagcaccgtttcaagcttcttcatggttcaataggccaattgaacagtatttctctttctttaggcatttcctggctataggagaggagtgttatctttccttaaactctgattttcagcccaaagaaattctgacaagaccattcaagtactgagttcatccttaccatgatcttgcaagatagtactattaccatcacccccactttacagatgacgatactgaggcagagagagctgcgagagttgccaaacgtcccacaaagggcagaggcaggattcagctgaagcagtggcaactccaaagttggtgctccctaccaccatgctttcctgcccctccagtaagtggtgcctgagcctcactgagcctcggggcagagacttccattcaggacacacctgctggacacacctgctgccttgcagagggtccaggccatgcacacgggatcttctgcaccacccctggcttctagagaaagtggccccaaaccactgccacatggtactggtggggcccctcacggctgtatttactgcccttgttcatcagctgacggctgcagggctttgcaccaggatgctgtttccaccagacacagctgctgactcactctgcagctctctgctttgctctgtggtttgtaaaccgtttagtttttttttcccccttttttgctcagtctgtacccctttgctaccctgtttctctccctttcttttaacaatattaggagattactttcctctgtaaaattaaaggagtgcctctgtcttcttaaaagccacagccgctccctttcacccacagggttctctgtaggtggacaatgctgcttgccactgttttttacctccaaatatgttttattttggtaattaccctaagaaaaaattagttcctccttactgacatcgcaaggatgttattaagagagagtaaaaaaaaaaaatagatctgaagggtttacccaagaaaggtgagtcctaaggtagaggtggtgatgctactcaatgaaagctcttgtctttcaagaacttctctttgtaaatcctggtttggcccatgagtgacccaagccacttttaggctttcctaaaccctaagcattcttgtttggaaatctctattctatattctaaaatgcacctcgtcacacattaaatgttattgttttggaagtaaaataagaatttaaaaattgctcttaaaattttatgactgagaataattcctttaccactgacaattttttaacaaccattgttcatttttgagaattcttgcagtgagaaattttgttctacacactgcaaaatgcagcgaattttgttacaaatattaaatttaacaattaatgagtttgacatgatgttactctttctaccatttacttaaacattcattgattttgcatttccaggtttctttcaaggtttgaaagctgatgaattttgcttacagttctcttatttctatagaccctcccttgaaattctcacagtcctgagccctatgtctttatggctactgggtaaaatagtcaagtgagaaattagctcatccatcctttgggcatagagtttgctgccacaaatttaggtcccctgctttctaactcttcagaaataggagagacatgagatcacttttgtccactgattctgtcctacacacgtttataagagaaatgggtgagggacaaattgctaagaggcaatgccaaggtttgagtagattccaagtgtgatttcggcaggtctgtggagttgctttctctatgggagaaagttgacgctgaatatttattttcaaacaaccgtatgtgtttatattgaagcatctgttagactgttaaatcaaaaatccatgccttttcctattcccaggtcatatacggaattttttcaagttgtaattttttggttacaatatatatactaagaccatatggttttctcataccattctttgtattttctaaatgcatattaataaaatgttggaggcaacaaaacttgattgggaacagtttgtatatgtggttctgaaaaagcaaaggcttccacttcaatgagctacaagctgttaatacatttcaaatgtgttgctagactgaaaatgagcactttccagcatagattcagaaaaagctgacctttctcacagtgctattgtatggataaattcacaaaaatatccatgtccatgtagccaacatgcaaagcagagtttataagttgggtgatatgtacaggaggctagcgaggatttagaagaaaatgaacgtaaaattgatttttacagtatattacttccctgagtagatgtcagttaaagttactttaatcattttatcacatcgattgatattacttacactataataaaaggtaatcttttggtaataagtctaaggcagtgctgtaactggaatttgggaggaaagacccacctcccatctgttcttaagcttctgaaatatgttcagcacagcttagcttctcttggtacggatactgctgtcaatatttacatgctgctgtcttctagggagccataaactatcttcaagtattgtaacatagcagctagaatgatgtgcctagatttttctttgaatttcataaaacaaagctgtatctgtatgatttcaatgaaatcaagaaaattctgactttgtccacccagctaaatgtgatctctttgacaaaggaagagtctcattcagcttcccaaggggacttgcaatcactcattgttggggtttttcttctggaaatgctgcttaacacaattggcgttgcagcacacaggcaaggcactggtttccgttacgatgcgcttgcccaaatactggaactgggtgatctggtttgaaaaagagccagctttttttttttttttcctaaacttcctcattttgagtgggttaattctgttctaggaaaagttttcacagaattgctttctgagcgccagcaaaatgttatgttagaaataatggtgtttacttccattctcgatttttttccataaacttttagaagttcatttcctaaatctaacttttattatcttacttgacctagccaatataaatggcattaagtcattattgccatccacataacagtactttgtgcttcacaaaataggaaaaaaaaatatatagctctttcatcccctaaacaccaggttgatctggctgttcttttaaggacgtcagaaatggatggaagcagcctgaactttgccccatatgaattcgctgcattccatctaggtcttgaatctgttagatcatcgtcctaggtcgggttcccttgatgcagagcttggggtaagcctgcttgtgcaggtgactgattaacggcatgttctcaggagagagagaatgggaagtgctgcaggggcagcgctaaggaagtttctggcctcctccaagcctccttgcagctggacgctgtttcagcccaatcccacgggagccctgaagcctgaatagcgtcatggagttggtctttccttgaggcaagggggccggcccgtggtaccccgttcagtccacccagctgtgggatacctgggggtgggcgaggcggcggctctgttcaggcaagggcagttctctggagaagtgggtggccatggaacgagagcagtccgcacccctgcagctgagggatggacggacaggcctggtgaagggaatgtgggcggcacaccaatagcacctccttccgtcatcacagagagcctctttcccctggaacctgtgctcactggagttttccttcctctcctgacctcattaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcaccc

SEQ ID NO: 37911 - DNA, 439290 bp, Homo sapiens
gagcagaagaaagagaggacttatctccagcatctagcactacagagcagaggctgtgtggagaatggctgaaaaatcagaattggttgtagaagcagttttctttctggttgtgagtatgagcccggcagacaccatgagcgctgttgcaggggagtcggcctgtgcttgacacatgtgtttcccattgatagctggagacagcccagtagctgtgagtcggtctgacaaagccatattgaagtacggagtacggtttcaaagcagtcagaaaaagaacgggaatgctgttcaggaaattcttcaggcatgggcagggacttggctgcagttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagaggtagggtactgttcagttcttgcgtttgcacgcgtctgttcactttctaagctatctgcctgctgtatttgcaggcactccgagtttttagtgtgtgcatgtgtgtgtgtgtgaattagcaagttagaactccgtcatgtaaacagttggcatggggctccaatctgtgcttttccccctttaaggtctgattttcagcagggcagagagacttcttttgaaagttaggatttagctggcaacgttattgtgtaaagaggagtatgtgaattccttatgttgtcaccctgctccaaccatctgtaacttttcctttctgcgtggaagggccgttcactggcaaggaagataatttcagatgaaactgtctgtgtgttttgcttcacttcgcaagagttttaatggggagttttttgttgttgttgttttttaatagtagaaaatggctctcattttaggagggaatcagagtttgaagtttctacgttggatgacactttcagagtgtcgaaacagatatgtgtgtatgggtttctaaaatcttttatataggagtttgactgtcattatctgggatttgactgtcagtgatatatttgcctagaattatgctggatcaacatttgtaattctgtttctataatcatttccaattttctcacttgaagtaatttgcagttttactctcaaaaaacacttctgtattttaggaaacatagataataaaaaagtaacagaaaatggcagtttactcaaaattcttcttaaaggacagagacatgatggtgtgaattttatttcattgatctcttggttttattttacaccttactgcaaaagagctttttataaaaatcaaagttttaaaaattttcagcacaacagggatcttagtgttcctcttcagttttggttcttctttatcaactctattgcagtatagattttttcctctcataggaaagctataccttgttttatgtacagcatttagaaaacacacagtacaatgtcattgcatttgagagactggttcagcccaaagccgagctaaaccttacaactgctttacaattactagcacagcaatctgtgacaacattggttttttccgaacggggcttggccaaaagtctggttggggagatggatgaatgaatggaatcttggatacttcttgagtagctgaagagtgactagacctcttagggtggatctctgtgacaacaggtgtgcatttacttgtgtcctacaatctttaaacaagtagctaatagaagagcctgaagttaatgctgaaagaaaagtggagagccagcatttctcattgcttcctctgcataagacctagaatgagaaggcacacattctgtcctgttggtagaaggtcaggattttcagccagcgattttcttttttcttccaagtgttgtacttggaggagggacctgggacaggactggcagcaggatatctttaagagatggttcatgaacattttctttattagtttcatcttcgtgttggggtggtgtggggagggtttggggactgcagggcttgaggaaaggaagggggtgtagttagaagtcaggatggactgtgaccttatttttttctctaaagtgcctaatgagtgagaaaaatgccaagacagattaggaactggcatgaaccgtagtcaagcccactgccaatgaaaaagggagccttccatgagctcgggtgtcatactcctctatatttagcgtgcgtcaagcattgagcagaagaggcgtgaaatagcaactccaggttgcaggattataaagagcagtgcttgaaacttggtagaaactctatagtttctctcttttttagaagtaaagtagggagaagtcaagctctcttgacatctgaagagaaaaagtaagcagcggaagggggaaggatacagaggaagaaatccaggacagaggtggaggcagtgaagggagaggaatggccacaacacaaactgggcagtgagggtggagggaggagcccttggcacaggaatgaaacacatgtattagaaatagccaaagccaccaggcactgatttgttggactggaggtgtgcagatactcagtggccttggtgaagagaattgttttagccacttcaccacaggagactgcatggtcagcctgccctgccttctggaagtaatcagaaagcacattttgtaagaatggcattgcctgagggttcagatttcctaggcaaggagggggcaggctcttcagaccttatttttaacccatatttgttccttgcagagacattactgccgggagtgttgagtgaagggaccaggtggagatggtgagtaattcccgggagcgaagcttgttcaaggccctgctcatggtcattttattattaacataaacttttgaaaaagagaacaaagtgttatatatgccttatcctgatgaagacatttctttaattttacttttttattttaaaaaatctgcaggccaggcacggtggctcacgcctgtaatcccagcactttgggaggccgaggcaggtggatcacgaggtcaggagatggagaccatcctggctaacacggtgaaatcccatctatactaaaaataccaaaaattagccggacatggtggtgggcgcccgtagtcccagctactcgggaggctgatgcaggagaatggcgtgaacccggaaggtggagcttgcagtgagccaagatggcgccactgcactccagcctgggcgacagagcaagattcagtctcaaaaaaaaaaaaaaaaaaaaaaaatctccaagggcacatactacatcgttggttgtacatgtgttgagcttcccaaatccaaaaatctgaactctgaaatgtttcaaaatttgaaactttttgagcactgacatgatgctcaaaggaattatttattggaacgtttctgatttcggattttcagatttggaatgctgaatggtaagtataatgcaaatattccaaaaatccaaaaaaatctgaagtcagaaacacttctggtttcaagcatcttggatagtttcctaagccacgtctgacgaacgtgctggtactgggggcagaagtggggttgagagagggaggaaaggtagaggtggtcagaaatcttaggtcaggtcctggctccattcatcttcagatctcaggtttcctatctgtaagatgatctgatacctctgaattgttttctgttttcacaacctatgatttttgtaatcctgaggctcttccttttctttaagaataactcttagtctgtctcccttaaggctgggtgtcttgagtcatttcacccatttctccatcttttcctgcactctttctttactcttctttgaacatatttcagtgagccttctcctgacaaaaactatggctccttgagctcaacttagtcatctgaacaatgcacattccatggtgaggacttcatacatgtgttaaccgaaaaggaagagggtgattgtagggagaggaagcacagcaagaaagaaaaaaatggaaggtggtatcatcttgctgtggaagaaaagtggttatattgtgaactgagctcagggtctgcctcaaacgaagactggggtcctggctgtgtggccataggcaagttacatcatctccaaaatgtgtcccaatttcctaatctctaaaatggacaagacaaaagtatctgcctaatagtgtgttgtgagattgtacagataatgcacttagcattgtcttttgcacacagtaagcacttaaatatgtcaaatatattaatacatatagttaagatgaactgagatagcaccaggcaaatcaacaaagagtgaaaaaggtagagcaaggtaaaacaaagagttcaaacaatcagcaaaggaaaggatgttttactctgaattatctgggttacttttcctgtgttgcccaaatttctctagaaattccacatttccctttgtttcacttttcttgccacacagaaaggtcttcattattgtttcaaattcctattgcagagtgtgaactgcctcatacaaaggaaaccatgtaagctgtagcctctgacctgcctctcagacaggtctgtaggactggggaggaacatgtcaccgtggttcacttagtatataaatcctgtgagattggtttgctcagaaagctttgttggtggttgtattaatggagctcaggatgtgtaggaggatatggatgcaatcactttattcttctttttcactgataaagcaatggcacctattagagcaagcacaattccctgataaaaactatattgccagggattagaaactccctccttgctcagaccacttttccttgccagagtgataggatcagactgtcttgtgagcaccttgacttccaaataatatattgtgaatgcctggaaaccctgctgttacttgctggagttgacatattcagccactgaaactattcattgagttcagagtaaataaataccagggtaagctcctctctccgaacgaatcattcgacaaaatcttgtactaaccctcattggggttgtgatattggcactgtgtattcaatgaaagaaaattgttccaggataaggacagcggggaacagagccacgctgtgttcctttcattcctatcgttacctatggttgacttctctcctctctcttattctataatctttctagccctttcgctctttctttattgggttccattcacccttgcaagtttcttttctctttgttatttgttcagtgtgtgcttaccaaagtccttatctgcttccctcaggggtcaggaatattggtaataggccagtgtctggacagcataatttttaccaggtagtgagaaagattaactcctagcattggctgagaccttcaaaagtttgcgtccccacccctctgatgttaccaggctgctgatacaaacagcaggtcataaaccggcaacccaaaggcttggactataggtacattttggttcacaaagtgtttttttgtttgtttgttttaattgacttatgaaatatttaaacatcttaagatatcataatgttgatcttctagaaaaagctgaagatgggcattccctatgtaatttcttgggcacagtggctggtggcctgtggtcagctcctgtccttttgagagggcatatgcctacctcattcattgaccccgctatctgacctgtacatgtttacatttgtctgctctatttttctagagtttctcaactgaaccaaagaaagcagacggttatttgagtgaccatgttctctgttctctcaagggtggtgcatattctagacacataggagagaagttagggcataattaagttgtggcttcattctctcagagaacactgttgagatggtctaagtctctgttgagcagagtcgcaggaggacagtatggtggccaagaatccagacctcaaaattagaaccacctcatcggattatagctaagactgaaaacattaaatgtgatagatatcagaatactcacaatctctggggaagggaattgattaagaggagtaataagagaattttctcgggtgatagaaatgttccctctcctgtttgaatattgttcccaaagatgttcagatttgtaaaactcattgggctatgtagctaatatctgtttgttttactagaagtaaattattcctcaatagatgtacatacatatatacatatctacatgaaagcatgcaaagtgcttagaaaaatgcatgctgtttagctatttttatcatacttgtttctagaaactttgatttaaaaaatatgtaaaatgaccaaaaacgagatgagcatttcctttcctaccacaggtttcattgcaagcatttgagagcgcaggtaatagctaaagattcttgccaaacacaattgtcaagggagaatctactggatcaattctaattttatgaaactattgaatcactatagaaggatgtgcctaatttgttgtagctgcttttcatgatgctgtaaaaatttataggttttagagacatatcaaagatggtttattacctgggacaaaatgcctatacttagagtaactttcactctggctggaatacagtagtcactcaataggtattcaataatatgtcttaaaattaatatccatattaagaacttctagctaatacaatcacaaaaatattgtttttattagtaatcacattgttataatcaattattcacatatatctagaagcatttaatataagaaatgagagaacaggttttccagccaaacactctggattcaaatgcttgctatgcctttaacaagcaaagagatttggggtagattacttaaccactctttctcattggctcaactgtaaaatagaaatgattgtgaggcaggtactaattatatgtctgtgaggattaaatacatgtagaacaatggctagtacatagtaccattatacaagtgtttgtcatttatgtgtgctttctttatgttagaaaagtgatttttttttttttttttttttttttttttttttttttgctatttgtctctaagtattgctcaaaatctgtgtgtagatggttggtgaaagtaatgtgaaaccaggagttcaagcggaaaagacagaaacctagaatttatgggaaacatactggttttcagtttagctgactttggtttttttttactgccttactctgtgacgttgattaagtcacttcacctccctgaaccttgttttattgtctgttaaataaggatttggattttatattgtccatgttccctttaggccttgtgtgtcactctgatctcaagtgtttgagtcatgttcattattattttattacacagcttggtccccaagtcacagaagagctgtagtagcttgactcctattgtcattatctggttctggtgggaatcatccatggggttttagaaagcaccgatcttgtacaacacaaagtagctggtttgctaagagtatctgccactactattaggaaagctaaccatagaagtggccatgatggggtagatacagcatcctttgcatgtgaaaatgacaccattaaatctgcgatcagatgtttgaaattatttttgctgcccaagggcattcagttcacatattcttttctggtcctcaccttgcaacatcaaggaccaggctagttttatatagagccaaatcttcaacaattcttgcaatgccgtcaagtctttgttcaactatagccttttccatgaggtcaacctttcccatgcttttaaatattgagcctgctgtattccccagcccctggtactgctggtctattttcttttttttttttttttttttggcttttttttaggaggtgggacttttcctcatagcattcatctccttgtgacataaatataatattcgctggtgtttatgtttattatctgtctccccatcactacctctttccaccgctgtgagatcagagctctttgttgttgctcattgatatatcccagatgccttgaacagcgtcaggggaggaactgaaggatggcacatatttgcaggtggtggcagtgtttcaaatgcatttcacactgaatatacgtctatgataattctaaataccttactttgtattcaggaaaagttaagtctttgcctcagcctgtgagtaatggagagaaaacccggcctgagtttaagttcagaccctaaccaagttactagttaggggtctttgagaatactcctgaattccttaggacctcagtttcttcatttatgaaatggttttaattatatcgatctcccatagtgttgcaggaatgtatgcacttgtgtatctgctaattcctggtagaaatatgcatgtgtgtttcacaaatgtatctgcctgaaagcacctcaactagtacctcatacatctgcatctctaggatggaaagaattgatgttcatcaatgctgaaatatcttctggttcatcagagataaatattttaaacttaaatacaaggtatattacaatttgtggggcaccttgataatatttatttaaaaactgtacagatacactttgacctggcaatctggtttctcaggacttgcctgagaggtatatttggacctatgtgaaacatgtctgctctatgtctatggctttcaataatactcatatcctggagtcttaaagattcatgtcccgaagcccagtcttccttccccttgaagtccagattcgtttccaagtgccatcatagtgttcttgtttatctgtctccttatctcactacctcttaccatctctttggaatctcatgtgccttcaacattaacacgcctgtctcttcccctatcattcccctgcacactccatccccctcctgccctccaagccttctatcctcacgctgttccctgtggggtacccttgtgcaactggctgcttatgctgaaaccttggggttctccttgactcctgtcctttttgacgccccatgtctcaagccacagagaatcctgttagctctgctttcccacaagattccagatacagcaactccccagcttctcacccacctgtctataggcctgggccactgccacctctctgaagacgattgcagtagtcgcgggcacctgttctccacacttccattctcgctcctacaacccatttcctagagaacactagagtgatcctgaagtgaaaatctgatcatcccatttccatgcctaggttctgcagtggttactgttgctttctgtatcatacctgaggtttttactgtggctctgagctcctgcttctttccccttctgcctgtgcccaagctaattttcaaacattctcctccggtgcactctgatctagccacactgtcctcctcacctgccaagcgagctcctgcctcagggcctttgcacttgcttgtccagtttcctctgactgaaatatttccccagatatcctcatgctttactctcttgcttctttgtgtttcgttctcagatctctctgggatggtcaggcttaaccatctcttaaacaggaactccttaacacctcagcactgttcccttctgctgcttctgtgttttcttcataagactgatttccaagaacaagtagaaaaagttacattttcattatgataggtaacaaaaatgactggaaacaacctcctcgctatttgtctctgagctggttaagttaaatatcatagatccataccatttaaaacagtctagctatttttttttaattttatgtttttatgggactatcagttatgttaagtggaccaagttagatttagagcattatgtaaaatatgctcttgtttgtgtaaaaaaaatataagtgtgcatatgcactgaacatctatattgaataaagcctgaatatgtattaaacatttctgtaaggataaaaaataagctgataacactggttgcctcagtgtggggaggctgaaggtatgaatgagagaattgtttaactgcatgttctttgattcttttaaatatatgcacttgttgaatttgttttcggtaaaagtttttcaacactttggtattacatattttagctaagaattggaatatataactattaagttaatctgaatatttgtttaaaaagaaactgccattcctgggctagttcacataaataggtgcttacttttctggatgaattttgtaagaagcaaatgttgttacatcaaaactaaaagtgatgaattttttaccattgtctaaattgtgccaaatatttgtgatcccagactaatgcctggtatggatggctgactaaaaaacaaaccttgaaagcaaacagttttacctaaaaactaatatggctaatggatttctatttctgtaccaggatgattcaaaatggcttagattccacaacaaactctagaaactgtaatgagcctttgagggaacctatgcctcctatttatataaactggttacaatctcatagttacataattcatgtttacttttaaattcacccaattttaacctgtagcatcaccaagaaaaataaaaacttacttgatttgtatcacttgtcttattcttaaattagctaatgtagccatcagtcttgctgtatttttctctactcgttagaacctaggaggtgccccacctctttctacaaactcacctctcaccctctcctctgagctcattcaatccaactcttgagcttcagttcttcaggccgtagtgcttgctctgccttctgctgaaaagcttgcccccactcccaagtatcatcttaattgtctccttatcagaatgaccttccatgaccagagtggttcaccttctattctctattacaggtacctcttcgttcttcctagcacctaactttagttctaggggtttcattattgtccattattgtttattgtccatctctcattaaaatatgagcttgatgaaagcagaatatgatcattttcatccttttgaaggcctttatctctaggacctactgacatatatagtagatgtcaaaatatataaatattttactgttgaaaaatagattgggattggaattttttttgtaagtcaactctgtactttgccatgtctctccctgacagtgcataactgaacagagaactgcactcacagcacctacccccataaattcctttatggaacaagagattatgaagaagcctagtggggagcagagtcaaacgttagtaaaatgcctgtcaatgccccttctttttctcagctctgccttatggtagagttgatcatggcccatacaattttacaggcccaaaagaaagatcattaggaaacttgatggcattgatgtgtttttaggaagttcactgggttttttgtttgtttgtttacaaatcatccctgaaaacataatgcatttttgcacagcaaattggtaatgtagatactgtaactatttccagggggcaaaaaaggaaaacatttgttcttctcctgaagaacagccctgtgggaacaaagatgcaaacaaaaagtgaccacttcaacggtattagactagaatatgtgcttagcctcacaaagcggaccagctgtggatgctcctgacccatgaccctttttcatccctatgtcttctcaatgacctgtaagaagaggagcaataagagattttcacagtagccatttgattcctaccaagtgtaggaaggaaagtcagcatggtataaaattaatgaccatctgagtctaatcagagcagtttctctgttaagatattaaagatctgtcgaaaatggcagacttatcactttgaagctcacgtagcttccttaattagatggacaatggctaggtccaggtatcatgtaggttgggcctggttcaaagatctcggtgacaacttcacagtgggtaggatttgcataaagttagcaggcttctcagactggtgttgagccctgatgaggctactggaggtggctgcatggtcatcacagagtcactgaggtgttggtggtggttgaagtggtagaagttacacagggccacacagcctcaaaggaggttcttcacaagtccaagtccaagtcgatccttgacttcacaagcccaagtccaagtcaactcttgagattgctagattaaattaatatcaagtcttgactctaatgctatgcaatcccagttaggaacatttgcagtcccaggtaggaacatttgaatgcctgagaccatgaggttacagctctccaaaacatgctttagtaatatgaccattcagaatgaccttcttgggaaactctacatctaaaatatttgaccactatttaattaattaatgattacaggtggttatattatatgatagcattgtcttgtcttttggtagtttcttcccatctaatggcaaaacaacagaaagttttactgtattcactctttgggaaatataatcctcttacattttgtgtgcaagaaacagatgatccttaagtcaagtggatttgtttatgaacaggtcaacattgaaaatagttttatgacgaagtaatgctttggatttaagcctgcttagcattggtataattgtatgtgcctttggaaaaacaaagttgtataagtttttacttcttctgatatagctagttacttattactagagaatatactttactgtttaacgttggcttgatttttattcatttattcattcattgaacaaatgtacactcattcattcattgaacaaatgttttgctaaaaaatgcatttgctttatttccattaaaacaaacatgacaataaagtgaatcacataaatgtttgggtttcacagtgcagataaagtttatgtttatactgtagtattctattgtgcaatagcattatatctaaaagtacataccataacttaaaaataccttactgctaaaaacaattgggataagaaaaaactaaaaatattaggaatacaaacaagttaacaacatgaatatatacttagaatgagaaaggaaattaaattattaatttttaaaagatgacatcacaaaatcaggaaggataatattgctaataattaactgcctcacatacattttctgtactttctggttgtatagcctttaattgtctcttcatatgacagctatatgccattatcactttctgtatggacaatggaaagataattatttttatggcaattttgacaaaactttttaaatattgatggttgtaatgtagaatgcacacaactttacacaaagttacacatggtatacataacctacaaacccaagtattctggttaattatattttccacaattctcatacaaaataaaacacatatggaacatttatgattatatatgccaaattcaatgtacaatgtattattgacagtagagcatttgttttgatgaggcatcaatgacagttgaattctacatttgacattttacatatctcatgattatcaaataaacttttgactagcttctgtcttttctactacccatgtatttctggtgctgaccattgtaggtcgtgtttatatcgcatcgtgtcctttggtcctcttccttcatgtcaccatgcttggtgaattggagctatgggtggaaggagtattcctagaagacattcctataccaggagagctagcagtaatgtacctctactgggaagtgctgcaaaccatataaatatattctgcattcaaactataggaaccactaagccaacttcttcttagatctccaaaatgcatgtaaatcctccagagctaacacgaggggaagtcagaatagaaaaagatagggtttagcgagttgcagttaaaacatcttttaaaaatgttataaaattgtatgactattgtcatgatttactggggcctctcctggggtcttcaaaggcctggggtctgcccaagtgaggaattaacgttttaacttcaattccccgggcagtacatttgttccgggaaggaataagaagaatgatagattggagattgtcattcatctttgtttttatctttcaacatgttttaatttttgattagaaaaatgaacgtactcagcatatctaaatttccctttccatgcaggattctttataacagatgtatccattaccatatgtttgcatggaaaggcctccttttataattatttgtcaaaaagtgctcatccccttcactgtttctttcttatgtattttaatgagttggagactggagtattctgtttcatgggactcattaaagagggtgtggtggagatgacatgcaataagccactatacgatgcagcaaaagatccaagttataattcctgctcagcttctaatttgctgtgtgacttgaaaaggagctgcttcctcctggtcttgacttccacagctggtcaattttgtcttggacaaaattagtagttcccaggagcaaaggattctgcagagatgcctcaaaggtagccagaccctgctttaagcagaggaactccactttttttattttttattttattttattttatttttttgctattttacacactagagtttcttgcaagactttgtcttacaatgattaccctatgaaaaaaagtgaaagccattttttagatgttgtcccaaatgcttagaatcatctgggagatttttcacaatgttccaccctgagctccagattctgaaaatggagctcaaaatttgtactatatttgttcagtttcttttgtgtttcggtgcataattagggttgagtggcattattctagaccaatggcatgtaatcctgtctactcttagaattatctgggaagctttaataaatactgatgcctgggtgctacctctgtgattgttacttaacctgagtacagatgtgtgtttttaaaattttatttacttatttattttttgagacgaagtcttcactctgttgcccaggctggagtgcaatggtgcaatcttggctcactgcaacctccgcctcccgggttcaagcaattctccctgcctcagcctcccaagtaactgggattacaggcacctgccaccatgcccagctaatttttgtatttttagtagaaatggagttttaccatgttggccaggctggtctgaaactcctgacctcaagagatcccccttccttggcatcccaaagtgctgggattacaggtgtgagccaccatgcccggctgagtacaaatgtttttaacagctccatcagtaactctgatgtgcatccagggctgagaacccttagtcaagagaatcactgcattctgccaagttctaccagtatgtgtatgaaaacaagaaatcacaagcatgctacctatacctccatcctcttataaacatttattgaacatgtcatttccattttatagctacgtttatgtaatgacaccatcgattgggttgaatgacagagaaaaggcaactgatatagtggcaatatcaccagcttctgcacacttatttgtaaagaatttctcactgtttatcttgcctatgacaattccagattattgttcaagaccttaccctgccacaaatcctttagccctgcacaagcaggttaacttctctaatcctaatttggctcattcacaattagttgattaatatcaaaggaaattgcacacgtgattctaagattctgtgatcattttcttatttcatagaatatgatctgatggaaaataaaaacctaatttatttcaggcttataaagcattatttttacttttatttgatcttcatgtttaaaaaggccagtgattgatgactttgttgtgttcccgtcttcttataacacatccctgatctgcagaggaattatcagaagctgagatttaaaactgagatcctcttacaccacaaatctcactgcctggctgggaacccagtgctttgggagcctgaagtgaaaatttgcaagtatacaaacaagaacttgcccatggtatttagcttaaacctttacatacccccagacagcagcagagctggtagcagatgggaaatcattcattgggtcatcatttatgcattctgttttccattcaatcattccacacacatattccaacatatactaggtactgatttcggcactagggtatgtgtttggaatgagacagatgccatgtaggccttcatggagcatttcagttagccataaggaagaattcactcagtttttcaaatggaattccactgatgcctaacggccatgagttctctaggggatttttagattttatgtgtccattttaatgattatctaaaaaccaaaaaaaaaaatcatattgtgaaccatctggaagatatcctaataaccaaggatgtgattttagggcctgcattttggttttcattatggccactttggcaccacatattactaatttattgctattggctgagaagaaaataaatggagtaggtcttatttgtagggaatgcagtgtgtctacatgacagccaaatgaagtaaaaataagggctgtaccattatctgaatggagataggcagtgggggtcctgttatcacatggcttatgacagagtagagatgctgtgctcaggagaccttgtgccagagaccttggtaccacattcatatgatttagtttaaggcaaatcatcctttgtagtactttgttattttccagtttgagtgataggcattttctagctttatttatatttaattttaaaatttgttttggttttagaattggatagaagtgatatgtttacctacatttgtgttgacaattagtaattctagtataaagataatttgtgtcaacagcagggacttggaaaaccttccttattctaaagggcatcaacgtattactttataatatattgacaaatccttttctaatttctctctctctactgtgcttagcatttaactagttcatcctctcattagcctacgagctaatgttcacattttacttgactttgaccctcctttatgtttcttaaataagttgcctgataacggttagaattgcctaactcacaaagactaactcagggggtagttaggtatttactagactatcacttgctgaagattcccaaatcaagtggggttccagctgtgtgtctgtaaggaccccccttttaaatctgaaatagaggagcagtcaaagctgccacggttgccactgactggcaatacagaatgatagtgttcaaaattttttaaccacccccccaaataaattgcctgaataatatttttatattactaaggtgaactgctggggttaccttattttcttcagtaattctaaatttttccttcggtttggtagatctttgagcatctcccccacaaagatgttggaattctgagtcatttggaaaatggcctcctaggagtccctttccacccattatgtgtgtgactgtggctgtatcagtgcacatcagaagtcatggctgtgttaaatgagaagcctcaagctagcatccagagaagtcacttttgtccagaggaaacagatttttagagttgtcagagggtataaaagtagacagcagccagccatatctcttcatcagttgatttttttttcctttattttttttctcttctctcagcggtttaatgtgagtgcttctctcttgcctcgtttatttcagatgcctcaggagcagtacactcaccaccggagcaccatgcctggctctgtggggccacaggtatacaaggtggggatttatggctggcggaaacgatgcctgtatttctttgtcctgctcctcatgattttaatactggtgaacttggccatgaccatctggattctcaaagtcatgaacttcacaattgtaagtaaaaccatctaggtttgtttagctttcttccgggaggggaagcgtggggcaagatgatgaaggaatgtggaaaagtgatattattacagtaggactcaaaaaatctgtaacctcgtgttttggtgaaagagcatttctgttcagattgaatatggatattgacttctatctaatctcagttcttcgggggctaatactccaacttaaagatatttccctcctttagaatctcctgtatgttatccctccattttgataactgtttctgtagcctgtagctttcaagcactttgattaaataattaagcaatagagaataaattcaaagtattaagttttcagcaagtgtagtgattataaaaggttttttgaagtagagagttgaaacatttgagtaaaattatactgtgagcattatctatctaaaaattttaactatttatgcttgattatccatcactctggttagttaagaatatcctgggtttttcggaggacgatcctctttgccactagtctgggtaagatggaaattagaggaatgtagctgtgtttcatttttttttttaagaattgatgtttatgtttcttcaatgaaacttttgctattggtgtttggggtccctgtacagactggacatttactgttgtagttcaaatgaaaagaaaatcctgaaaaatgacttttggagttatttagaggttttatacctagaaattctgatctatactagtaatgtaagtagtctagctcattaatgaggaaatactgggcagcagtctgctgtattgagcataatttcctttcttgttctgatgtcaaaagtgagtaatatagattggcaataaaaataactcctaggtcaggcacattggctcatgcttaaattccaggactttgggaggctgagttgggaggatcacttgagtccaggagttcaagatcagcctgggaaacatagcaagacccgatctttgcaaccaagcaaacaaacaaaaaccaaaaaacaaataacaaaccaagaaacaaaccaaataacaaataccaaaaccctcttgtttgataaataaacatgacctttacaaagtaacagtaaaattttcatgtgacaatcccaaatatcatagtggatatttgcattttctaaattacaaagttcatttttatccttgacatcctatgcatagtcacactttcttgcctttgcttgtacattttcttctgcttggagtgcttttctctgtcttccctgtctggtaaaacttgtcttgctactcctgtagttccatttatgtatctcttattatatttaccactccagataataatttttacatgtatttcccagacaaactgaactttgagaaaggcaaaggctgcatcttttctgtgaatggctttgtccatcactcatgctagggcttcttggtgcttgacttaattagcactctataaaccaaggttacagatactgcttcaggcctcagaatggctcactttttaatatttgtggtaacaggaaaccataaaaacaaaaatattaccttgatgttacaaatttctatcttgagaaaataattcagttctttctaaaaaaatttttctttctttatatatgtatttatttatgtataggcagggtctcactttttcacagacgctgtaggacagtggtacgatcatagctcactgcagccatggactcctgggctcaagcaatcctcccatttcaatccctcaagtagatagaactagagacacacaccatcatgcttgactaatttttaaattgtttgtagagatgggtgtctcactgtgtggcccaagctggtctcaaactcctgacctcaagcagttctcctacctcagcctctgacagtgctgggattagaagcatgagacatcacatccagctaagagttcagttcttttgaaaaatgcagaaaatctatattgcagtagtaactttggaagattatatggtcagtttccatggggttgtaggcatccaaggtaatagttctagagtattagagcacattagcttccatttctgaattagactcaatcaatacttctcaacttgggctttactttatttttttattttttttatttttttattttttgtgagacggagtcttgctgtgtcacccaggctagagtgcagtggcacaatctcggctcactgccagctccacctcccgggttcaagccattctcctgcctcagcctcccgagtagctgggactacaggtgcgcaccaccacgcccagctaattttttgtatttttagtagagatggggtttcactgtgttagcaaggatggtctcgatctcctgacctcgtaatccacccatctcggcctcccaaagtgctgggattacaggcgtgagccaccgtgcctggcctggactttactttctttaaagacaagcagaattcagagaaatgtttaatcaggagagcaagatataatcagatttacattctagagagcttgcctaggtgatgaagcaatagaatggggaaagtttgttagagctgagggctctggaggatgccttgggtccatttggccttaagtcccagtgaccacaattgccatctgtcgatgtgcatgttctgtgatgttgttaatttgtatttcaaaaacttataaattagtaaaacttctctgttgcaatattaaacaggagaatactgaagctagggcagtagtatggaccttgcatttaaagacatttaaaagatggaattgatataccttgacttctggttggatgtagggttgagggatcagaagacattttggaagatttctggttttaggatggtgagatggctgggtggtgggtcctaaaaagcaaaatagaatttattacttttccactagaacttggctagtactcatgtatacctttagtcccctatttgaagctatcctcttaatcccttatttttgtgatttttaccaagactgtcacaaatttaatttgtagaacctgtaagatttaggggtagaggaagtggaaaatatgagctgaaactttgataactgtgatattataccaatactgcttctagagtatgttttatctggaagacttaatagaagtatatgtaaatgtatattgagtaccacttatatgacattaaggtaataatctatatgaaatcggctctttcctgcagttaactaaattgattgccaaaattgagagtccttaaagctttaccaaacttactgagataagaataatgctgttattaggcataattggtactttatagccaataatgcatttgagcaaatagaactgaagtgttagaaaattggtcttgccctgcaagttaaaagcatattttccatcaatcatggtataaaggatattcttttagaattataattctcttgcacaaataaaaatttactgacagtggagatcgtggggaaagaatgaggtattaagcactgttacgttggagaaagagaaaaaaatcaatgagatggcagtaaagcagtttatgcagagatttaaaaatatatgtaggggaagtcctagccagagcaatcaagaaagagaaagaaataaagggcatccaaattgggaaagaggaagtcaaactgtctctgtttgccgattacatgagcatatacctagaaaactctaaaggctcctccaaaagactcctagatctgataaactaaattcagtaaagtctcaggttacaaaatcaatgtacacaaatgagcagcactgctatataccaacaatggccaagctgagaaattaagcactcaatctcttttataatagctacaaaaattttaaatacctaggaagatacttaagcaaggaggtaaaagatctctacaaggagaaatacaaaacactactaaaagaaatcgtggaagacacaaacaaatggaaaaccatcccatgctcatgaattgaatgactcattatcatgaaaatgaccatagtgcccaaagcaatctacagagtcaatgtacttcctatcaaaatatcaatgtcgtttttcacagaattagaaaaaacatttctaaaattcatatggaaccaaaaagagtccaaatggccaaagtaattctaagcaaaaagatcaaatctgaaggcatcacattaccggacttcaaattatactacaaggctatagtaaccaaaacagcataatactgctataaaagtagacacattgaccaatggaaccgaagagagaaccgagaaataaaacctaatatttaaaatcagctgatcttttacaaagtatacaaaaacataaattggagaaaggacactctaataagtgatgctgggaaaattggatagctacacgaagaataatgaaactggatccttgtctctcactgtattgaaaaagttaactcaagatggatgaaagacttaaagacctgaaaacttctagaacataaaaattctagaaagaaaaacctaggaaaagcacttctggatgttggcctaggcaaataatttatgactaagaccacaaaaacaaatggaacaaaaacaaaaataaataaatggaacctaattaaactaaaaagcttccgcacagtaaaagaaatagtaatcagaattaacaacctatgaagtgggagaaaaaatttgcaattatgcatctgacaaaacgactaatattcagaatcgataaggaactctaaacaagaaaaaaaaacaggtgatctcattaaaaagtgggcaaatggcatgaatagaaatttctcaaaagaattgatataaatggccaagaaacataaaaaaagtacaacagatctaatcattagagaaatgcaaattaaaaccacaatgagataccaccttacccaaagcagaatggctattaataaaaattaaaaaaaatagatgttggtttggatgtggtgaagaaggaatatttatatactgctgatgggaatgtaaattagtacaatgtctatagaaaacagtttggagatttttcaaagacatcaaagtagacctaccatttgatccagtaatctcactgctgggtaactacccaaaagaaaaaagtcattatgtcaaaaagagacctgcatatgtatattttttttgcagcacatttcacaactgcaaagatatggaaccaacctaagtccccatgaacaggtgagtggataaggaaaatgtgatatacatacaccatcagccataaaaaagaatgaaataatggcttttacagcaagttgtatggaaccagaggccatttttctaagtgatgtgactcaggaatcaaaaatctgataccacatgttctttttgataagtgggagctaagctaagggtatgcacaggcatatagagtggtataatggacattggagactcagaagaggagagggtgggaaggggatgatgaaggatgaaaaactacctgttgggtagagtatacagtactcggtggtgggtacactaaaattccagaggttaccactatattattgatccatgtaaccaaaaaccacttgtatctctaaagctattgaggaaaaaaaattatatatatatatatatgtacacacacacatatacccacacatttatgtaggaaagagtgattattttgtatgtttggtttgttcaacaatttgagatttgggaaagctcacactgtaatcaaaccccctgtgtaatgacgaactataagaacgatgtcatctgaaagtgtttgtgaaaccttggtgatctatccaagattgaaaatctggaattttactttttttgtcagtcttgcattctgtgctatccccaaggatacatgctggaagagcctttccagtaaagcaatctggacaagcatcttaccaagttttctttgtctcagaggtaaatcagaagaaaagttattttgctttcttctgctcttagcagaatattccagtattcattactggcaggagattgagactacatatttcattttccccatacattggagagtgtgtgttttacctacactgtaaacacccacaaatagaccttagtttatcacacattgtgcttatacaaacgagctaatatttattaaatgtctcttctgtgctactcactgtacatggcccttaaaatcttttaactttcataactctacaaatttaatattgttattcccactgaaaacccaaggctcagagaagttgagtgacttgctgaaagacagctagtaagtaaaacgctggtgtttgacttcctgtctcaacctttccactacactttacctcctcctccaaattgcaataatgatctggctcttcaacagaattctgaagctggaaaaatagcttgttatctttgccaaccctgtgtcataggtcactttcatctgaggtatccagtgacgttttatgtttagagtagttccctggtagttccgaatgtttggtttttatctaatttctctttgctgtgtagctgaggaccttctccttgcattgttcccaccttgtgttttgtccatttgatgtgttaacataagcatttagtataaacttaatatctacccataggttggtggaagacccagtgagttaattcatgtgaagcattattagcagaatctgacacataggaagagtcagtgttgacaacagaaagtcatgagagacccttcatgacagtatagtagttcagggctcaaactctggagacagatgttctaagtaaaaatctggattctgtctcttactatgtgatttttgataagtttctcaacctccctgtgctgccatttcctaggagtaatgacaatacctacctcctaggattgttgtaaagattagaggaggtgataaatgcattgtttagtgcttggcacatagtaaacactttatagaagtgtttgctatcgtcgtagtcatcatcatcatcatcatcatcatcatcatcatcatcatcatttactgcaggcttattctctgccaggcactacactgtcgcagttacagtttgcaaatattatctaacttaatcattatccaggctgccactatttggataccaattttacaagggagggagtggctcaataacttgagatcaaacagctataaagcctcagagtagagattcgaacccaagcagtctgactatggatcctggtctgttggctagtttgtcatattgtggggcagtgcataatgccatgagtgtcagaaactggattcccagccctaactggccatgaactacattgcctttctcttctggaacccagtataccactaaatgcattggactagatgtcatctcgggcatcttcctgtttgcacactgatttttgtcattttatatttccctaggctgtatgaagtctcattctaatagagagctgttacttttgctagtgcattctaccagcccaatcagaataacctggcctcaaagaccttccaaaatactgtagtattgatcatgtagacaatcatttagcacaagtggttattaagtgacaaaactacaaaaggcttaggagtcatcagtggatggcatgatatcttatcccagtacttgtaaaattagatgaaataggaaccttaggagtcacctcatcagacatccttattctacagatgttggaaccaaagtagatagcaaagttttctgaccagcttgagcaccccagctgctctggaaacttctctcagtagcagggattattctctatacatttttgtagccctgctcaatgcctgctattcagtaggctttcaacatgtgttaactgtagattgccttttgcagaccacacaaaggagataatggatatcaagtatctgatcatgttgctgacatggtaggacctcagtaaatgatagctacctatacctgtagtatatagatctcctgatttctattttagtttctattcgttaacattacaaaatccaaactgttgtcacttgtgatcatgtaagaaatgaatttccatttatttcataaaaactcatacaggattaactttataaggttttcacatgatgcacataagaaccctatgagctaagcacccttgttatccacatttgacagaggaggaagtggaggctccaagaagtgcagtaacttgcccaaggtcacacagtcagtgaatgatgaaactgggatgggttgcagggagtctggctctacagtcactgctcttcttcagtacacaatgctgcccattttccaagggctatttttcatgaagacaagttgaatttgttcagtgcaatgtctaaaacatggtttatttaccctgaagtaagataaagatccactgagggtcagaggaaggcattctaatgcttgtaaattggacacattgtaaaacagtaaaagccagagagaacagccagcatgttccataactcaggaccctgacacatcatctgttttgagtaagctcaaggaactgcgacccagtcaaactaactcaagttgaggggagtgaggatacatataaagtacatggcagacacttagaatatgtttattgaataaatgaaagggagaaaattatgaataggcagtcactttaaattaaaatgtataaagatgggttaatagagctttatatgacttctaaaatgaagtattagttgatttattaaggtagatcataaatgagatgagtgcttgaatttgattatgaaaaggtatttttaatacagacactcgctctgtgtatcaactacctgctacattttaattacatgagaaaagaagggtaatgatggagtgtgaaatagattaaaggtaggagacttcatcctagctaatatacagatttgcttagtaaatgggtgaaagtgatattattggcattagttatacttttcatttaacactgttaatatattgtgagtttgagtagcatccgcttcaatgcgggtgccagcttagcttggggacttggaagtgcttcctctactgagaaaatcatgcttccatctctcagtgctttgactgtgtggtcacttttaatccattagctcaatccatccatctgaaaaatggccaaaatgttgttttttaaaagcaccataaaaattgtaatgcagaaaaacaaaaaacaaaaatttatttttattccatggtcagtcctaggatatggctctctaatgtcctatttggtttgaaacttcctgtgttttatacctttgtgagaatgtaaagcatcagggatgatttgggtatcataattactgcaaataacatgaatcaaagctgctgtaaagttatacaatctattgggcatatctgcttcaattgaatcagtatttcttaagcacacagttgagtatactatgctttgtgtagaaactaaagattagaataaaacaattctatactttaagtactcataatttactagggaagaaaacacatgtataattttagtactttccacaaattaaatgttttaaagaagtatgaaagttgcggaaagaataaattagctaaagttagagggcactggaaggcttcttgagttgtgtcaccaaggatggataaggccttttgtgtggtggtggaagcagagaaagcagtgtgattatagtctggaagctggtaagttaaacttgattggggagcctcaggcataatggttctagtattgagagcttaggccactggaggggaaagaggggatggggaaagatgagaataggagctgacatgagtaaagtcaaaaaggctgcaaattatagactttggagaggtcaaactgaaaagcttgaattccaattataaagaaattactgtgcaactttatcctattatttggacaatattcgtgaccttttccacttacgagagttttcatacaactaaagttatttttatgtcctagaattgagaggaacaatgttagaaaatcttcctggaaatattttttgtctttgtatatcacacatagccattcacacatggaaacttcagttcttactggtcatgttgctgtgagctctgaataactctcagaaatctgaacttgtggccacatcacaaggatctgttcatgctgactgagttattaagcaatcatagaagagaagcagcaaatcccaagggcttgctgccactgagaacctgcaggtcagtccttccatggtagacaggggtggggttaggtgattcaaactgtagaaagaaccagtaaatatgagttggtttcccatcagttggtttgcctgagaatcattagttaagatttctaggttcagagttgtttgtaaatgatctttctagaatgacactgtctattaaggatttaaaattaacattgaagatgtctatttagtcacacttgtcatgtcacaatgttcaacagctacacctggctagtagctgccatcttagagcagatacagtttatttccatcatcacaggaagttctttgtttcaaaactggtccaaaatctaatgtcctacttcttagctacatcttggatggcatggtaaggcctgtgaaccaaaaagttctttgtgcctcaccatacaacaatttttgcctttccttcctgtgccccaggcactttccaagacccagagctgtgggattaaggtaggaaaacaaaccaaaaccattttaatataaaaaggagaagaaaatttctcataatctgattaacagccaagataactactatgttttttaatcagctttgtaccttttccacacattcattctgtctcatttcttcctttcaatattcttaattggaaaagttctgagactgtgctagatttttcatcttgcctgggaggagcaaggtggacttttgttgggtgaagagctgtattcaggaaggagttgcagggactgtttctgagccatattctcccaacttgtaaaatatacagttggatcagatgatacataaggtccaacaccctcaaataatttttgtttttctgtgagacagagtctgactgtgttgcctaggctggagtgcaatggtgtgatcccagctcactccaaagtccgcctcccaggttcaagcgattgttgtgcctcagcctcctgagtagctgggattacaggcatgtgccaccacgcctggctaatttttgtatttttaatagggatggggtttcgccatgctggccaggctggtcttgaattcctgaactcaagtgatttgcctgcctcggcctcacataatttctgtgtgtgatcactgggtcctccatattccctgacccagaatgagaaagatggacatcttttttcttctagaagtgtgagggtgtgagtgtgtatgtttgcttactctgtatctgcttagccaaagatccaatatattaagtgccagggagtatatcttatgtgcctttataaatttctaatcttcattcatttaattacttaatgaataattggtctgattatctattgctacacaacaaactaccccaaaacttagtggcttaataaaacagcaataatttgttttactcatgattctgcagattgggcagagctcaggggagatggcttgtctcttttccctgatgtctagcaccttagctgggagactcaaaggcctggggtatctcaacagctgggactggaattatctccaggtgtgtttacttacatgtgtgggtggttgatgctagctgtcagctggaacctcagctggccagaacgcctacacacagctcttccctatgggctaacttgggcttgcccttaacgtggttgctaaactctagaatatatgttccatttaaagaagatggaagtgcatagcattgttatgaaccagactcagaagtcagattgcatcacttccactctactctgctgtaggcagacacaaagtcctgcctaaattcaagtagagggcatatgggctccacttcttcatgggggaattgcaaagttctagaggagtacgtgggatgggagattgtaatggattgaatagtgcccccctacattatatgctcctaatccttggagcctgtgagtgttaccttatttggaaaaagggtctcatctaaattaaggattatgagatgaggagataattcctggattacccaggtgggccctcaattcaatgacaagtgtcctcataacgatgaggcagaggaaaatttgacacagaagaggaggaggcaatatgatcagagaagcagaggttggcatgataggaccgccaattaaggaaagttgatagccactagaattgggaagagacaagggatagattttcgtctagagcctccagagggcttggaattctggcttctagaactttgagaaaatttatattgttttaagctgagagttttgtgataatttgtcatggtagccacaggaaactgatacacagatactgctatggccattttaggaaaagtacaatctgtgcaacagtaccgccaccatcaatgctattaagcgtgcagtcaccacacctgtattgaacattgtttgaacaatgttaagtgcctggctttgttttctcttactcctcacaatgaccctgtgaatggggactattatctcctctttctatgtaaagaaactgaagcatagaaggcttaattcacctgtccaacctttttagctagtgggtagccaggtcaatatataaaccaagatatgtctaacttcaaagcttatgcttttaattttctctgaaaacatttagtgtcaaaaaggaaaatgaatgtcttataaacagtaatgaatttacttgtataatgttcagtggcaatggtggtcattgtatagctagggtcaatgaggaatgggcattttaaaatgacttcagtattggctcagccattgtcgactcaagcggttttattctcatgaaaaattttaaggggtcatactaactacatagcttgtatttatgttagaagaatcataattttgttgcttttcagttacttttgtgcttcactcagttacatgtaaactgcttgttgctttgataaataaagttaaagaataggcaaacagttctcagtagtagggcagcctttctgtttattgtagaaacctcactgaatgcttgtgtagataaaaattatgcattttgaccggcttttaattaccagccagctttattaagtggagtacttcctaggtctcatgcctaatatgtactatggtcaaccccccaactttagaataaataagaatgagcaatggataacagaactcggcaacactgactttctgcagaatcaggcaagtcactgagccagtattcatgaggtaaagggttaaagtctcagtacattctggtcccttagctaatcatccagtttggattggccgatgtatgggagttttgaccattattacatgaggctgtcatctgccatgttaagtaaccatgttttctctctttctctcataatctcttaattatatgataaaataggaagtattgtccataaaacccaaagacagaggaaaagtatcatttgggtcactcagtcactccctgggtaaaatcagctttgtgccatacatagttgcttgccatttaataaatgaatgctttatagttcatataagcaatttcaggtagtctgaattgaaacctgcattgcaatccttggcagggaggagacagcagaaataatttgtgtcttgttcattcactagtggagagccttgtgcttctgacttatttcctagtctcagttaagtgaatggtttctattggaaatcctcacctcttcaagtcaattattactataattatgatatattgacagccttatgaatgagaaacagttgtttattcaacacatgcttgttgagttcctacagtgggccaaggactatactaagtgcttgagatatgagagtgaagaagagcaaatgccgttcctccctcatggagctatctgtctaatggggaagggattggaattactaacacaatcaaataaatgtaaaagaacagtcaggataagtggatggtgtaaagaaggcaggaaggggtgatttggcataattgaagaggggctttcaagtcaagatgattgcacagatgttaaaaatgaaaactcaacaaaggaagccaaagtaaaatgaagaaatgggcatctagtaatgttgtatatggatctgcagaaaatctgatgtttcctctgggagaggagttgactggtggtggtggtgggtggggagacaggtgggagaggggtggaaggcaacttttccatgctaccttatgctgttgaacatttggtgaggagaatgcacttatgtaacacttgtgggattcaagaaaaattaaaaataagaagctaaaagggaagagaaaagaatcataaatagaaatagggaaaagtcatgacagttggtttcttaaggactatttggctaccttgtggtataattggggacctcacctgtgaggatagaatcagactataattactcatagtgaatacaaatactgtatgtgttatgaaaaggaaactggtttataacaggtcttttgctttcttctttggagctggtttataacaagtcttttgctttcttcattggcacaaaactgtatctggccacttacaggtatatcaacattgacctcaggattcacaggttgattattgtcattaattaataggataacatgtattaagagcttattctgtgccaggtgtgatactgagcacttaacatagaacatattatctaatctctgtaacagccctagaagatgagtcctataattaccctcgtttcccagatgagaaaattaatctagagaagaggtcaagccactttcctaaggttgcagtaagtcgcagagctgggatataaagccagcctagacccagaatttctaacagctgttgcacatatcctccctgatgctcagcagtctgagaagatactgtctccattcctcagagccttagtctctgtgcttgtggtattattaagatgagtcaacagcagggcacatgaagaatgctgatggtctccagtatccctaagatgcactcatttctggaactttcttaatgcacacatatgaagatgaatacttattcacagctggtgctatacctcccatacagcttactgagaaattgttttctctttgtgttttctaatggaccttattgattcttttctgtcatattgtatgaatcacctactgaacttagaaaggttaagaggcctcacaactggtggacttaattatgttggagcaaatcctctcagtccagacttctcaaattcttggttcattttccatttgactctcattgtccagggttgccctgatcccatagtgcaaagtgatagtgacaggagcagccaaatgtccaggcagacaggggcgggtccccactgaaaccccacctccaagctaaagacagtttaaagcctgaaagcaaagctacaacttaaatcctcagatcaaattcagaacttgtcttcctgtttggtgtgctttcctctggttgatccctacccttcgcctattttacatatacctaccctttcctaattttttttttttttttttggagacaaagtcttgctcttgtcacccaggctggagtgcaatggcacagtcttggctcactgcaacctctgcttccctggttcaagcaattttcttgcctcagcctcctgagtagctgggattacaggcacctgccaccatgcctggctaatttttgtatttttagtagagatggggtttcaccatgttggccaggctggtctcaaactcctgacctcaggtgatctgcctgccttggcctcccaaagtgctggaattacaggcctaattggtttttttacactgtagtgtccacctttgagtgctgtcttcactttaacctttattgcatactcacaacccaatcagcacacacttcccatcctgtgcctataaagactccagactcagtcagtagagggggagatggccagactttgaggagaccactggactttggagaagagatggccagactgtgaaagacacagcctgactttgggggaagacgactcacccttcccatcccctctccagctcccctttctactgagagccattttcatcacttaatacaaatcttagccttcaccatccttcagttgtctgcatgacctcattctacttggatgccagacaagggcttggcgcccaccaagagtaggtacccagaaaggctgtcacaccagccgtttgctctcactgacagagggcaactgccccacatgattgaggcaaggggtcaattgagctgctaacacactgccacctgcagatggcagaactaagagaatactgtaatgctgtaagcccctctggggcttcggggtcatgggcaccctaacctgggtgctgctgcaggccccatatggagcttgctcctgctggagcctggagcgcccaacaagatcctgtagttgcttgttcatgcgctccctcctgcaaggggttgagcacagtgggcaagccaaataatagggcacccctgttgcaagtccaatgaaggggccaagaaaaatcttgcaccaaaaggatgattcggaaaaatcctgatgtgcacatacatgtgattttaggagagaagcagtgtaatttaccaggttttgaagaagacagacctggaagcttctgctctgttactgatgatctagacaattattggcaaagtacctaatcttctctgacccttcctttactcatttgtactagtgagattagcaatacttgtgttgaaaagttgtaataaagattagagataaccagaaagtagagtatggtaggcactcagtgctagtttttatccctgtcaacttaaaacatttggagaattgtcttacaaagaggaaaataagtttcagttgctaaaattcagcacagagtcataagctcatgtttaaaggaatgactaatagagtcttaaaagcatatgtaacttgggtgttgctgaaaatcatcattactgtaagaaatacggtgactcaaatattttatatgtacacattattgctggttcaacttaaaataggactctgtgaaacacagtaaactatagctattctggtgcatgagatggcctataaagaggtaaactaaaataattattggttgtgatgcatcctctgaagtctacagagagagatgacaacgtgaaattgcatgtggattactttggacatggatcagcatttgcctccctggaaaggcaaattttagtagaagcctaaaggaatgatactgagacagtcatgggaagagctgggcaagattttaggccgaaggaaaagcaagttcaaaagccctgattgagaaaggacttagagtaggctgtctatgtgtagtgtcaagaaaagggaattgccattcagacagtctccactgtaggaacacacaccctaagtaggagccaatgaagaagcaacacacatgtacttgagtctccacactgcactatgtcattcatgagaggccatttgacctttactggcttatttctgatttgtatggtgtgatgcttacatcaggtggttcaaaatctctgccttcttggaagccctcttcaaagccaatattcctatttgtcaataaaggttgagtgttcaaatggtttagaaatagcattcgaggctggcacgtggtggctcatgcctgtaatgccagcactttgggaggcccaggcgggcggatcatgaggtcaagagactgaaaccatcctggccaacatggtgaaaccccatctctactaaaattataaaaattagctgggagtagtggtgcgcatctgtagtcccagctactcgagaggctgaggcagaagaatcacttgaacccgggaggcagaggttgcagtgagccaagatcacgccactgcatgccatcctggtgacagagagagactccatctcaaaacaaatgaaaaaaacagaaatagcattccatagtgtgactactgtgaacctcgtggctagtctctgggatggaccactatggagaacttttccaataagggatacttgggagcatttcatgacatatactctatttgctttattcagagtcacagcaaccttcaaacattgtaaatggactccactatctaatcagggaattatagcaatatattaattgccatttctgattatttgcatttaattaaggggtactcttgagaaattgaaggacagcataacctcaaaatatggctttacatctgggataattgactataatttctgtctttgcagctttccctaaattgtttatttctccagatggtttctaaaatctatgattttaccttttttttttaatgggtgagtagggttttctgataaatgcttatatggtttagtttttgcagctaaattaaagcttaattagtcaaaaatccagatctgtgatatgtttatgaagtttatacaagcataattaatttcagttaattgcacaaatagctttccgtgtaaacaataacctcttcactactgacctctaaatgtcagatttcagtttatctacatttctagccttccatggtaactcacgtatttctaaaagtattgttctttcctttgatttatgattttattaagggagtcagtgattacccctgcaacccacgtttcatgttttgaaaatgcagtgaaaaaagtataacattgcttttgttttgatggaagcagaaaaataatttaaaatatgattttggtatgctctcctaagtttatttcttctcattaagttacctaggtttttttagtctatttgaatgacagctcaaatttcattgatcagctcaatgtcaaaaataatagctattatttttttaaatatcctgattgtttccaggatttctcttcctgagaagaataacattactgtaaactgagccagattctcttgctgtataagctgttgcctttgcagaggtatttacaaagccatgcctaattctaagaaattattctctgtaagtatgccttcacttttgattggcaatgaaattttcttattagttcccttatttccctaataaatcttacatatagattgaaattgattaattttgtctttttctgtctacctggttgaagggaaaggggatgtcattgcttcaggagctctttcagaagacccagaaatgtctttcccaggagcacacagaaaaactcactacctgtcacattggcctgacgggagtcacatgcccaggtctggacgaataactgtacccagggaatgtgattatgatcattggcttggtggtctcagtcacaagtcccacacctaatactcaaggcctctgggctgtgcagggaggtatgggcagcagagtgaaaatgagtcattgcaaatgaaagaggaggggatgctgagaaagcagtcacagatctatctctcagaactgaatctactgagttatgctgggattatgacagcagaagtctgggggaacctcttgactttaaagtgacttttccctcaaaatggtcagtatatatgaatttggaatctgtaaagtgttcttccttgctgtattcctccaaggttcactaacaatcagtcttatagaatcaattcaaaaggaccatgtttttggtgcctatcttattattagtgtcagggctacatttttttttttaatgcgcaatgaaatccatgaaatacttagcaagaatactttgcaaatttggctttgggggcagtgcatggcttataggcagaaggaaaaatatctgacaattgcataaattgaaaaacccttcatccatttctaggctgcagctacctataagcagttgaaaaaggagaaatccagtatgtgtgtgactttcaaggaatctttaatggttcaatatctttttagttttgtacacagactataggaaggtcatttttccctatgtgtatgaagttggcctccctccctttgtgggatttttgctcatttcagaggataagaaatgaggactggctattgttagtgacaggacagtgcttcaagaataatgagagtcactcctccttttccctaaagattggtaaagcaaaagtacacactggcttggaaactttttccaaataagtatctttgccattttctctccagaactgtagagagcctccttaggacatttgagttatggtctgggctttttcacaagctatgagaccttgggcatactacctgtcgcctctgggcatcatggtgcatgttggtaaaacggagagttgcaagggcatactcagatagcttttatctctaacactgtacacttctacaatggagagaagtttaaaaagggacttctgatttaaaaatgacagtataaaaatgtgcaactcaatttaaaaatgggcaaaagacttgaatagacatttctctaagatgtacaaatggtcatcaagcacatacaaagatgctagaaatcatagtcattagagatatgcaaataaaaagcacagtgacttatcgcttcacactcacatcctcacactctcttacctactaaaatgtctgaagataaaacagaatgaggaattatctattaccaaaaactaggaattccaatcagtcttttcccagactctgggaggcgtcttcatgaaccttcaaggtttaggaaactacattaatggacacagttgaagatagtatatgatatgctttcagaaacaggtcatttcctcccctcaccaggagttctttaggagatgctttatcttctgacctgtatttgtaccctggatgcaaaaatccagtgtcagtagcaactggaaagatgagcgttttctcttctttctgcatggatgttgtttttgagttcatctgcactacagttttctttccccacatacatatgcatacatgtatgtatacacatacatatacacagatatacacagaagtatttgtgtatctgtgtatgcataaatatgcccataaatatgggcatatatgtgtgtatgtagacatatatacaatatatacatgtatatatgtatacatacacacctatttacatgtatgtctatatttccatgtgtatatgcatgtatacataaatacatgtaaaatatacagatatatttaaatgtacatgtaaatatatacacgtgggtatgtgtatacattcatatatgcatatacatgtatacatatgtgtatacacatatatacatgtaaatgtgtatgtatgtatgcataaatatgtaccttctatacataaatctctgtaagcaagagaaggtacaagaagacatgagtagccatgcaacctagaaaatgttcttaataaatttcatgtgttcagaatgttaaagacaaaagccttcctgacaaaatgaaggcaactttgcaaatgtgagaccattcagtcagtgcccccatgggtgctcctgagagcagcatcgcgctgggataagtttttcctctttgctgtgtgaagagagggcatgtggagtctacggaaaaatactaccaagtgaggaagaggaacatcatcctgagcacttgaagaaagagcactctgatgaaaacaattcacaaatcagaagaaaggtttagaaaattgaggtcaggtggtggtggaacagggcagggtcattgtgatttctccatggcaagagtggaaatttggaaggacagatcaggcatagatagaaagattttaaaatcaggggaaatcacccaggaaatgtacaggtactaaaaaggcaatagtcaaataaaaacccactttggaatcagcaaatactttgtactgagaaaaagtaaattagctaagtgaagaataagaagaggtgctttgcagaagaaaaaataaaactggttaaagaaatacatgtgattactatggaggatggagaatgagctatagaaattcctaagaatgagagaaattcttgaggaagaggctagaactggagctaacatagcaacaatacaatgaagaacattcttctgagctgaacctagtgtcagttttcattgaaagccagacaaagtgaatgaaaagatgaccacacccagataaatcctggcaaagcatatgttaccagtgtaaaaaaagaaaaatcttgcaaacaaagtcatgcctatcaaagaattctcctttagaataaagcagaaaacaataaaatatctagatacttttgaagggaaaaatgaattccaagaatgttttagtcagataaatggtttatcttctataaagaaatctaagatgctttctcatgtattttaagtgtcacaaaacataacttctacaccctcagtttgtgccagccaactaatagctaagtacagaatagccccaaaatgagagacttgtgctataaaatgactgggggaggtaagctctggaactattaacatatgaaaaatttctaaacattttctgcaaattataaaatgccagttgtaaactgttgagaaacacataagatgtttatctaaaattcagtatctaaaatgccagatttacatccacaaaggtgagaaaggggtagaaagaggatgcaggaaagggcatggagatatgaatttctgcaaaatgatgtgtattatgtaggagcaatttaaaaactaacttttcagtttttgatagtaagtaaaatgtggattgaattttttttaaaacaacaacaacaaccttaagaggtatatgttttccaaaccttgagaggaaagggtaggaaattgttattcaaaaataataggcagaaagcacaaaacagagaagcaagcttgaagtgtattcagattcatttttttaaaaggctcaatctatgtgttaattctaacctagaatcagtcatgtagttttgcaacatattggaacatacggaacaacatttagctgtagatctttgaccctgaagggatgttgacaatctacaccattccctcctacagtatggaagctcccctctgacttattccatgtggcagccctgtggaatggtcctaaccacagccagacggggagttagcattaggcccagctgtggctcagcctcgctgatgactatgcctgctgctttcaactgtggttgtgttgtaagctaggtggttgttggaggtgccgcacaagcttggtgacacagcatgaacattgtgccaggataaatgtcatgactatttgagctaggtttgaccttcagcaatgttgtgaaatctgtgcccttatgtagaaactatttgttcatagtttctcagcattttcaatatattttttaattgaggagctttccaaaacatactaaaacctatcctagcctttacccttccaaaaactggagtgcttcttcagtatctttagcttaaacagtctgtattcacgcttgctttttttttttctttttttcgagacgaaatctcactcttgtcacccaggctgtagcgcagtggcacgatctcggctcactgcaacctctgcctcccgggttcaagcaattctctgctttagcctcctgagtagctgggattacaggcgcctgccaccatacccagctaatttttttgtatttttagtagcgaccgagtttcaccatcttggccaggctgatcttgaactcctgactacatgatccacccacctcggccttccaaagtgctgggattacaggcgtgagccactgcgcctggcctgtactcatgctttttagcacataattgtggttattattttctatcttatgacatgaaatgtctcttccagaagaaacctctaccgtaggaagcaagaagacaggatttttttgttacttgcagtacatttcttattctgtcaaggcttctgtagcttcatttttttaaatggcagtacttctggaccgtagaccagtactggctagcaagcaaagcttcatctgtatttacagccactctccatcacttgcattaccacctgagctccatctcctgtcaaaagcgtggtggcattagattctcacaggagcacaaaccctgttgtgaactgcacacatgagggatctaggttgtgcactccttatgagaatctaatgcccgatgatctgtcactgtctctcatcacccccagattggactgtatggttgcaggaaaacaagctcagggctcccactgattctacattatgctgaattgtataactatttcattatatattgcaatgtaaaaataatagaaaaaaagtgcacaataaatgtaatgcacttgaatcatcctgaaaccatcccctgcaaaactagtccctcgtatcaaaaaggttggggaccgctgctctatatgcttgaaggcagtgaggtacaccagatgattccctgtaattctctgcagctctgagatctataagtgtctgtggaagcctgtgtgtatgagacagagggtttaagcttaatagaaaaggtaacataacacattattaatctcttcatggcaagggccacaaaaccatgattttttttcacctaccccagtgcttagaactgagtagtgaacatagttgatactccataaggacttttgtttgcagtgttgtttttctttatgtcccttaagtgtaccaggagcaaggtgaagaggaatttgggggctttggattaggagtcaagacatcccactggcaaacctgcatctaatgtggcctgaaacaatccacttagagttctctggttaaatttcctcatttttgaaaccaaagtcttggattagattggggttatagactaatagttggccagtttgtctagcagaagtgtattattagacctgcagggcgttgaatatgttttggttgctgttaatttgaaagccattaaaggaggtgcatgtgccttgcatttcactatggtgcttgccactccctattggataatccaagtctattccactcatctacatttcccttactagcttttagaggcatttgatagtaattaagaaaggtaggggagagagttagattttaaatctaaatttagctcttctgctttgcaaactccggacagtcagtgtgcagaggtttgtgggatttttttaatagacattgggggtttaaaaccatttgactaattagaatggattgatgtgggaaaaaatgtcaacctaggaaggcacaccagagaaattccaaatggggtttaaaatggaaatagaaaagttgaatcaggctacttgttttcaggtgctttctcttcacagtcattagtttgatctgaactacatcaaaatggccttaatggccctagtcacaagagctattacaggttgtctaacttggttaaattcttttctgctctaaattgttaatgattcagcatttcatggcttgagtcaggtgttctcagtgggcaccctccataaaggtcagttgctttccagatatcagcatccaagtttaaggtcgcagattctgctcagtgaccttgagagaataatactttattacgcacaggctcagaaagcacagtttcatggagggagacctctggttggcaatgacaggaaaagcaaagaggctgatgaaaaaacagagtgccaagaaggcaggggtgtgggattgaggacagctctccaacaggcgatacatgttgctgtggaagagggaggagaattccctgtataccaaacacagttaagagcttcacatcacatcttacctgtctcatcctctcaggaggccaggaagtaaacactatcatcacaaggtcacagatgaggaaactgagacttggaaaggtgaggtaacttgcccatgtaagagcattttcagagtttgtacatgaaatatttcatgaagggcctattactattctctgcacactggtgtctgatgaatgatttatgtgctttattcgtttatgatgatattatggtgtctgaaaatacatttctagtaaacgttgacataagaacccttttgtcacctgcatgggattgtcagtatgaaatttacaagactgaaacatacacattccaagagggagtgtggtggatgcatgacagtttttttacggagttgatagagatcatttcatgacattaataggagcaaaaaaacaaaaagtagaggggagattttgaggacaaacagaacatcggtgagtaagtggaatattagggcagtcggcaaagaaatatacatttaaaaataattggcttcaaatttctaagattctgtgggaggctgagggaggaattactatatttttttatttgcaaaccagcaagtagatgatttgtgtactggaagggggaaaaaaaaacagtgatgtttttctccccttatggcatatagttaccagcctaggtttctatttttactctaccctagtccctgtgcatgattttcccttatttagaaaacttgcaactacaaatgtattgaattcattttcttacctttctgctaaatatagagaacaatacctatattttcatgcctagggattattttaagcagaattgagaccaattgaagcagtccttatgtttgtatcatgaaaaccaattgttttggtttttgagttttttattattttaatccactctggaagatgtttctctttaggagtaattttttgtattacaaattgagcaaatctttaaggttctcttctacagagacaaatctagtggttttaggattgatgaaggaaactctgggaattcctttcatgatacttgtaaggagtgaaaaaacaaggagaaaaaattgtaagtctagtagttgattggaaaaagttaaagtttcctcttggagaccatgtctaagtatgataggagctacaggcaggagagaaggagagaaaggaccgagtgtcagaaatgtgccacccctggaattgttccatcagagaggtgagaagtaagcccggaatcaaaatgtgagtcttttccttgatcatcagcaaactgcctttagaaccacgtttgtgatactgacaaacttactgtagtttcagggcagcttgattacagagactttgagttgtccattagacttgtcacactgtccaataaatgttcccccatcgtcattaggaagatatattcagtgccccatgatatgctccgtctaatctccatgcctttgggcctgatggtttatagcacatctttgtcttttaagtaacagaagacacaagacatgttgactacactaacgtgtcttttatatgttaaatttggacttttgtgtagcaactaacatgtcagagctattgtacattgaccgatattccatgtctccatcagggtttatgccatcactctaaaaaggcactgcatttcccttagttctcttattttaaaaactggaaaaatcaagctatgatgaaaagcagaggtctcaagacaattgaggcaatgtaggacataagtgaattgacagtggtgaatttgcagtttctaccaggccctctttggacctcagctagttaattgtgtgaaattataatggaaaagagcaaaattaaaaaacatggcaagaggcaggaaacatatcactgaatattatctaagaggtatggtatcgtgggatttatgttttatagcacctttatatgtgttaatccattatttgacttgcatattttactttggtgcagcttttcacagatatgtgatgcaataagagatggcctgtagtcatcaacaatgggtagctttactattctcacctgtaatcttagcactctccagtccattaagaagccatcaaccatggctcgtttgaatttactttctccaagaagtagtcttcatttgggcttagatttcacctcatcctccctttgggctgctttaaaattataggagcacatataatcacacttaacatttacttgtagataactttgtatatatatatatatcttcctccatcaaccaaaatatttgttccttgaaggcagggctagcaatttattcagaatactttgaggaaacatgggctattttagctagttaccttggaacagtggacatagctttgcctcctacaaattagacattttgaagcttttaaaactgcattcagcattccctcagcatactgattcctttcagcttgctgctacccattgggtgctaaaattttttgttctaaatacatgtctttcaggatcaaggagctttgaatatgggttttgtattttccttttatattctcttcaggtctttctaggtgacaatcatgtactcctttgcctttgtgtttccaccctgagatgccataatgaagatggcatttctctacatttaaggtgtagagaaatgtagtgatttgtgtcttctttcataccaccccagagagatggaatggccattcttgatcatcagaggtatttggtgtttaaatatgccattaagagttgctcataatttagctgtccagacattagagtaggtttcatttgtgctcgtgttagcattcatgtcttttagataatttacagaagagtgtaattttctctaaaaagatatctgtaagggggaacacttaccaatccaattacattttcgacttcttctttttctgtactctccaataattttgctggacttttcaagaaaaacaggatctcatatttttgtatatgtcttcagtcaatgctaattttagttttaatgttccctctttggtatctcctattgatttggtaagcgttacctttaatcacttaaaagtaagtaatgcaatgagaccgcccaaggctaacctatatttggaaaaatcgctacatttaagaattaatttaacaacagtctattacacattttactttggaaattcaccaggattctttccttctctgtgaaagcatttattacccagaagaaattaggcctaattttagagaatgccactgtgagccaaactgccttacatttccagaaatctccatgactctgactttaataataatgtttaaaattcacagaatttcagtgctaagagaaaatgaacggatagcaattgtaattagaatactaccacctaacttaagatattttgaagccatttaaacagtaaaatgaggcacagaccaagggctgttgctagctcaggccaagagggtgtgacatagtggcatggataattttgtttgggtttgtattatgtttggatccacatcacccagtggtcagcatggagggcttgatatggaaagaccaaccagactgtgctgtgtgggtgacgaaatagaaacaaagaccttagatgcctctttcatgttactttgctgagaagaagagtagagaaatgaaacagcagttgaaggggcgggagtggagtcaacggacattttattttattttttcgtgataagcagtaactcggataaaaatggtgcagtttggagagagattaataatgctacagagagggaaacttcagagctaagaaaatgttcaaaatacaaaaaaaaaaaaaatgcatggcaatatccttagtgttaaaattgctcatttcactctctagcctaaaatatatttttgatttaaggacttttcttacccaaaacctgtgccacagaaaatacctgtgaaacaagctcactcatgcctggcttgatcacaataactagggtttttagatcttccaagctgtggagaaagtaacacgtgaccaactatagcataacgcaaaagtaatctgtggagtcattactgccagtcagcttcacatgggagcaaaacattaatagttttcttggtcatcagctattgagttttcagttgctcttctccaagagcaacagaaacctagcaaattgggcattttatttttcagcactcaacctattcgttgatggaagaaaaaaaattgattgatttttgctaaaaaacaaagcaaatttgaaagaaaaagtctcaattgtttcttggagcagaagcttcctgcatgaataaacaatacaaagcaaccctgtctttttttttttttttttgagacggagtcttgctctgttgcccaggctggagtgcagtggtgcgatcttggctcactgcaagctccgcctcccaggttcacgccattctcccaaagcaacactgtctttttgcccctgacatgctgacagcataccaacactccagccgtggtgtgaggcagcctgagtcaaagctcgcagtctcgctagtgtcattcagctctgagaatagcaattttaaataaacatttgtgacatgttcgaaatgaaacacaagcaaaatgaatatcaaacctacttactatagaacatcactcttcacagtcttttttgttttgcgtgtgtgtgtaaaatttcagatttaccaaaaaattgcaagagtagtaaaagaaacttttgaagatccttttccaagattcaccagttatttacatttcacttcatttgcttattctccccactccttccctttccttctctctgtcaacctctctctttccctctccttccgattttttccgtctgcttccccatatgtgctttttaaaaaacgatctgaaggtaatttgcttttaaatacttcaatgtgtatttcctaagaacagtaatgttctcttacataagcatagtacaataataaaatctcaggacacttaaaattgctgtaattctattatctgatccacagtccattttcagattttgtcagttgccccagtaatatccttcacagcttttttttttttttttttttttaaagagtacttgttgaagcattaatggtgctacctatggtcttgtggtctggctccttataaagacagtgggaaaatgtgagagtgagaaggatggtcacccatgtgtaatattaatctccagactatagctgtgctgtgtgatcatttccaaagtgtgccccattaaatgattgtttcaagaaatgccgtggaaaataaagatgttttgttcaaagctgaggaaaagcttaaacaattctttccccatgctcactgcattcactccttgaagatgtacaagagtgcattggcttataaaagcatctgaacgtttatgtatttatgccataaggagactgtattattttttaactcaaattctctaagttaattgactatagcgcatcctactgaagccctcatctacctatacagagtttattttggaaactctgctatatttttacagtatttattttgctttaaaattttctcttttatttatttttattaaaattgtgagctagtcaaccttttaaaacattgaaaatgactgacattttatgacaaaaatgtaagatctacattattgatttatcgtatatgtacagttatagatagaagatcagtgacttcatatcagtgcttaaccgtgtgaggcaaacactagattctgtaacaggcaaatctatgtcagcagtttaacaaaatagtttgttgctcactcacctggaaacagtggctgcctgggatgaaagctctgctcagttactcaagaacccagtctaaaggaggttttgccatttttattgcaatggctccccatatcatcttgggtgttaacatccacacagcaaacatagagtgagagaacacaaagaattgtaggggaaatttgtatgggactagccagtgtcatttacatgtacatctgttgacaagatttcacccacaacgtcatgactgatggaagaggggctaggaagtgctaaccctggttgggtaactgctttaagtagcagcttcaaaatatgaaaggtgaacataaatttttgatgaactaatctccagaagtctataatcatgcatatgtaatttacaagtttaactttgatattttgttaatcatatgttatctcacattgaccctaatgagattgggaaggcaagataaatatacccatttacaaatggagcagctgaatctgacttttaggtgatcagagtagaataaaatggtttatgtgcatcagatttttttttattggttactaatcaagtatctttgtgtttttcaaaagtattttagccttaattatactttttaggagaaaattatacttttaggagaggaagtttattgaacttgccatagtctccaaatttaccagggaattaacaaaagtggcccaaggtgctctctattaaaataatttaatacaaatagaatttttaaaagatataatttccatttgttgacagtggtgaaaacaggaagtttgtgtctgttgattctggggtttcactttgagtaccatggctaagtaacagatgagagccaaaattaatcatcaataaaaaaaatgactaaaaatataaagcatgcctcttcaacagtttttcataagatataaatatcttgaaaccactaaaatgaaaataaaacattacagagaaaaaaaagtcatgtaaaatcccaaacctctattttaaaaaataaatcagtgttatgaggataatgaacttaatacttactatttaattaaactttaagctaattagtctaattaattcatctgataagcatcttaatattgccagcattaagctgaatcttctagaatgtggttttaaatttggagggagtaatttaatgatgcttaatattggttgtttacactgcaaaataaatttgatatgttaatggatgcccaactcccatcgcattataaaatttatgttgattctcactgcttctatcctgcaggctagcctattcagtattctcacaacacactatgttttcttattagagcaaatatcacagccaaaaaagtaatgatttgttataatttatgtaatatatgcctttattctctaaataatgttaagctccatgaaagcaagaattgtttctgtcttggtcactgctgaattcagagagcctagtgcacgacaggctttcagtagacaatggagtacatgaatggatgtcctcactgaaaataaagccagcagtgcacttagagatgggaatggtgtgtactggtgggttccagcattcaagatcagtaaaatgtaggctaaaacacacactctttactaccaataatgtccattaggtacccccattcttggctataccattttttaagtaaaatggatagagttaattatgttgtttctggtgttgcattttccattaattgcacattgatctcatgaatatgaaatctctggtatgagaaaaactcaaggtctatggattgtgtttgttatccattgctatttaacatagtggtttgaaacaacaatcatgcttattaacttccacacaaatatttttatttctcctatgatttagcaatttcacttctgggtatagatcccaaagaagtgaaatcggggattgaggcagatatttgttcactagtgttcatcgtagcattattctcactagacagaaggtagagcaacccaagcatccattgacagatgaatggataaataaaatgtggtatagacatacaatgacatgttattcagccttaaaaagtaaattctgacctgttttgcaacatggacaaaacttgaatattttatgctaagtgaaatcagtcatttacaaaactcaaatgctgtatgattccccgtgtgtgagatagttaaagcagtcacattgctagagaaggaaagtagaaagatggttgccaaggggtgaggggactggagagttattgcttaatgatacagagtttcagttttgcaggataaaggttctgaaaatagatggggatgctttcacagcagtgtgaatgttcttaatactattgaactacacactttaaaaggttaagatggttagttttatgttgtgtattttaccacagtttaataaatgttttccgtgttgtgtctagcattttataattccccccacctatacagacccctgcaatctcatgaccatcaataagctcccagtatgtttactttctgatataagccaacttttgttttcaaaaaagacttttcctaccattttcccatcactcaacctaaacaaaataatcagtccttttagaatttttttcaatttttgtcactggtggtgagctattagtttattttctcttgtcacatgtaaaaggcaatataattctattcagcttaccaacagtgaataaaataagagttagtatgtggacaaaatgtatagagttctgtataggttaaaaataattttaaaaatgtatattgcatatgataaaatatagataattctaaagtataaaatcaccatcccagatactgccttttatgatgaatcactttttaatccattcagtcattgaatgtctaccatgtgctaaatgtttgcatctacttccatttcatctacttatgtactcacaaacctattcataattcactttattcatttattcttttaacaattattgaaagtacctatcagatgccaattattctaggttccaaagatgcaaaataaaaataaaaaatatctgccataaagcttgcattctaatgtggaatctgacattaaacaagataaaaaggaaaatacctatatttcagacagtgataattgctaaggaggaaaaataagtcatagatggaggttagaaaatgtcattggaggattagagttgaaagtttagatagtccaagaaaagcctcacataggatactgagtaaatatctgcaataagtagaggagttatgcatgcacatgtctgggcagagaggatcagagggagcagcatgtgcaaattcctgaggaacacgccatatggatggtgtgttcaagaaacagaaagaagtgtccttctgtgtggctgaagcactatgatgacaggatagagtagtagggactagatcatggagtgtctgtaaatcagaacaagtttggaactttaatttttagtgacagaggaagccacttcctaatcagaaaagcagtgattatagtttttatttaaagcatctgtctggctgctgtaatgagaatacacagcagaaggggagaggggagaaggaaggggatgaggtagaacactattacaataatccaggctcacagagtggcttggaccaaagtgacggtgaagtagagagggtagtatttttaaaggagagttagtagaattttctgctggatagaatgttgattgtgagaaaaggagaaatccaggataacaccagtcttttgactttgaagattccttcagaattgttcagaaaactctcttaggaaaaaagaaaaagcaaaaaatttgactgcaaatgagaaatagcccactctttggatttgttttatgctgagtgtatctgttgtttagcattattttcctgtgttcgaataagaacaaagaattccaaagtgtgggctcccccaggtctagagcccattcaaggcacagcgtttgtggtcttgggtgtttcctagagttcttggtggttgagtcttgaaccctaccctttaattttctgttcttggttgaaatgatcattgcaaacatctgatttagattatttttccaggctcttttaagctcatctgtgttccctctgggtctcagagaattgctgcagtaacaaagaaacaagttaatgtactgcacaccttaccaaagccaaaggagacgttgaaatgctatactacttaaccaaatctcagagaaccctcacttgatgaatacatagtttgtgttttgtatatcttttgcttatttgaaaaatgtaaatacaaccttcctcctacaacagaaggggttgactaggcagaatttacaaaagctggaggagcaagcacagttttcaagcacgtattcattctctcattcactcattcaaagaaaatcttagcaaatgacttgcatgaggcattgtgacttacaaggctagcaggtggtttcacttgtgtttagaagtagtgatgcctgagtggcagatatttagaacgtggcttggaggttaagactgatgtaggttagacaccatttcagcaacttcctagccatgtgatattaaatatgtctgtaaactctgaagtttggtttgctcatctgtaaaatggggatagtggtactaatctctcaagatttttttgtgtgaagcaagagaattgatatcaagtgtgtagtgcagagcccagagatgtatataggcaggctgtggtttgcattttaatttgaattataggcaaagccaaggcatgggatgtgatgatacatctttttctctcgtaagtcgagtagaagatgtatgcttttccaggcattgtgtgcatggtggtagcatcagagtttgagacaccgtttcagtaacttaggaaacagaataaattgagagtaaatgatgaaattctccaagaagtctctctcattcctctcccatgacatcagctgaaaataatggcaattgagaaatcaaagacaaaaacatctcaggaagaaatgagttggaggtatcaaaggaagccagggtggaggccaaggtaatcaggcttgtgaattgcctgctgcattctagcagttctgaggctctttaaataaaaggaatgagggttatgaagtgagaaaatggggctgctgcaaagcaagcttgcttgagcactccttatcattatgtgttcattctggaaaaagaaaacaactcacagataaaaggaaacgtaaggctgctgatgcagagaatgggtgtcctctgcgaatcctaatcaagttggaataccatttttcattcttggcaaggaaaatcaaattggtcttttatacagaatacgaatctcgagctctaccctggggatggtagtttggggagctgggcacaggggcatggcagaagctttttgttatcattcatccataagcattatattccaatataaatgtagtactttgttctactaggtaaatgtcctcatgtaaacatacatgtgcatatttataaaattaatcattatgcattttatatttctatatgacacatatagttgagccatcagtgtctgtgttaaaaggtacactttaatatagaagtcataaaagcatagcattttaaagctgaaagtgatctttaaagggtttggtacacagcagaaagggagtataaggcagtagtatgattggaagctctagggacagtccgctcaaagctggggttcagctccaacatttaagcctctgtgaacttgagtaagttactgaaaccctccttgccttagttttctcatccataaaaatgggataataatagtatattcctcctatgggtgttagattgaatgatataatctgtgtaaatcacttaacacatagtaagtggtcaatgtatgtttttattattatcataaacataatttttacattatcatctttaattcccacaagttgttgaagtatgtatggttttatccttattttatggctgctcaaccaaaggcccaggaatgttaaattccataagtaataacagtggaagcaggaatcaaacccaggttttggaaactcattccaaaacccatactctcaggccacacagtgctcataggtccctctccacatatttaatcaatgcctcttagatggtcacctggcacatcatcatgtccttctctgccctaaacactcccctgctgaaagaagccagcgagaatatgtgaaattgctttgcagacttcaaagacctgtagaagctcactcatgttactgtccataaggaataaaagcaaaaagcctatcaggatatatacaagcataagcgcccagaaaatgctgaggactgctttaatggagtaatggagaacactctttggtgtcttgatgtacttgtaaatcgaggctaaatttactaaatgtttctatttcattttaatacaaattccgatagttattcaaaacctaaacttaaaaattatggttttcaagagctatgatgaggggtttaaaataaaaagtaataaaaatcagggacacgtgtgtgacatgttataataataatagtagggatataatattctctaaatctagtagaggatatatcggtgctgggatatagtttgtcagctttctaaactcttcaccaaaatgtgtaaacaaagtgaatttgtctcatttgagatgtctagaattggtgatttacataagagactttatgtactttcaaagcttatagtacaatttcagaaaaaaacagttattagattttaaactgggcattccaggtttttccttattagattttaataagggcattctggtgactaaaactaaggtactccattcatggcaaataactatttagcataattgtttgcatccttagcaacaaacaagctgtttccagtgtgtaacatgaccatcaggcaattttataagaagctgttaaagagtagataggcattcatgaatgccacctggttcaaaggactgatattatagcaaaaacaaagacatggaacctggaagtttaaccataatactgtaatgaaacctgggccatgtgctgtgtggtacattctatgctcatcactggggcttatcaacatggaaagtttgatgcttagaaatagaggtattggccgggtgtggtagttcacacctgtaatcccagcactttgggaggccgaggcaggcagatcacttgaggtcaggagatcgagaccagcctggccaacatggtgaaaccctgtctctactaaaaatacaaaaattacccgggcgtgcagcatgtgcatgttagtcccagctactccagaggctgagacaggagaatcactcgaacccagtaggcggaggttacagtgggccaagatcgcgccactgcattccagcctgggtgacagggtgaggctccatctcttaaaaaagaaaaagaaagaaagaaaaaaaaataggacatttactaggaatataggagtcctggggctgctctgcttctggtcactgtggagcctgggtgagtcactgtttctcttagcagccttgttttcttgcttataaaagggaatttgactggaaactaaagtgaagtctatccagtgcccataatggagaacatacatgggctcaaaatggcccttggctatctcttcacattagaaacttacatgtcatcactgcagaagtctgaaacagctgcttcattcctctagtattggaacagatcgtatcttctttgatgagtcaccagatgccagatgtagtaatttgcttgtttttaggggcagtcatcagaatatatgtatataatgaaatgccagaatcatttgaatatggcaagagactctgtgataaagatatgggggactgagcttgactgaatgtcaagtcttctctcatgctcatcctagggtccaggctgtttaaattgtgttcatgtatatttatatgtatttcggtgtgtacatgtttagttgccgaggttgagttatttgcagcaaggatatgctgttgaatccacacaagttaaatatgtgtagcacattcaatgccagaaagagacaagaagagggatgaggactggatacttcgcattgctggaatggaccatgttctttcttacttccaaatctttgagtatgtggttctgtcttcctacttcgttagtctactttactctttcttagctccagttctttcactagctcttaatataaatcccttcttccaggaagccttctttccttctttgattgcctaaatctatgtgagatgtccctcctgtatgcttctgaatgattgtgaatgtttcctatcaaagcctttcttgttctgtaatgtgatttcttggtgacttggctctctttcactaggataggaattccaagagaataagaaccttatctatctagttgattgagcttgtgtgccagacactgtgctggacagtgacgatagaacaccatatgtgtgttgaataatcgaataaatgcacaaattaaaaagttaagtgccaagagagaattaactcttgagttttatctacagagagatgcaattaaaaaacatctcaaaaagatgtgcatttttttcccccatccactattattgtcaatggtatcagatgtgatttggggtagtttctaagagattttaagaattctagactctagggtaatgttctctaatgcaacactatgaagacaaattgtgccttttgtttatgtgcaaactttggttgtcactccaggccttgggtgtcttaaagaaggagcctggggcttgttagttattgaaagccagttattccaaggtgaacctgcagttctcatatgacctaggaggaggactcaaggatggactcaggcaggagagatggcaggttgcgaaagcacaccaatgctgggtgggcagaatgtcttctgaggcatgggtgggtggtgcaggaatccagccagaaatgcacaccattaaaatcatcaagagaccactcaaaagtgtaggtaatccagagtctgcatttagatggagtgaagtgcagtggaaagagcaataacccaggaattcagagacctgagctctaattccaccttgactagtaaccagtcctatgcctttcacaaaccacctttcttttctagcttcattttctctttctgtaaaatgagggtaactgggccaccccctaaatttaaagtctagatttctctgtaggcaacaggcaccagggcactgtggtagctggttggtcagtgggaggctttgaaacagggttccctgcacatattttttatgctttttaagtatgattgcaagtaagaagttaaataagaaacagggtgggggaagcaacatagttcttcacaaaggtggtacattttgaagttaaagataaaaccatcaggagaagatttgtttaaattcaacaatcctcactggtattttattttcacaatatatttggacaaaggtttggacaagtgatacagaaaacatgttgaggatattagagttagagaaggggtccaacttaggccatctgggaactctctctggaggaggtaagagcttatctgggcctgcaaagaagaaaaggacttcgactgatgattctaaagtgggagggaaggcagacagaatcttccagattgagggaacaccacaaagaaccagagctttacgtgctcagagtgatggatttagatgcattgttaaatattaccgacattcccattttttgagcagtggcctgcactgtgctaagtgatatttacatgtattatctcctacagttgcccaaactaccctcacaggtctttttcattactgcctctggtgttgaatgaggccaggtggagatgtaggaaaagtaaacattttgcccctaagcatacagttaaagtcagagagtgaactctgaatcctcaaatccagatctcctatcaggtaatgatgactacagtgtttcttattttgttaggtgtaaatatggtcagaatgccttccaatctgttttagtgatagtatagttattgagctttccttagtttacacattcacaagtgtttttgaagcactgaagtccctgtgctgaatcagattgtgtggtcagcagtgtgatctgaggaccctatagtgtgtagggtagggtgtgacaaggtaaagagggtggactctgtagccagtttgtctgtgactatcttctgtgtgactctgagaatgtcccctggtctctctaaatctaaattttaacatccattaaagtaggtgatgaggattaacaatatatttaaaattttaatacaaatattaacatagcacaaagtgcaaatacaatacatgtggccaagggttataatcatcgtctgcattatcacattgaatggatgaatcactggacttaagcataaatatctgagtttgcaacttttaaaatgcgtgttgtttaaaaagtcagctgtaattcaggaaattcagtttctcaactgtaaagtaagggtgctaatagtcccttgcgatgccgccatatatcttaatgaaatgaaggatgtggaaatattttcagaagtacaaagcctcatacagatgtaggtggtattttcctgatggtgatccccttggggctccctcactctttagagcttcggagcactccaagtgttggagggatggggcacaagtgttggcttttttgtttgtttgtttggatgtcattacattgaaatcagcccaaaccatctcaagctcatcccagtagtccagaaagtttttaacattcccaagaagtatttcaaactggtcagccaacttaaggtatgtttattcattgttgtttcttgttttgttacttttttgtggggagagtacacaccagttaaaagtgtactttaaaaataatactatttatgaacagtcaggaatgaacatttcagaatgcctaatggattctgaaatcgtactgcactggagaaccatcaagcatacacttccaaatcaagaaggccttggggaatgagtttgcctcccatttccctctcattcatgcttagtaataaatggttttattgtgaagtgggtaacacagaagcacatgagcctcatgcatttgagtatgcgacagctccaagtggtgttgtttgaaagagcatgctatgtttaagtgtaagtgtaatcaatgtgtggtgacatttcaagattgtagaaattcagattctgtttctgggtgcagtattgaacaccggattcagaaacgactgttgtctctatcatgctacaccctggcaaatgattaatgtgcttttagcttaaataattgggaggggggtgcctcagggaatgctaaacatatatttaattgctatacaaatatgtcatttccttgctaattcaagttatgcatgggaggttatataataccagagagcctccaagcatgatgtattgcacctataagctgagtcaagggactaacagggcccagctgaaggcaaaatattctttgctaactctgtcttagcagatgaagaattagatgttgaagcatgacatggctttataaaagcagaattattgtttggcagagagtatggtctctaaataactttctgagatgttgggaagaaaatgcattttcaataagaaaagagggcccaaaaacaacttcaagaaaaatatccttatttaggggaatgtgcatgttgaagaagaaatgagtattgcctttgacacaaaataaaatatacaagacggtgcaggacattagtttccctatggccacgttcgtattatagcctaaaactgaccttatttgttttgatacctacaaaagcaaaggtttctttaactccaattcttgtgttcttccctttctatttcaactcttcatctcagagagggagagagattctaagtaagactcaataggtatgaagctgtgctaaattatcttttcaggctcagttgatattgatggattgccttgctttaagagctgtgtaagttggatttcacattctgaggttacaaagaggtcatatttaaattttggagtgagtctattttttgttgacaccaccaccaacctgtgattctgagttatcaaaaacaaatgtgtgatagccgggcaaggcagctattgagaaattcaagaagtgagtggaagaactgtattttttttcttaaaaaagcctccctatgatagtttccttgaacacttctgtttgtgccatagaccctggttcattagcagaaagacaatagatggattaaacacagaaggcagagtcattcaacgaccagatgccaagcaaatggcaatctttggcatatctagtgttctgatatgggcagtaatcaaacgactatcagatgtgcccaatcagttgttatttcatttgcaagggcctgaaggtatcatttaatttaaagcacaatggaatcagaaatcatttaatgactgattgctgtttctcctagaaactgattttggatttggcagtctgaagaccccaaagtgccagagtctatgcatgggctacattaaaatacagctaggatcttgaatgagttaattagaccagttcttccaactttttcagcaatgttgtgattcttcttgacaaaataaatgtaacttctaaaatttcctcccactttttctaaacttccaatatttttgttctataacttttagcaactgaagaggaataatagcaatccattagtattttaaatatttccctaagcctttaaacataatacagatactattttgaaatatagaatatcgagaccagaagatctcaatgccagccttgtaaaatcaaggttatttgtacaatctactaggatctcattacatgtacatactggaaatgtttatttgattctgtaatgagtgtaagacaaggggaaggtacaatacaattcttatctagagtaaggctgacacaggacttatacattgcctcccatcacactcccacaaatgtatacatgctcaaatatttgaataggcacaggtttttgaagcttcccctctccaagcctttcaatgataaacctctgcattttattcccctgggacttctgttggctacaaaagctgggggcaaccagaaccttaacaattgtatatttctgcaagatatatccctatttgaaattgtgccatggagggcttgcccaaaggtgggaagctggagaaattcctggtctttgtctcactggttagggaagccattcatatatccccaaactagggtttccctcctcatacagagactggatgcctaccccagacacttggtaagaagattaaaactcctacttttgaagaactgggactatctccagaaggatacaagtccaaagacatctgggagttatagtattgtttgctttgtcagccacagtccccagcctttttggcaccagggatcggtttcatggaagacagtttttccatggccagggcaggaggcaggggaggctgggggtggtgctagagggtttcagaatgaaactgtcccactgatctgacaggaggcagagctcaggcagtaaagctcacttgccccctgctcacctcttgctgtgtggcctcattcctaacgggccacaggctgatacaggtttgtgtaccaggattggagacccctgatgtatagtgtaacgattaagaacaaagagtctgaatccagatttcatgtgaccttgagcaagtgattaaatttctgtgcctcagtttcttcatgataacagttcatacattagaagcttgttgtatgactaaataatagtggctggtatatattatgttacacacacacacacacagagccttatgccacatattgataatgggggttcgataagattattgatggagctgaaaaatttctatagcctggtgatgtcatagtcgtcgtcttatggtattgaaacatgttactcatgtgtttgcagtgatgctggtataaacaaacctaccaagctgccagttgtataaaagtatagcacatacaattatgtatggtacataatacatgataatgataagaaatggctatgttatggtttatgtaattactatactttttattattttagagtctatgccttctgtttattaaaaaaaaaagttacatttaaacagcctcaggcaggtcctttagaggtatttcagaacaagacattgtcatcataggagatgacaacttcgtacacattattgctcctgaagatcttccagtgggacaagatgtggaggtggaagacagcgttgttggtgatcctgaccctgtgtagccctaggctaatgtgtgtgtctgtatctttgtttttatcaaaaagtttaaagtgggccaggcacaatggctcacgcctgtattcccagcactttgggaggccatggcggcgggtggatcacctgaggtcaggagttcgagaccagcctgaccaacatggtgaaaccccatatctactaaatacaaaagatcagccgggtgtggtggcatgtacctgtaatctcagctacttaagaagctgaggcaggagaatcacttgaacccgggaggcagaggtttcagtgagtcaagattttgccattgcactccagcctgggcaacaagagtgaaactctatctcagggaaaaaaaaagtttaatgcatatgaaaaaaattttttaataaaacttatagaataagggtataaagaaagaaaatatttgtgtacagctgtatgatgcatttgtgcttaagccaagttttattacaaaagagtcaaaatgcttacaaaaataaaagtttataaagtaaaagttacagtaagctaagattaatatattattgaggataaaattttaaaataaatttagtgtagcctaagtgtaccgtttttataaagtctacagtagtgttcagcaatatcctaggctctcacattcactcaccactcactcgctgacttacccagggagagaaacttccagtcccgcaagctccattcaagaaagtgccctatacaggtgaaactttgtattttaaatcttttgtaccatatttttactgtatgttttctgtttagatacacaaaaacttcccattgcatcacagttgcctactgtattaagtacagtaacgtgctatacacatttatagcctatgagcaataagctatatcatacagcctgggtgtgtagcacgctctactatctaggtttgtgtaagtacacgctatgttagcacaacgatgaaattgcctaatgatgcattcctcagaacacgtgcctattgtgaaatgacgcatggctgtatatacagtcagccctctgtatctgtgggtttcccgtctgtgtattcaatcaaccacagatagaaagtatttaaaacaaaaaagaaaagaaaaaggatagttgcatctgtactgaacacatacagactttttacttgtcattattccctaaacaatacagtgtaataactgtttacaaagcatttgcattgtattaggcattaaaaataatctagatatgatttaaagtgtataagaaaatgtgtgtatattatatacaaggactacaccattttataagacacttgagcatctgtggattttggtatctgcagggggtcctgaaaccaatctgctgcagatactaagggatgactctctatatacatgtatgtgtttgctagtactatcatattttgaaattttgcagggcaaaaaatatcatccaagtctaatattttcttttttgttgaaatgttcttaaattttggacgagaataaactaatgccttgggaaatgttgctgtgatttcatgagaagttgttgtgccacgttttaattcatagttaatgtctagagctttgtataaaccatttgaaaaggtgttgcaacatgtccctgttagcaactttagttcttttagcactacgtatattgaatgtattaggagtttctcaaatgcaagaaatactaggtcacactgataaaatacttacctttgtatggctcctgtttcagactctaagacatttgctatcttgcagcattacattatcatctcagtataacagtgatagatagcaacaagacactcatatctaccccatccatacattcaacaagcattttttgaggtccagacatcagaaataaagtggtgaagaatggacggggtcttcaacctcttagagcctacagtctggtgggacaagaagacactgaatacatgtggcaaaaggaaactgtgtagtagtgaaatggggaaagttcccttgccccctcttaggacgttccatgagggtgtggcttgcttcttcagtgtgcactattcaaacttctaaggggagcatacagataggcaggttgtagggctctgactccatggcagtgtctaggggtgaatgtttacagctgaaggcccggggggcatgtgttacagggtgctcttttagtttaaccatcataggcagcttgtgttagctcaattagacctctgacttattgcaaggacagaggctttctgtatcccagggttcttgccttggtgtcccggaagaattggatcatgtgtcggcttggagaatgagttcaaggttttattcagtgggagtagctctcagcaggtagggtagccagaaggcagatagttttcccttggagtcgggccccttggtggcctgtgctctcctctgactgccccagccaaactttgggtcattctgctggtcggtggcctgccagcatgctggtgcctgtcagtgcattcctctcgacatccagccacccatgtgctcctcccaacatccagccacctgtgtgtctgcctgcttgcttgggtctcgggtttttataggcacaggatgggggcgtggcggggaaattcaacatttgggcagaaaaacaaaaatgcctatcctcacctaggtctgtgggcacaggcccagggttggagccctagccagggatcatgccctcctctacccagcacttccctgccccgcttccatatcatttaaagggaccacgcccttctcttctcagcatttcgcttctctatcagtagggaaaccaagagacagggacaggacggacatgcttgaataaatgaaatgtaattaagcagttcctttactatgtggtgatctaagacctcaaatgttaggggtatttattttcacaagaatcctatagactacattcatacaagcttcacgctgtttgtggtacagtgaagccagctcacactggctcatgagagccaattgttaaatgttcaagaattttaccaataagtcagttgttaaacagctattattaaaattaaatcatttataaacatacagttaaataaattaaaagataataaatactcaaaactcatttcttcctacatttatggctgttgatgctcttgctgtgatttagtttattgtatctgtgtagcggtggacgcaccacatgatagcgtgctcctgtgcatctcttctctgctccatgtagagtgaagtcatgttaataggttgaaattggccatagtgagagtatttacaccacagaaattggcaagcactacaaattaagatcatccatctcccagagccattggtacatagttactaacaaagtgctgtcttactgcaatgtttgacatctagagcatccatctgcttctgagatttaactggctattcagatgttgtggaatgagctgagaggagccagaaccaggagccaggtgactcagattccagtacccactttgctgctggtgagttttgtactgtgggtatgccacttaacaaatgttggtcgttgacactcacaagagatgggtaagacctgattctttccctgaaaaaggccacattctaagcagtaaaagacaaagatgcatctaactaattacatcaattgtgatttaatggtgctttgggagtcagacaagtaagtctcatattggacacttgggaggaattcatgagaatacaatatgtggagtaggaactgagcagaatgtattggcacacagtaggtggaggataaccttggcaagttatgatttagtcatgtctggatcaaggatgggaagctttgtttggggggtggtgggaagtggcagtagtggatgacgtaagtttataaattaagatcagattgtgataagcagttgtgtaataccaatggagtttataaactattttttacacattgagtaatgatctcttcagtactttgaacataatagctccaataactgaagaaggggtaaattaaaaggattaatatatcagaaaatagctggaaaaccaatttgggaattaacatgatggagaagagacaatacgagagattgtaagaggtaacctgtactaaacagttgatagtgaccattacttatccacaaaaaggacaattattacatctatgatcagggccataatttagctacttaagttcctagacattttcacttttgggggctccttcctccacaaaaatatgtgtaagaattatattttgcaattgtgttggtataaaaactaatatgttaatgtgatataaagtattttctttgacgtaagtgtctgcttttttccttccgattttaaaagaaattaaaacgtttgtgttttaatttcattcctctaaaaatattgtggcccttggctttgtgcctgctgtgcttttatggatgcgccaattctgtctctgactcattcaaaaagttgatagcaaaagagggaacatgttgggtaagttattggaagaagaggaaacactgtgtaaacatatagtcttttgagaattcatattggctagaacaggcttacataatcatattgcactggttacttcctttgctattggctttatccgtgtattgaaaaatcacagtactggctgtatctgtccttaatttactgaatgacaggatgtgtgtgattatgcagggtatgtgcaaggtaagtgtgtgtgcattgtggaaatgagtgaatgctaaacaaatgggagaagcaagggctatttattctgagcttgctgtcgtaagagagtcaagccatcactttcattttggcagagactcaaaggcaggcagagggctttataatggacaaaagggaagactttaggaatgccttgcttgcaggctgtgccatggagaagctggatgcagctaactaggactagggcatcctatgtgattggttaggatgtatatttggctttctctggttggtcctaagttggaagctgagacaaaattagggaagctgtcagttatttaatgacgtcctggccattttaggccagattgttagagttattgtttagcttcctggattgtcagtagagacagtagtctggcttcctgcaagtctgacttttagctggctggctccatgagttgtttattgtagatgggggaatggttttctgggaaggttgctgcattttgtgggactcagttctgttttatatacggtctggccatcatccatttgtatattcagtctttcaacatgtaccaagctctgtgctaaactgtacatctaatcctcttcatgatcctgtgaagaaggtactccaacatttgcagagaggaaaaggatcattagcgaggttacatgatttgttaggaaggggtagagcctggtttcagacacatatatatctgtctgtagcctgtgggctttacgaccctgccctacagggatacagcttccttcgttgcaaaatgaggagataaactaagttaatctctagagttccttctaggtcaaatttgctaattcaaaacttgacacaaggagtcatcctacttagttatgactgtagttggtctaccagagcaactatttactgccaacacaatgatactatgagtttaattttgacatatccataggaccttgaatatgttcatgtttcttcacttagaattttgaaaactcagaagaactgaagtcaagctacctgggtaactgaaccctttttatgaagtaagccccggaggagttgtgcttccacactctccccaccactgcaatccattttcccctggaacgatttaatttcatgcacagagagagattcggcgtgggcaaagagaatgcactatcatgtcattcagtcatgtctgcgatttctcagcttctctccagtgctgtagaaatgattaattccttgggaaggaagccaagaaaatcatgaaaatagcaaaaatatttcgactgcaattgtggagcacataaacttgtcagtggagtgatgagaaaactgctgggttgcctctcattagcagcaaaatattttatttatatatgtagtttttgtgtgtttttattgttgcagggtggagggtatcaggagggtttggggcttaggtaagcggggttttggagagaaaatatttcatgcccttgttggacttctcaaccgagggatgctgagctttctgccaacagtattgattggttaatatgttttgagtgttccgcggtgtggagcatggtagggtagtttacaacgtgtgacttattgacctctggacagtattgttgaagctgtttcaagaggcaggcatgtgtgggagacagaaaaaagagtgtgttctcacaataataatgatagcttacactgcctgacatcttagtatatggcaggcctgctaaatgctgaccatgcactgtttcactgaaccttcactggaacttagaaggacctactattgtgattcctatttcgaataattgaggtgatgtaattcacccatacctacaggtagtaagagataaagctagggctcagtcccagtactctgactcataagcctaagcactagccattaggtcctactgcctctcagaaacaaagacgactggggcataaaaagggctttacagatattttggtctgagacttttaaggtctatttctaggaggttaaagggtcacaaaggagccctggaggaaagagtattgatcaggttctcatccctgcattaacctgagcaggctggcatttgggttatatattcagtatctggactttgtgtaagatctcctttggagagctcattccaataaggaggagggagagaatgaagtttgaaagaaaactttttttttctagtttatgttctttattttagggcagtcggtctgcaaactttttctataaaggatcaaagagtaaaagttttatgcttcaaggtctacagataatctcaattgcatattcttttttgttttgctttttataaacttttaaaaatgtaaaaaccattcttagctcacaagctatacaacaacaatccccaaattggatttgacccacaggctctggctatactttttcctctccgttctagaggacaaatccaatgttcagagaaggaaagtgatttgcctgaggttacacagctgagaccagaactcaaattgtccagaagagctttacaggccctgttgaccacactgggcagttggacgttcactgtgacctgtggcatgccagacacagtgctaactgcttggaagattaacatgtgggaaaagcatccctgtctccccgagcagcttagagtctatggagagacaagtcttaaatgtacaagttaaccagccacgcggagccctcctcaaagcagtacataagtcattgctaaacaagtgactgaaattttaaatgccgagttccaaggaagcagggtaaaatgatttttgacagctcccaaccaagagcaggcacaaatttgatgggtttctgggcaaaaggatctgttgttctccatctctcttgcctattgaaaaacgggtttgaatctgtcctgaggctgataaagaggcaggatttattaacatagggccctttgcttctgggtcagcatccaaacctttttaacccctttatacaagtgttccagggaatttgaaagctgtccctatgggctggatacatctcccctgaggcgctgcctgaagttccctcattggttattctttctgcttaggcattggcctttggtttaacatgcagatgtgtcatctgcgagacctgacagtctgaagtgatagagttgtgggtattattcacatgcaagtgttaatcagagtaatattatcatccagctaagctctaagagaaagtgcagttaagttttacttgaagggaaaaagcagtggaaaacccggaatgaagaaatgagtgggcagaaagagcctccctctaggtttgttgaggaatctatttagaatcagaaaggcctgttgggggaatgttctgaacatctgatggacaattgaatgaaatgatctattagtttttacccagctctagtattttattactaagattgttgggaggggagcagatgataaaggatcctagaaaacaaacttctttctttatagttatgcatggtaaagctggctattcaccaaaataataggtgccttcctgccataatgtggagttgttgctggcaggtggttacacacccagagactacatttcccagcctctcttgcattcagatgtgaccaagtgcatagttctcactcatgtaatataaatggaaataatacataccacttacatgcctggcccataaaattgccttacctgtacttccccatgctctttttctcttcaaacttaactggacagaggacttctagggtaaccttgaacatcatatattgagggtggcagagcccccattagcttggatcctatacctctttgggtatattgtctaatatggtaggcactagatgcatgtggctgtttaattaatattaaactccagttcctcagtcatcctaggcattttgtaagtgctcaatagccacatgcatgcaactaagtggctaccatattagatagcgcagatgtagaacatttccattatttcagaaagttctattggattgctatgctccattgtatatgagttttcatgtgatttaaaatttattgttgtaatagttgatctattaatattactattaatacagagataagtacaagattgacagaggctttgctgaccctcaaaagacaaatatttgctgggagactactttgtgttagtagtcttctagagtttgggaatttgtcagtaaatacaacagaaaattttccatactcaaagagctcattgttataggccatgtgacttagctataggatttctcaaggtgcaaatttaggcaaatccaggatttttgaatccattatagcagcaatattctctataacctgtttttcaaatttcagctacattctgagcagcaggtccaccaaaccagaagcctgcctttaggagtccaaaagatcagaggacctaagagaaaatagttctgtctgtgaggatatccagtgtggctttactggccagcttccttgatgaccatgacctttccagggctcttgtacttggggcttcccgaaagtgtgtctgagtgcagtagtctttttatatctgctggaggcagatgctttagttcccttagttaagacaacgaagacaagagaaagatgaaaatggcttgcaaagcagattaatgacccaattaatgctgaattgtccatttcccttgttaatgtgccctgccttctccctacactgtgtggacttcacacataacattctctacacgttcattgtttatctttcttccttactggactgtacatcctagagaagaagggattatgtctgtcatatctaacgtcgtatttctggggcctggaacatagcagaatataagaaatatttgttcctgtcactatatattgacaatcatgtgatgaaaatatttttgcttttccataatctggtacagcaatttctaatgtgtacctcatgaaagttaataggtattccatagagtctatggaagttaatagatgttacatgaaatggggtgaggagggtaagtaaggctgctttaaataagcatgtttcattgctgcaggcctttctgaaccactcctgtggtaatacagtggttctccagcttcagtgagcatcagactcacctggaaggctgtgaaaacacacattactggactctgtccccagaatttctggttcaatactcttggtgtgggcctgggaatttgcattttaacaagttcccaagtaatgctgctgctattggtgagagccagcatggagatatgttattgacacttggagaaaatatacagtttccatcatttcccaaaagtgcttgactaaaggtcttattaaacctatagtcctgtctgacttgaggatatgatgacctactttaaactcaagtgccaaggaattataaattaatgcatccacattttaaaggggacatctggacagataactactgaagcacaaataatgtgttgctactaatagaatttagacttcattacagaataataaggacaaaagttttgggtggagtattaaaaagaaagatcacctactcctactagttgtaaaatgaatttgaacacaacttatattgcctggaaaagaacagtttatgtatgaaatcattgaaattactattgtttaaagcaattcttatgctttgtatctgcagctgttctagtttaaacacacattgcttggccctgacaacatgcagctttttacttcttggactctcctatgatttgaaatgtgttattcataagtttgctaaattccaaatatttgaaagaacagatgtggacctaaaggaataatcagctcttgctgatattgctccaaaaggcaatatatagagttgcattagaatgaagaactgcatttggctcttatgttttgagatgttggaatggcagagtgtctgtaggataacccagtgttgcatgccattttatgcttataagagtgttaatcattcagctcaatgctgattaacctcctagacactgcagataatatacaaaatataagacatatttcttgccctcacggagcttataagctaatctgggaagcaagacatacacatgaagtgattagagcagaggtttccaaattgcacagtaacttaagagaatatgcaaacagaaattgagattcccaggacccatgttagtcctattaaagcagctatggaaagggcagctatgaaaagcaaagaatatgtatttttaataagttccccaattgaggctgatgacgagacagagctggaacccatgggctatattaacaattattggatagtaaaaggtgctctatcattcagtgttacaataaacttttcttaatccagacaacatcttctgtattcattcaacaaggtaggtagagtctgtactatttcatcttgttctttcattggcaaagccatgaagggccctaattagcctaattacagagggctgcctagtgtagagagctgccatgcagttaagagataatgaatacattgtcaaaaagaagatactgtgacaaagaaagccacaggtggtagcattttacaacattggaccatagttggttaattagatatttattgagaactcactatgtgccaggcactgtgcaaggtactggggatatgataagcaaaccaagtggcctcaacattcatagcccctacagtctagtgaagatacacataggaaataagtagtcatggtcttttccctctttttaaaaaaaattttcataaactatacataaattcatgattttaaccattttcaagtatatagttcaagcgacattaagtacatgcatattattgtccaaccatcatcatcatccatctccaaaactttttcatcatctcaagctgaaactctgttcccattacataataactcccacaaaacctggcaaccagcaatctgctttctggttgtatgggtttgactactctgccgacctcatttgagtgaaatcatgcagtatttgcatttttgtgtctggcttatttcacttaacataatgtcatgaaggtttatccgtgttgtagtatgtatcaaaatttcactcctttcatactgaatagtgttccattgtacgtagacacaacattttgtttatcctttcatctatcaatggacatttagctgtttccaccttttgtctgttgtgcatcatgttgctatgaacattcatgcacaaatatctgttggagtccctgttttccattattttgggtatatccctaaaagtggtattattgacagtgagtatgagaccttggttcttatcttcttagttaaaataatgtaagcaagagacacacagcaaaggacatatggcatagagcaattttttgcaaaagagaatgcacactctgaaggttacgtgcaaaagagaaagtatactctgagagatgattcagcgcagactgctcgaaatgagacagcgttgcctgttactggggaaactccctttataggagttttacataattattcagaagggggtgggaagaggtattaccagtaagcatgttctgggtggccctctaggtgcacatgtgcagtagctctacttgcttgttcatacatgcatgaacttgcaagaatgcttgcatgtcttgttaacatcttaaatctccacccaggggtgtgtttttactattataataatcaaagggtcagtctgaagacaagtaatcaaaatgtgcatgctctctgcaggggaaagtccccactgaagctagttctacttggacgagcttgactgaaatgtgagcactagggctctttgtgttgatgcggtcaccatggttaccgcgttccccaaagacatggttacttccttgactacctatcctgcctcagtattgctggatcatatggtaattctacatttaattttttgaagaactgccgtactgatttccccagcagttataccatttgatagccgcggtcttttggcaagatagcagaagttaggtattattcctatgaggagtttatgtttatcctaattgtttcagaaacattaaggttgactacttcggggccacattgcggccccaggtcccaaatccacatctcctccaacccaccctgccgccttttcctgtctgtccttccatccatcctccccagtgaggaaaagtcacagcagtgcacttcagctttcagagtaaaagatcaagacaagcccaggatcaggtggcctgtaatgtgttccttagaatcacaatttctccattcctggtacagttttctgtaattctgttgccataccccaaaggaaaagctttgcttttagagaactcgcggtctattaaggttgagcaaaggccttgggcataggcactggggagttctaatctcaactctgctccatattgtgtggcagccccaggcaggtaatttaacctccacaattcctcatgttttctgactcgccgagatgattgtaatgacttccctttggagctgctgctaaggaaactgtaatgataggtggaggaatgtttgtgagattttgccggacgttcactaggctgcaaaagacttggacttaacttgctcccgtgtctttgtgtgcacatctagaattggggtccctcatgccagtcatatcattactctcagataaattccccattgccttatgaggattgatctaggccttgatgttcatcaccagcctttgcagttaaacatctggtttatggagggttttttttctttagttctttgagaagatagaaaagaacttgggagagaagggcatgatattccctgacatatttttttttctttttttttgagatggaggctcactatgtcacccatgctggagtgcagtgtgcgatcttggctcactgcaactcccacctcccaggtttaagcaattctcttgcctcagctcctcgaatagctgggattacaggtggtgcaccaacatgcccagctaatgtttgtatttttagtagagacaaggtttcaccatgttggccaggctggtctggaactcctgacctcaaatgatcacctcacctcagcctcccagagtgctagaattacaggtgtgcaccactgtgcctggccttcctcacctctctttcacccagaatactcagaattgagcacgaatattcttaagaatgttgttcccattcccttcatcggcttacctgtattatgtgtatataatgtcatcttcataggcattctctctatttgtcccatactatcttcgatgcagagctcaatacttcttcatatttgtcagggaaatgtcagtctcacaaaatattagagagaaatgcagattctactgaagatgtcataggggagccagagcaaggggttcacctctcacctcctgctgcaaatgtcttgattaacattttaatcgatgtatctttcttcctaagtcagtgtttctcttctgaatcaccgtgagggctccttgcctctgccttttacccctagtacatccagaatattttgtcttatttcttccctcctaccttttaaatctcaaattcctcctcactcctcatgtcatacagagcacctgactgaccagcttctgtctcaaaacactttatatgtataccctttctcaaaatgcaatggtagatcatatatattttttcttttactgatggaaaaaatgggtttgctgtaacaactgagataaattttatatttcaagaattttaaaatatatcctttaaaatattttggtatgaatttggcactttatttctttggaagatgtacatcatggtagacagatatctaagatggcggtcaagatccttgctccctggagtaaataccttatattctttcctttcagtgagggagaaacttgtaaatatgatgtgatgccacttctgtgattatgttattgcctaagggattctgcagatgcaattaaggctactaatcaattgattttgagttaatcaaaagggagatttttctgggagtcaccagcctaatcacataagcccttcaaatctgggtatagaggtcacagactaagaaaatcagagagtggacatgtgaaaagacacacatggcaaagaactgaggtagcttctaggacctaagagtggtccccaggcaccaactaacaagagagaaagagcctccgacctggggcaaaactttgatttcaaccttgtaagaccctcttcagagcacccaattctctgtctgggcttctgaaggacagaaaccaggcgatgacaaataaatgccactaaacatatcatcttctacatagcaatagaaaattattatatgcagtttactcagagcttgtttcccttccattttggatggtagaatattcttgcttttatgaaatgatcatcctagaagaggataggtttttctatcttaaacaaaatcttccttatttagcaaaaaagtttacaaacccatgtcaactctccctgccttatagggtttgtttgggaattttagtaaacagtaaaattgccaagtctagaaatcacagattgaaaatatcccatttccccatctgtcatctaaattttactgctctcccaagctctcttcaaggaaacttcttcaagggttttgaggtgttttctgcccctgagaaattgtcttcctcttatcagcgagttcttaaattctgtgcctgagtagtaactttaatttgttgtcaagatggttttgagtcctgtgcggtttagtttcccactttttgtcttgcctccctggctataggcctgggggcaggaccacagtttcaagctcctgagtcttctgctgagtctggccagatacctgaggcccagtgggtgctcccacatccttttgagttgatggattttacaaggcaggggccaaaactccctactaaataattgatcaacacgcctcttggattttgtatccactcctgtgtgtagatatcacctgctgtatttggccctatctttgcttaaaaaaaaaaaaaaaaggcctctgggcataaatccctctttcagagagagaaataattttagcagcagctggtccgtggcattaaagattgaatgactgtaatgtgttcagaccatggttggcttgttaggaattctgtaaggcaagaaataacctgagagccacagaccttggagactgcacgaaaaagattgttggtggtgatgtccttccttgaagcatcatgttgtaattcctgggccattaacacagctacccttcagtggcttctcattaactgcaggagaagctccagcgtctctgtgtgtcactgccagcttctcatccccttccatcctcattcctgcagccatccttgtgcactctgtgataagttttactcacctacttctgctctcctgtgcccctctcctctcctctcctcttctctttattttggtgcatccaattccctcttttggagtaaattttcctatagccttttctccagtctcgttcacccagtgatttctacatgtgtccttcaatccgttcaagtttcacctccacacagccttccctgaccttccccaggaagtggactttttcaaaagcacttagagtgttttccctgcagtaatcattttatacaagttctctttcagaatgctcaaaacagcccgatgaggtagacattatctctgtttttacagaggatgaagctaaggtttaaggaagttaagttacctgctgtattagggttttctagagggacagaactaataggagattttatatatatatatatatatatatatatatacacacacacacacacacacacatatatatgtgtatatatattagtttattaagtattaacttacataatcacaaggtcccacaataggctgtctgcaagcttgaggagtgaggagagccagtcctagtctcaaaactgaagaacttagagtccgatgttcaaaggcaggaagcatccagcacgagagaaagatgtaggctgggaggctaggccagtcttgctttttcacgtttttctgcctgctttatattcactggaagcttattagatggtgcccaccagattaagggtgggtctgccttccccagcccactgactcaaatgttaatctcgtctggcaacaccctcacagacatacccaggaataatactttgcatccttcaatccaagcaagttcacactcagcattagccatcacacctgcctaaatttttatggatactaagccagcacataagcctggaactgttataatcgcaacccatgcttatgatgtcaaggactgtctcttaacctcagagctgtggtgcttcctgggccctcacagtgctttatgcattgtctctgaagtagcattcttcctttcctgttgctgttgaaatctgtctccctcattggcctgtgagcctaagcgggggaggggatcatcgtctcttcatctgaacacatatccccagaaactcataaaatgttgaacaaacttgagcttaataagtaaagaatttttaaaagacattgccaaaagaaacagaacttgaaggaaaaaaaatgtaagggaaattataatctactcagttaaattttctatggtaaggccattactggtttcatgaggagtgtcttgagcttttgtttaattgaaaggaaaaggagattttcaaggggaaataccacacaaagtgggggaaataaaggaggaaggggagtaagtctatttctctcacaggtatatgattgttattatatcagtggtgtttaattttgcttacttaatgattattgtataaagtctgctatatgccattgtggagtgttcaggggattggttttaagacattccactcccaaagctcatttttacaaacttgccaccttatggtgttgtccttaacatatgtggaggaggaagatttttatcccctaaagtggagggtggtggcatttaatgcttggtttcgggaatattcatgtctacctcaaagatggtattataaagaaggagtagctgtgaaaaagtgatatttacattctcatcttaatattgctgttgaatatgtaatttgagattatgaaatcataccacattctaccaaaagtttattactatcctcttagctcttttgtcttttcatcttgaagtatgagtgtttcttgaagctttaagcattttacaagggataagaggacatccagtaacaacaaaatgaggaagccacattgcactccttggacatgtgcgtacaggatgtgtagtagatacaaccctgaaaagcctggtttaacctaatcgggctcctgtggaggaacccaagttggatttttttttttttttttgagatggagttttgctcttgtcacccaggctggagtgcagtggtgtgatctcggctcactacaacctctgcctcctgggttcaagcgattctcctgcctcagcctccccagtagctgggattacaggcatgtgccaacacacccagctgatttttgtctttttagtagagacgggatttcaccaagttggccaggctggtcttgagctcctgacctcaggtgatccacctacctccacctcccaaagtgctgggattacaggcgtgaaccaccgcccccagcccccatgttgaatttcatgtgcgtatcaccccttgtcttctgccatctttctctttgtcccctttttcctctgtctttagtcatcctctctttctttcccattcccgaggatattttgccttcttttccaaggctaagacctctgtgtctagaaagaagttgaaattgagagctcttcagtcagatttaccagttcctggtgactttaggcaagtccctgggcttcttcaagtctcagttttcacacctatataaaggggggtaatagcccctctttgctcacagctgcaagctctgctgttgtgttttctccctagtgaatggggcttatattctcctggaagtaggaagacaaaaactaaacagtaacataataaaaaatgcttacaaaaatatacttaacgcttcttcattcttcaaaaagaagtgagtttatttgactttgactctgcatcttaagccatacttgcttttttttactttggctacattgcaaaagaaaaataaaatccttattttctttctcagtgccctcaccacccattaattcactccttaacctgctacaaaccccttttttccttcctttccttaatttccaaattcaacaccctttgttcatttttcttctctttgatgtctgtgtagcattttaactgcaatggtcaaacttctctgttttaaaatcactatgaacattctttttgttctgtcctaaaggagggcttcctccctatttttgttaaagataacgcagttcttcagatcgcccacgcatcagaccatatcataaactttgagtaacccatcacttttatttgctccatcccaaccaatccccgggcccggctgggcccttatttgcagcatacccctttcctttccttgtgtttccttcccttctctcgttcttacattctgtagacagattagttgcattgcatctatgcccagcctcagaataattgtgtggcctttgacaaactacttagcttgtctgagctttggtttcctaataggtaatagaaatagtaattataatttttacctctaaaagttaatgtgaagattaaataaaataatggataaatagtcctatctactcctatgctaaacagctgacacatggtagctattaatattatctgcctcacaccatcccagcctcctcattcggttctttttactggaacaaggaccagcagtcatctcattttagtcccattatttttctttcctccagtcttctccatccaataccacagaaaccctgtacaaatactagatcaatattaccactgcatagttgggaagatgtatgaagtaatatgttaccacaagaatacgggctttggcttgaatttttattctgtatcttgatagctgaataatttcaatctggcttctgaacctctctgagtttcagttgcctcatgttgaagattgcaacactattcacaattgctaagacatggaatcaacctaggtgcctatcagtggattggataaagaaaatatggtatatatacaccatggaatactacacagctgtaaaagagaatgaaatcacatccttcacagcagcatggatgcagttggaggtcattatcctaagcaaaacataggaagagaaaaccaaatactgcatgttcttacttataagtgagagctaagcattgggtacacgtagacataaagatgagaacaatagacactgggggctactggggaggggggcaaggactaacacctatttggtactatgctcactacctgggtgatgggatcatttataccccaaacctcagtgtcgtgcaatatacccatgtaacaaacctgcacatgtaccttctgaatctaaaatgaaagttggaattatttttttaaagttacagctaccatgcagagctggtgtaggaattaaaactatcaagcacctagcatagtgcctgctacagagttcccactcagtagatggtaacagttggtattatagcagccccctgctctctttaacccagcgaatgaacctgtgaaacctttgatggacagtcaagctcccccatggtttagcctttatctctgcttccagctgcccttgctgtcttccttgctagtatcccttacatgagctattagacccatgaaaggggcctcatttttctgtctctgtcctgctgtttttcccactcctcttttctggaatcctaatcctcccttcttcttctccctggacaagatcaactctcacttcatgaaatgaaaaaaaaacatacaaaggatttaagattgttactggtctagaccttattatactagtctgtaattgggagtctttcacatttattgtataaatgcacgactttagcaaattatgctacagtctttggtattattttaaaatcatattgcttttatatgatttgcccccttgatgttttatttctttgatgccatgtgttgagcagttacacagtaaaaactcagtaaactcttattggtgatttttgaggttgattttcatggaattcatagctcgtgaaccatctgatccttaggtcgcaccatttatttcttggcctctgcacagaacctttttcttcaagatgttccatctgctttgcagaaattagctcatgagtcatttcctttccccaccctccttgtaaactgtagcagcagaagggcagcccctttggaataagtggaagtacaggggtcgcatggagcagtagggagttcgaagcaggctcaaatctgtcaagtcctagttcagggttattatcccccaaagcactgagaaattaggcagagacagctctgttcagtggaaagaaagtgctttggagccagacgtgactgggctcagatcctggctctgcctgttgtatgctttgcgatctttggcaacacagttaacatctctgggtccttgtttcctgttccataaagtgggaatagtaatatctgcctgccagggctattgtacaataagataaacagtatgaaaagacactagcatggtacctggcacagagtattaatttcatagtattattcttctgacccagagaggtttcagtgtcccccaaagagaacactgcagaaattattgacacatacaccaaaaactttgtaaataacttctcagccacattcgggcctgttgtaaaatcatgtttaaaagttaattattttgtccttcttgcttaacagggtggaaacttgataaaatacacctgtgagttagggtttttgttatttcctacctgacagccagaaagaaaagtctgaaaattacttttttctctttactttgaattttcaagagctgatcaatttttatgttccctaaagaggagaattcaataaggcagtctggaatccaactaataatttttagtcgtgcattctagggtggaccttgatagaatgtttgttccatctttgtgttttatgttcactcttttaaactgggtaactgaatgttgaaatgttagcctgggtaagggtcagagtagcacctgcttggccacatcctacctgggtgagacacagcattgctgtagccttgagtttcctcatcattcccattcaggctggttagcgtgagcctcagttgaccaaactttcaagaatttcaaagtgtaaaattagaccaggtatataaaagttctttaaaaagctgcagttgtatttgaatacaatcaaatggcttttttctacctatgtttataaattggaaaataacatagtaatagaaatagcaatggagggtagctattttttgagaatattctttgtgccccaggaccaaactaatttgaatctcaaaaaataaaatcctactggattaggttttgggtttgttttgccttttactcatgaggaaaaaggggcacaggaaaatcaagttacttttgtccatagtcttacttgtaacaaacataggtgccagtactcaaatgtggagaggctgtctccagagtcaaagaacttagagatcaaataaagaaattgcttactctaatattcattccttaatgtggcaaatatttattaatcacttattatgttccaggtggtacaaagcacaagagatggcagattgaatcaggcagggttggttctttttttttttttttttttgagacggagtctcgctctgtcgcccaggccggactgcggactgcagtggcgcaatctcggctcactgcaagctctgcttcccgggttcacgccattctcctgcctcagcctcctgagtagctgggactacaggcgcccgccaccgcgcccagctaattttttttgtatttttagtagagacggggtttcaccttgttagccaggatggtctcgatctcctgacctcatgatccacctgcctcggcctcccaaagtgctgggattacaggcgtgagccaccgcgcccggccgcagggttggttcttgttctcatcgaggacacagccttatagagtaaaataataaacaggaatgatgaaataaaataattgcacactggcaaatgctataactaaaaccagcaggtactgagatggagagcaaagggtcggggaaggccctatttggatcaaatgttcaaagaaggcatcctgggaggagtgacacttatgctgagatgcacgagatgagaagaagatagcctaccacataggtgacatgtcaacttagctgttacatagggatacagagctcagagaagaccacgcctaacatactactttagactatgaaggcatttcaccctccaaacctagaaggccaaatgcaggatgaatggtcatgtcttgcagttgaaaccttgaactttgagataggatcgcactctgtcgcccaggctggagtgcagtggcaagatcacagctcactgcagcctcaatgtcctgagcacaagcagttctcctgcctcagccacctgagtatctgggactacagacacatgccaccacacctggctactttttaatttttatttttgggtagagacagagtctcagaaaccttgaactttttatagtagttgttcaattatgagttacctctttcttgagccttcccagcatgtaaaacaaactttgtctttgctagcgcagacatttgaaatggatttctaataggttagcttccttggactgaagctagaaaattgggaaaaggattttttttttttatttttggagtagcaagtgtcttcacaaagagcttaggacttggagatggaggacacagtactgaggttttggagatgaaagtcatacgagttgctttccttgaaatggtggtacagaagagataaaactaactcatttgaattcagggaatgcacagtttctgagcttgcagaaaggctgaattttgaactgtgctctgcaccccattttctcgattagactataacatggtgtcttgcccatccctttctctacttccaggatttctgggaagaaaattaaaatacttaaagtagcactcaatatttaactattccaaagcactcaaggtaaaacccagtctaaagtggttccacaaacattttattgcattttctaaagcacggttcttatacatctctaccaggctcaatctttaaatgccttttgatttcctgtttcttgaaacttataatctcagcctataaaaataattttaaatgtccatcaattggatatcggttaaattacaaaatttttataaaacttaatgatgcatatcttttaaaaagaatgaggtagatctagataaaattatcataaaagaatattgttgatataacattgacaggaaataaaggttatggaggaagaattggcacacgttttctgtaaagggccagatagtaaatattttcagctttgcagaccatatggtatctgttgcaattactcatctctgctgttttggtgtgaaagcagccacagacactgtgtaaataaatgagtgtggctgtattccaataaagcttttcacaggcttttacaaaaacaggcggtgggctcacaggctgtactttgcagatcccattataaactatgcagagtgggaaataatctgttattaaacaacaattaaatatttggaaggatatgtaccagactgtttcatgatccttctattctagagatagaataacaaagtgatttttctagcatttggtatgttacaatgagcaatgattgcttttatactgagcaaaaacaatgaaggcactactattgtgatgaaaaatcagattttgcactgttctaggtagcttagtcctaataagtaatatttaactatatttttattatgcccgcagagcaattgccagtattttattctttggaggcagaaaccagaagtacagaattaaacattaaatttacacaagaacagagtatagttaccatcagtggtggccaaggtttcagtcttgaatggaataatatctagatatacagtaaaggtctgtctttagttatactctatctcgtattctagaagaagatgaatcttaatacaaactcttaaggaatgaaaaacttaagatataatgaaaccagaccagccacagttttaaggtatttctccgcaacccagattttgcattatcagagcactgccctgctcttgcatgatattatcctagattagaatgtactcttcatttttttcccatcatatggcattaataaacacaaatgaaaggagaggttatctaaaagtctattttgtatgattatttattttgcctgatggcaatgttgaagatgagatttgagcacgtggtctcaggtgggtgtgacagctctataggtccctactgaccctgaggctctctgatttcatgattcagctgttgatcagattcagtgctttgcaaggttcacatccttgactggtcttgacacgaaatgagtggccataattccgcattttagattcaatatccaggtgtaattgaccaaacaagaaaactaaagtgtagcccagattagagctcattttagtgaaaaaggaagcaggaagtaaactcttaggtattcaatggcctgtcctctgcttgattccagaatgccaagccaaatatttctcccacctgttaacatttccatataagtgaatcctgcttttggtggatttcaaataggggttaaatagggcaaaacttatggtttctaatttacttctaattaggggaaagtcgctttaaaacttttagctaaaataggcttagtatttacaaatacagaaacatggatttgaaaatatatatgtagtgaacatatatttagtggttcatcaaattgctgaaacattaattcaaccacttttctcttagagcaattacagttattccactgtctttccacagttacagtgaattctctaataatcatcactgcacatataaatttgtcctccttttaactatgctggacaaatgtctgggaggaaatgcccatcaatcaagtggataaaggaaatgtagtatatatgttctatggaatactactcagttgtaaaaaggaataaaataatggcattcacagcaacctgggtggaattggagactattattctaagtgaagtaactcaagaatggaaaaccaaacattgtatgttctcactcatatgtgggacctaaactgtgaggacacaaaggcataagaatgatacattggactttgagaacttgggggaaagggtggaggtggcaagggataaaagactacacgttgggtacagtgtacactgctcaggtgatgggtgcaccaaaatctcagatagcaccactaaagaacttattcatgtagccaaatgccacctgttccccaaaacactactgaaataaaaaaaaattttaaatgaaaaaaatggggggggaaaaaagtgctttggcaccttaatttgtttattcatttgtaaacatttaataaggatcccactgtatgacaagtcctgtgttatatgttggggatgagtcactaacttgctgtgtcaccttggacaaactccttcatctctctggtctcctttgttctactgatgtccttaagaaatcattcaaagaatatttacagcctcaagaggatcctaaggatccatattgtcaagttgcttccaaaagttttaggcaaatttgcaatgctatctgcactaatttcatcacaaccttgccagcaaggactttgtgtcccatttaaaattgtagtcatttaaatgagtggaaaatggcatgtgattggctttttttcttcttcttagattattaatgaggttgaagaatgtacaactttggctctaagtcaaatgcagtttcaattccatatcatattcttagattttctttgccaagaaacttcttttgtagtggcaggaagtagaagaaaggacaggagagaacaatgctttttttaaaaaaatctcattttagagaaaaaaatgtatttgagaaaactatttccacaacacattgcacattgataatgtgatgatgcttcaaatgttttgattgaattttttcatctcattccccaaggaaaatcctcaatttctatttttacccttgttccaaatgccacatgtatacttccatccctatttccctcttggagataatatctcaagcaataaggctgttgcatacctctctagtcattaataaatgatcgtgaacccttcaaaatgcaaaatactatatcggtgttttgggatgatgatgacaagaatacctcacaggtaaatggataaagcaaatgaattaaagtttgcaaacaatttttagagaaagacttgagtgtcgtcttagtctgcttgggctgccataacaaaattccaagactaggtggcttaaacaacagaaattattttctcatacttctgcagtctggaaagtcccaaatcaaggtctggcagcatttgatttctgatgagggctgtcttcctggcttgcatcctcacatggtggagagacggagcactggtgtcttttttcttacaggggcaccaattctgtcagatcagggctctaccattatgacctcacttaaccttaatcaacttctcagaagccctatacttagtacagtcacatagaggattagtgcttcaacatatgaagttgggggaggacccaattcagttcacagcaggtatctacacaggaactgaactgctcatctagagctcagttgccaagatcataatacattgtctggccctcaccccttgtcacagttctttcataagcatcagaaatgtttctagttttctcccctctggaaggaatggactggataaaaatattcaagatggtttgggtgactttcttatccattgtcttgtcaaccataaaaggtatctacaaagatcgtagaagatcgtagacatgtagatctcagaaaccacccagattttcagatggagaagctgaagcccagaaggatggaaagacttgctgtaggtacttctgataagcagttatccagatgatcctggaggtcttcggactcccaatacagtgcccaaactggtcatggatgtgattgtgctttcaaatggaagagtttatgagttccaacttcataaaattaagtcttgatgtgagttaggatatatttggttgcagataacataaattgactctgatcctaagcagaaaggatattgagagctgactgcattggtgaggaagggaggacttggttttgtgactggacatggtcccaggtggctccagcagccacagagcaggaagtattaccagcattatgtacaggacaccacctctgctgctagagagcacagcctccaccaccatcacctaaagtgaattgaaatcatcactttgtctttgagagacctcatacgatgtcagagtgccaggtagaaagttcccaaatgtgcttttctggatcttgcatttatggcttggactggaaagagaaaaagatctgacccttacatcttccacaaggagatggaggagtcctatttttacaaagaaatagagcatatcccaaaatagaaagtggttaggtgcaggacattcagaaaacaaaataaagcaaaaccaagtatctgctgcagtctccagtgtgagagcttccatagtagaagatggtttgtgccaaagtaagtccatttcaagcaaaagtttcatcttttagctttccctagagctctcttctattgctagaccagtgtacatttggcattaccttttctttttccattcagaatgaaatccagcgttgaattttattcttttatatttgttgattttagcattctgctcccattatggctctagacatatatagtaacttgtatgtttcagaatgcaagtaagctgtcttaacctactttgttagtttattgcacacaactaagagaagtatctcaaggcaggcttggggatgtttttttcaaccacccacagaatgcaggtatatttgttcattgataatttggctatgaagaaattatatatgcatcttgagtatttgaccacatgggttcactttttcacatgcggaattaactaaaacacaagtaacaatatcaatcacctgccccttaaacagcaagagatgtatttatcttagcaaaagaatgggagtgtttcaacagcaatattatctcagattatgtgtcttctgggacttcctacctttttctgtacagcctatggtcatcttctgtctcccacagcatagccaagaaaggaagctaaggaactggtgttctgttggtgagataatgtatggatctttatttagtccctgacatcagcacctccatcaccttcttttttagaatcagatttatagtttcttctgaacagggatacagcactgccactcagaatgacacctagctgctcttcatggatcagcctaagaatctgataaagttgttcccctagttgctggcgagtaataaaagcaatatggtggtgggttagcagctgattggagaagcaaatggatgtagagattggtggctaccatttgcaatatttattagtttcataagtgggcaagagaaaatagactgccttaatccgtgtttttgatcttttactgaactattttttcaaacatctttctgcactaggacctaggcctattcccatggttacatggcagaataggcattccatctgcataagtgatagttgccaaggtgagtgtgtgtctgtgtgagtgtgtacaaagctttgagaataagcttgtaaaatcacacaatgagctgcttttctgtatctttgagcagggtaactgtataccagtggatggaagagcctaggaagactcttgtgacatggctctgcccctgtccttcacctcagcctctccttccagggacttgataacagtccattggtcttggggtatcttactttagttttctcaacctctggccatagtaacattgcaaaaatatttactcacactttgccatcaactttaccatttatttccctcttcataacacctgagtcttccctctgtaaatattatctatatccaactgcagtaagtttagaacactgatggagctctctttctggtttgaatggagtcagattaaaaatgtccagagaactcctaataagtgcttttacatctgaaaatgtttagtatagcataaatgcaagagcagctctttcaaaggtgaagttcttaacatataatgtgaagcatgagggaagtacaaaaaaaaattacttcttagggcatttttactaagcccatgccattaggagcttcgggaatattggaagaattctgtagaatataccaaataatttattacttattttgtgtggatttcacaggactgttaattttttttgcctgatatttctgtataatttgcataaaaatccatctgaactgaagccaaattttaatttcaattgctgctttacaaagaaatgtattttacttctttttagcatgctggggtgaccgtgctcaggtttttgctgagataagatatcaatgagatatttccaccatggctttttgaagagattctttactgtgtaattgctaagacaattagctgcaagctacagctactattccttagaaatgaaagatgctttccactgtaagaattatgttactcctcagtggtgttgacaagatgaagaaccattttggatgttatgattctgaaatggctatctgttggtgatccatgcttcaacgtggttatgagtcagttctagtcaactgacatttatagcttttagtttatagactggggctttcaattcagctcaatcaggtgtctgcaaataaacatctgttatatttaagttttccagtgtctttctttcaactcttatttcccttaaatcaaatgcttatttagcagagcctgaaaataaaaataaataaataaatacataaataattaagaaatgaaaacaactccaaatggtctcaatggaatacttcacagaaaactgttatgaaaaggcacaaagaaagtatatgaaagggtttaaaatggagatagcctaatttctttcatgtccattaaactgttattaataaagagggtaataacccaggccagattacacagtgcattcaaggattttctcttagatcgttaaaataattgtcataatcaggttatgatacattcgagtgacactttgacagcgtggatttgcatcctgaatctgcaaactctgtgactttggataaattgccgatctcatattagtattggtttcttcgaagaaaatctgtaaactggatgcaaacaggcaatgactttgaccaccatgggtcagcacaactgtccctgtgaccaacaaaactcagccacacatgatcttatggtctataatatcatcctcatacttggtacaatcatctcttaagtgaagatgtggtataaagggcattatttcagagggggagaatgggtgaccccgtgagcagataggtcatatctcaatagccatagaatttaaattgctaaaagagcccttaagtaaatgagcgcttttagcagcacttgaagctctctgttggggtccatttggaaatcacagatgctactgaaaaagcagggggaattccttcacttactctttattgcctttggaaagatttctgattatgctctggtttagggataagtcctaatacccaatctgtgagcctttaccgggcatggcattcagcataaatgtgaaatgacagtgtgtgccctccggaaattacagagataaatacagcctcgtattatgctgggcccgcaagtccatggagtgcttttggaaacatacaccttccacccaccagctcagagtgttttatcagcactttactaatgtgatttccaatgaaggtcagaaagttaaacttatcacccagtagccagggttgatagttcatatcttgatcttatcattgggcctctttttcccattccaattgctttttgagggcttagcactgttcacttgggggaactgtttgctgtgagcaggagcttaataaaaataaaaatcttgttgtataaggcaaaaccaaaatgtccaaaacaatatccctgtttgctccccaaatgtggaatctgacccatcaatttccatcagaatgatgtgacccaataacaaagtcactgttttgtttttgtttttgttttttttcttctgtgtttgactcttctttctcacacgtcaaagaaaagcctgtagtgagcaggtaactgtcaaaggattcctcttttgctttttccacttcccattcaaatataattgattgcagcagcatcacaacagctttttaaagggagctacacttgaaatgcagaaggattcactgaaaatggctatgccacaagatcctcgatatccataagcaagataacctactatgttctagaatctccacattcatgaatgtcatggtatataatttttcagtttccttatatataaagcagggtttctcaacaacagcacttttgacattttgggctaggtaactctgttgtggtacatatcccatgcacagtaggtgcttatcaacatctgtaacctctgtcctgctagttgccagtagcaaaccccctaccccattgtgataaccaaaattgtcttcagacattgctctatgtcccttgttgggcagttgttcccttgtcccagttgagaaccactgatgtaaagtgaggttaatatttccttctgtaggttgctaggatcacgaaaggaaatttatcctttattaaattaaaagaaatagtgcacagggtgagaccaagaaatcggcaagttgtgaatgccagaggcctgcagtcttcactcacaaatgatttgatttactcagacacaaaactcatgctgcaaaattagtcttacaaaggcatataagctccatttcacgagggtcattagaaacaactgaaaaaggaaatattaattaattaataattaatatttaattaattatttaaatattatatttaatataattaattatataatataatattatattttattataatataatataatatattgtattatattatattttataatattatattttattataatataacattatattatattttattataatataatatattttattataatataatatattttattataatataatatattataattttattataatatattatattttattataatataatatattatattttattataatataatatattatattttaataaaatataatatatttattttattataatatattaattaaataataattaattaatattaaattggcaaagggtacaggtctactggagttccctgtaccttcgatgtgaaggttcacttaatatctagcatcatttcttgttttgaatgttacaatttgcatcttgagaacactgcctgacacttaacatatgcccaaagaatgttaaacggaaggagggagggcagcctctcaagaatagacccaagatccaatgatcacacaggcccaggctaaacttcagcatcctgaaatcttctaatcaattcctgggttcttctccatgctttgtgtatgtcttgactctaaagtctactatgtgaccttagtaagtagctttactgttctgtgccctagctttgtcatctataggatattaacagtgcgtacctccaagaattgtaccaaggagtaagtacctggtacattagtcagtgatggccaatacaactattatcgtcatcatcatggtcatattatagttttagggtgaagttgatttttttggatcccagggacagaaagatgagttgatcctactcctctgttcgtggcacatcactattattgatctgtacagggctctaatcttattttaaaagtaaaatactttctttcatttccatatcacatttccacttccccttcccaaaatcatattgttggtaccatagaaaatcattctaatgtagccattgagtaccttttgtttttatatgttcatgcatattgtcttgtatgcatgtatctaattttcataaataaaatggtgtgtatctgatttcttcttactctttttactctgcctgttactgcatgctcgtatactcctttgtagttgcctgatgcctaacaatacacaccaacacattttacccctgtattttccagtgaaaaccacacaagtggcctccaattctccacaaataacaatcatgaatgtcctcgttcataaacccttcagatatgtgtgaggatgtatttgggatatgcgttgtgcacacatctctgttaaaaacctgatacaggaaaccattccaaatttttggtcttgccacatcaatatcactgttacctgcagtttcattcagagtaatagcatcaatatatcaagatgatggcagagataaatacatttatttattgcatgcgtttttatttgctaggtagtatgctaggtattttatgtcctcaagacttcacattcagtaattcaagaggaggactcagggcactcagcatatggctgtactcatggccatgactttcttccagcaaaaggacgctaagcacaatcagcagaggaaaaaggtgcatggggcaccttttcgagaagaaatcagatgaaattattcagagtcctctgccagtggagtcacactgaatgcacttaattccctcaacaactaagtgtgacaatatgtgtgaaatgttgccaaccagaggaactttttttattgaggctggccacgtaggcagcctgtgcctgggatataccaaaatcccagattcccagaaggaaaacacatgttcagcataaaccctattgtcgaggaatagcttgccatttttatcctttctgagaatgctgagaaactttccaaaatccaacttcccaaactccagcgaaagccaaccttataagcaaccctttcaaaggacagcagtcaggcccaatacgttaactcttttcttgcccattttgttttcattatctgtcagtgcactgaaagctggtaattatgttttcatttttaaatgagaaaaccaagaatttaagtaacttaccccaggtcacagttcagaagaggagtcaggatgtacccctaagcttcctggaaaccagcctcctttttaaactgccttcaagaattgatgttctctctgctataatttcagctcattattagcaattaaacacacaaaatttaataatttctttctttgctgaacatagcttaatctgtcattttcttcttttagaagcagcttcttggaaaactttaagttaatacattgacataagcagagggtttggttattgctacagtcctgagaaagggacatttttttctctacttggatgacgggttttttttatttaatttccatagttttgggggtacatgttgttttttgttacatggataagttctttagtaatgatttctgagattttggtgcacccatcacccgagcagtgtacactgtacccagtatgtagccttttatccctcacccacgaactcacgcttccccccgagtccctaaagtcctttatatcattcttagccttcgtattctcatagcttagctcctacctactagtgagaacataggatatttgcttttctattattgaattacttcagttagaataatggcctccagctccatccaagttactgcaaagaccattatttcattctgttttatggctgagtagtattccacagtacatatataccaaatattctttatccactcattggctgatgggtatttacgttggtttcatatttttgcaattgtgaattacgctgctagaaacatgcatgtgcatgggtctctttcatgtaatgacttattttcctttgggtggataccgagtagtaggattgctaggtcaaatgatagttttactttcagttctttaaggaatcttcatactgttttcaatagtggttatactagtttacaattctactagcaacgtaaaggagttccctttgcaccacatccatgcaaatatctattatttttcgactttttaattatggtcttaccaccttactcctctaagctggaggagtaaggtagtaagtcattgtggttttgatttgcatttccctgataattagtgatgttgagcattttttatgttcattggccatttgtatatcttgagaattgtctattcatgttctttaattattttttgatgggattatttgtttttattcttgctcatttgagttccttatagattctgaatattaatcccttgtcggatgcattgtttgcagatattttctcccacactctaggttgtctctttgctgattatttcttttgctgtgcagaagctttttagtttaattaggtctcatttatttattttggtttttgttgtatttctttggtgttcttagtcatgatttttctgcctaagccagtgtctagaagaattttcctgatgttatcttgaagaacatttatggtttcagctcttagatttaagtatttgatccatcttgagttgatttttgtgtaaagtgagagatgaagatccagttcattcttctacttgtggcttgttagttgaataaggtgtcctttccccactttatgtttttgtttgctttgttgaaaatcagttgactgtaagtattttgctttatttctgagttctctactcagttcccttggtctgtgttcatatttttataccagtaccatgctgttttggtaactatagccttgtagtataatttgcatttgagtaatgtggtgcctccagatttgttctttttgcttagtattgctttggctatgtgggctcctctgtgtttccatataaattttaggattcttttttctggttctgtgaagaatggtgatgatattttgatggaaattccattgaatcagtagattcctttgggcagtaaggtcattttctcagtattgattctacccatccattagcatagaatgtgtttccatttgtttgtgtcacatatgatttctttaagcaatgttttgtaatcttccttacatagatctgtcacctcattggttaagtatattcctaagtattatattttttgaagctgttgtaaaagggatcatgttcttgatttgattctcagctttgtcgttgttggtgtataacagtgctattgatgcatatgttgatttagtatgctgagattttgctgaattcatctatcagatctaggagctttttgagtgagtctttagggttttttagatgtacaatcatattggtgaacagcgacagttttacttcctgttttccaattcggaggccctttctttccttctcttgtctgattgctctggctaggactttcagtaccatgaagaatggaagtggggaatgtgggcatccttgtgttgttccatttttcagggggaatcctttcatcttttcgccatgcagtctgatgttggctgtgggtttgtcatagatggcttttattactttgaggtatgtcccttctatgccaattttgttgagaggttttatcataaagggatgctggattttattaaatgctttttctgcatctgttgagatgatcatatgatttttgtttttaattctctttatgtgatgtatcacatttattgacttgcatatgctaaaccatccctgtatccctggtatgaaacccacttgatcatggtgaattatctttttgatatgttgttggattcagttagctagtattttgttaaggattttagtgtctgtgttcatcagggatatcagccacagttttctttttggttatgtcctttcctggttttaattttaaggtgatgctggcttcatagaatgatttagggagggtcccctctttctctatcttgtggaatactgtcaataggattggtaccaattccttttttaatgtctggtagaattctgctgtgaattcatctggtcctggactttttttgttggtaggtaatttttaaattactatttcaatcttgctgcttgttattggtctgttaagggtatctaattcttcctgatttaagctaggaggtttgtatctttctaggaatttatccatctcctctagtgtttctagtttatgtgcataaaggtgttcatagtagccttgaatgatcttttgtgtttctgtgatattgggtgtaatatctcccatttcatttctaattgagcttatttggatcttctcttttctttttttagttaatctctttaatgctctgtcaattttatgtatcttttcaaagaaccagcttttaatttcattgatattttgtaatttttttgtttcatttttatttagttctgctctgatccttgttattacttttcttctgctggtttgtagtttggtttgctcttgtttctctagttccttgaagtgtaaccttagattgtctgtttgtgatctttcagacttttgatgtactcatttaatgctgtaaactttccacttagcactgcttttgctgtaacccagaagtttggataagttgtgtcactattattcatttcaaataattttaaatttccatcttgatttcattgttgacccaaacatcattcaagagcagattatttaatttccatatatttgtatagttttttgtgggttctatttgtgggtgatttctagttttattccactgtgatcagagaagatacttgatgtgattttgattttcttaaatttattgagtctttttttgtgacttagcatatggtctatcttagagaatattccacatgctgatgagaataatgtatattctgcatctgctcaatccatttcttctaggatatagtttaagtccattgtttctttgttgagtttctgtcttgatgattgatctagtgttttattgaagtcccccagtgttattatgttgctgtctatctcatttcttaggtctagtagtaattgttttataaatctgggagcttaagtgttcggtgcatatatatttaggactgtgataccttcctgttggacaaattttttaatcattatataatgtccctcattgtctttttttttttttttttactgttcttgctttaaagtctgttttgtctgatctaaaaatagctactccagctcacttttggtttccgtttgcctagaatatctttttctacccctttaccttatatttatgtgagtccttatgtcttaagtgagtatcttgaagacagcagatatttggttggtgaatttttatccattctgccattctgtgtcttttaagtagaacatttaggccatttacatttgacattagtattaagatgtgaggtccctttatattcataatgttagttgttgcctaaatagtttggtttttttttttttaattgtgttttgttttagagaccatgtgagatgtatgctttaaggaagttctattttggtgtatattgaggttttgattcaagatttagaactccttttagcatttcttgtagtgctgatctggtagtggcaaattctctcagcatttgtttgtctgaaaaagaatttatttctccttcatttataaagcctagtttcactggatacacaattcttggcttacaattgttttgtttaaggagaccaaagataggacccaaagtccttctggcttgtaaggtttcttgtgagaaatctgcttttaatctgataggttttcctttgtaggttacctgatgcttttttctcacagctcctaagtgagaaatactcaatactttttcttgactttagatagcccagtgactatgtgccttggtgatgatcttttgtgatgaatttcccaagagtctttgagctttttgtatttggatgtctagatctctagcaagggaagttttcttcaattacttcctcaaagtttttcaaatttttagatttctcttcctcaggaacaccaattattcttaggtttggccattttacataattccatatttcatggatactttgttcagtttttaaaactcttttttctttatctgattggtttagttcaaaagtcttatcttctagctctgaaattctttattctccttgttctagcctactgttgaaactttccactttattttttatttccctaagtgtgtctttaatttctagaagttttgattttttttctactatttttctggaaagttttttattcatatcctggatttttttaagttggtttatccctttctctggtatctccttgagtagcctaataacctttggaattctttattggaaattcagagatttcttcttggtctggatccattgctggggagcttgtgtgatctttttggggtaccatagatccctgttttgtcatattgttagatttacttttctggtttcttttcatttgattagaccatttcctcaaattgttcttgaatttatttttgtttggactatgtttttttttatttcatttttcctctcaacgattggactttaatgattattttagcttaatttgatttgtggtgcctttaggagtgaaaactttgtatgtgtttcttagttgaagggattatttgtgtgctggctttcccagatgtggttgtagtcgttatgttcttggggtgtgggagagttcactgtcttctttggggatgaaatggcagagatcttttgaagcttatctcattctctcatggtatacacttaattttttcccagtattttattgaccaaacgatgattcaggcttcaggccaatgggagaggtatccctgggtagggactggttgtagataaggcaggtgggtagatataatactcaatggtgggccaagatcccagtcttgatgagggtagctgggggagctctcaattagatgtgctgaggtttcatcagggtgaagagggagagctatcccagctcccctgccaggccagcaggaaagctatccacctcacagcctcattcctattttagtgttttggctattcagatcagacaggcacctcttttcatctgtagaaatgttgatgttccaagtagggaggggttgtgactctgcttctcatgcaggtctgactcagatgtcttttttctttttcttaagatctgattatctcgattatctcctcctgtggggttgccctcatcctggattgttccaggaaggctgtctgtaggtgcatccatgctgcattcctgtaggagaagccccagctttgtctgcagtggtgtgccagaggggaacaaggaccccttctccaagtcccttcctaatcagagaggctgcctgcctattagggtagaggtgcagactttccctactgcccccagcactgcagttatgtctctgctgtaagaaacctcccactggcagaaagatctgggactcaaggtctgctgttaagattattttgtcccacggggtaatcccttgatgtggtactgtcccccttcccttaggaatggggcttcctgagagccagactgcaatgattgttttgttttttgttttgttttgttttttggacagagttttgctcttgtcacccaggctggagtgcagtggcgtgatctcgactcagtgcaacctctgcctccccagttcaggtgattctcctgcctcaacctcctgagtagctgggattacaggcatgcaccaccatgcccagctaatttttgtatttttagtagagaaggggtttcaccatgttggccagtctggtctcaaacttctgaactcaggtgatctgctgacctcagcctctcaaagtgctggaattacaggcgtgagccaccgcacccagccagactgcaatgattgttctgcttttctgggtctagccacccgtgggactacgaggctctgggccggtactggggaatatctacaaagggtccaatgatgtgactgtcttcaggtctcccagcagtggataccagcatctgctctgatggaggtagcaggggagtgacatagactctgtgagattcctccattgtagataggctaatgtgctggctttctagtatgctagttatgctagtagtgaagttgtcacaaggacagactcaggacctctggttagccagcatgttacaggtggtggaattggctgttattttctctttcttgcgagcagtatttctttgtcatgggttgctgtaaaggcctgagttggttggcctccagccaggaggtggcgtttgcaagacagcaccaggtacagtagtagcagtgggatttgagcttatccaaagttggccaggggaagtattctggtttctcaggcattgggcggggccataaagctccccaagagtttatgtcctttgtgttaagctaccagggcaggtagagaaataccatcaggtggggtcagggttaggcgggtctgagcacagactctctctccttgggcagggtgtgctgtggccactgtgggggataggggtggttttcagactgctggggtaatgttccacaggggagaataactgccactgttgtacagaagagttcacaaggggagtagtgagtagcaggctgtgataggtcccacctagctcccatgcagttggtgaagctggtctaactcccacagtgccctattaacagcaacgggtttagatccaggcagcctgcacacagaacttagacctgccccaggccagaagcttccttgcagagataacaagcagggctttcagaccacgctccttcctatatgcctgtaatgccaggcacctagctcctgcatgtgtatctgcagcacttcctgctcactcacagattctgttcaggagagttcatcccactcaaaattatatcacagaattcagttgggggtgtctttcaatgatgggtattttgaaccacagatcaaagttaaaatttttgtgacttacaacaaatataaagttaggttaatttttacattgcaatcagtttggaaaacagtgtctcttttctggtcgagaaagaaccactcactctgctctaatcattctctctctgttctcgctgtcatcattacagaccctaatgcttccagatgttgaatttctgaaatggcatctctctagtaagttggggagtggggatttggaccaggcagataccaaaaccatagcctattcacatgctctactgccttccccaaacaccattctaacggtgatccagagtaaactgggttgggaaacaagtcccatgaactaagcagaagaacaaaggcccacgttggtggctgaccaccttgaaacctcagtttagcacttggttggtgagcattagcaagcccctgtctctttgtgcctccgccttcttgtttccaaaatgaggctaaggattcctgccctactacctgtacagtattagtgtggcaatcatgtaggatggcaaatctaaaatcattttgaacagctaaaaggggcttacatcagttattactcttttagttgtatgtgatattaggcaaaaaagtcttttatcagggcagaaagctgacagcaccaagcaatggcctgtcaccatatgcagcttgataatagggtaaacattgtcaacacaagttggtttctccctgtgcatgtttcaggccccatttttctttatgtaagcccctttcccaaagtgtctccccttgtggttacaagatggctatagtaattgttgaccttgaccttgttgtctcaatgtccaatacctcaggaaaggcagagacagctgcttacatagctaaaactgagattcccagaatcaagtctcattgctcatgattggcctccaatgggtaacatgactggctataaaccaatcccagttaccaggagatgccaaatgctcattggctaggcccaggccacgtgccactcctgcagctgaggataccatcagagccacctggaaaggcagtatggaaggtgtgcatctctagctggctaataccagaagaaggatgattatgttggtaaagaagtttcagtgacatcttctgaatgctgtgtgtgtgtaaagtagtcttattaaaacatcatgatctaagaaagcagtatgttccataaactgattggagtaaggcaaaactaagatacacttttctgaacagagtttagatgggagggatggctccccgcacaagcataccatttattaaacacacagaggggaaatgtaattcaatgatggtgaggctccctccctctccagtcccatttaagcctttatttttcagcccttgtcatattggcccacttagggaagggtaactacagaaggtaattactaagatagtatttaattagttttggtttcaaataaaggtatttgctgcaaacccggccagcgatgctgatagacattaatgaatgaagccgtatgattaaaacatctggcactgtcaggcagggtagattcagggtggggattggcctgtcactgggaatgtgatgatggccacagaaaaccaaattagccaaacttaatgtttccctaatcattaggcgattgagttgacagtgattggtcacaaacatgcaccggtgagcagtaatgaagttgctaccagatcagttcagcataggtttttcaggctaattagctagacaaaaatgttaatttaatcaaagaaacatgtattcattaaaggtgtataagagagctggaggagaaaattggctcagtcattgaggaggcaaaattatagctgccaagcaagtcatcttgcttcataaaatcattcctcaatttatactatctcttagaaaagtctagttacacttaagcgtgtcatgtggacttttttcttaagatctgattattgtaaaggaaagatcatctgcagagcaatgtagaataaaagcaaatacttaactcattttatccccagaggattaattaattcctgtagaaatgttcttttattttgattcatagactgtaggaatagaaacagttcttagggattatctaattcatgccattctatttacaagaagaaaatgaggcacagaaaggcggtattacttgctcagggctacacagcttaacgcattttaatttgtgccctagacacaaagattccctgtgtagttagtggcgtgcaacttgtgaattaaacattggaaatgggatttccccctttgcagtatattcccctgaggatatactaaggacatcctcagatatttttacagagagacattcatctcaaaagatgacaatctgtctgtacttgtaattgtgaagaaaatgaaaaatctgtatgatggacaaatacaatttgactgtttatttcttggtgtggaatcatatatgtggaagtgctagaagtaataagtgctatttagatatcagctgttgctacatcaggggctaaaattattttctgtatccgctcttgaatatctcttttgcaggtgatagggagatgtagactttcctttgcaagttctgtatcctgttattaatactatgatagacctcctgagtccatgtatgctaatatgcatgggctactaactgtttaaaaaattaatgtattgatttgtccatctgtttattaattccattaatacttctgaagagaggttgtggtgatacattgttcaactcaggcctttgtaaaattctctctggattgggacagggagaaacccttaactcccaatgtttacgcaggctaccttctgtccaagatgctgtttgccgttatcttgagctggtaaaattctattcatctttcagcactcagtttgaatattctttcctccaagtagctctcccaagttcccagaccaagtgtggaccccacctgtgtgcccctagcacccaaagcctacacttatcagggtagctatcactccatttgtctgtagcctgtttgttcacctgtcactcaccgggccacagtttctcaatgtggaccaggtaccacccacagcaaaactgcctggattctttgtcaaaaatttgaattgattttatgtgatccacatttaatcggaggggaagaggtgtaaaatggattttggtcaatttcttaggttatcacacactataagattttaaaatgctatgttgttctctcagctagctgaaacatggataggcccacagaaagtgctcaagatgtatttgttgaatgaataaatgaatgaatgattgcacaaacaaatgggttcttatcatattgaaatcagttgtcaagtcatatagtcagaactttcccaaggaatttgactcacggctttgctagtgtaggattctgttccttatctctgatgctgtagaaccttaggagttataatattgtggaagctaaaagggcccttgaagatcatccaatccactcctgtgatggagatgaccagatgtaaagaggcttgcctaagattacaaagcacgttaatgacagagactaaatcagaatccacatttccgtgtgagtccattgcctttcctattatatcatgctcctgctgcagtggctaaatttaccctgtgaagaagcaaaggtattcttgctctggtaccttgaaggaaatgtccaaactctctggttttataaagatttagaaacaaatcaaatttttgatagttgacatgtaaccacccctcccagagacccctcctttatagctaaccaactcagccaagtctgatacatggaaaggtgctcatgaaagtgtcagggtgctgattatttcaagttgtaaaaatcaattaggaattgcagccacatagaattggagcatcttatggacagaaaagtcctggctgtcatttcattcaaatcctctgtgtcccatatttttttttattcccattcatttctcacagttgttgctacgttcaaataccaaacattatcctttaaaataacttttaaagaaagattgagttcatcctgattagtagtattcatggaatcttgtgtttgatgtgctagttttctttctaatacttattttaaagtattattttaattgccatccttgtaccatgtaagtcatcttacatgtaatcaatggtacatatgttgtggtttgggatgcaacttcctcattattttagttggattctgtcatcttcccattatacttcaaaggggagtattcataccttttcagaagaaatgttttatggtctaatttaaatgaaaataaagatgttatcctagagtcatcttagttcctctgaagtattgtctatggcaaaggagagctgacagtcttattttgaaatcacgccctgagctatttggttattattaaagaatgacagatggcacaaaggatgctaaggtagaaattaaggtttctttgtaggtttggcaaatgttatagcatacaagggctgtttcagtgctgtgattgaacaatgcaaacagtattgcattagcatctaaattttacatcattttcaagaaaacagagtcccggtaacagatggacaagactgatatttatctagcaacaaaggggagtcacaatttgactgctggatacttaaatctcagccaacaggggagatggcaattcagggaaattgaagaggagatagctagtgtcactcttttggagagggaagaaaatatatatgtgttttttaacttttggaaatgatagccaagttcaagttttggaattacctctgtgatttattacaagtggatatttgaatgagcatttcagatcatttccagatacacattttctaggtttgatgcagagaagctgtgagaatccttgaagctgaaggaacattacatttagagggattgaaggcttatgcctaagcatgctacctggaggatacattggggaggctggatttgcaactttaaaatggcaccacactcaattggaaatttaagtatctccgttagggttttgaattaggagagagcatatttgtcagatgtgaggacagtaggaaatcaagcatttttggaaaaccataaatgagttaatgtagtgttcaggacaagctgtgaactggcctctaaaaggaggtttgtagtaataacctgctgtaaaaattaccactgcttttctggcggttttgaccatatgctcctgctctgagagctgacattttctggcagtcactgtagcttaaggacctattattctgtgtggtggactttggctccgttttctgtgtgctttcaggtgggcaatttgcagcaagggagggaagccaatgggaagttaagtcaagatggaaggatctttttcaaaaggttgtttttttcatgcacagcagcaaagacaacagagccaaagagaggtgtttatgtttctacatggtagaaaagaaactccacttcaactcccacctttcccaggacactttcttttagctcctccagctcatgctgttctctcctgtttataaaattgcaaagtacctgtaatctctattacagtgtttagcgattaatcatattctaccaactcttttcttttctcctccattcttcacagggaaacttaaccaaatggtgtcccattttcaacatttttgaaagtcttttgtaccttctatggcacctagtttaattatgacagccaagtaggctaacagtaataataatagctgcagtagtaattgtgataacagtcataacaactcaacatgaactaaatgcatttaaggtggtaaaggctgtttaagctttcaaagaattaagtcttttaatcaaacaaacctgagagagttactgttatttcctacatttgacaaattgtaggggcattgaaggcaagaaatgttaagaaattgctcaaaatcagagcaagtacttaagctcaggcaaatattctgtcttcagagaccccactccaaaccactgggctctttccctaggtcatgaaaaataagtaatagcagctaaccttgatagagacgtgagactgctccaggcactattccaaggaccttcaaggtataatcccatttaatacagcaacccagtgaaggaggtgccctttgcaacccctttttccatttgaggaaactgagtttcagggagattattagttgctctgtgtaatgcagccagtaagtgaaagagctgaggagtgtcttatcttaatcattgtgtgacattgtgcttcaggacgtccttgaatttacctggatggcaaacaaatattatttacttgacgactccttcttggggaaacttagtacttaagagaaatggattgttcctggttttctttctttatctagggtagagtttctcactacatttttaaattattgcccccctcaggagcctgtttaaatctttttgcataattgccccctactccccaccatggtggggttaacattccatggtgaaatgttaataccatgaatatactgcatagctatttaggtactacatgaatatctgcgctttatacatgagaagagtaagaaattttaaccatcagaaaacagttcttatcctttggggacaatgttacaccaataagaatgcatggaagctgctttagcatgaactcttgaaaagcaatgcataggaacattttgattaaagtgagagctcactgtgcaggatgctccacttaattagccaggaatcctttatgtttataccattaatgaatatcttgttgtatcagattgttgtggaaaaaaaatcatggaaatcagcaagatttcccatttgtgcctttcactctatcttttgatgcccagaaagcattggaaacccatcctacagaaagtcagtgcagtttttttaattgaggtgaaattcacacaacataaaaataaccactttaaagtgaacgattcagtggcatttggtatattcaaaatgttgtctagctgccatctccatctaattctaaagcactttcatcatcccgaaagaaaaccccatgcccacttaatcattccccaatctccccttccctgtagtcattggcaacctaccaatctacatctgtctctatgaatttacctatttcagatatcaatatgtcatatagatgaaatcatacaacatttggcttttggtgtctggtttctttaacatagcctaatgtttcatccatcagtactttattcttttttattgctgactaatatttctttttgtggattatgccacattttgtttatccatttatcagttgatgggcatttgggttgtttctgctttttagctattataaataatgctgcgatgaacaacatttgtgtacacatttctgtatggcatatgtttttaattcccttaagcatagagtggaattgctgggttatatggcaactccaggtttaacttattgaggaactgctgtactattttctgttatggctgtactatttggcatctccaccagcaatataaaagggttctagttttttcacatcctggccaacacttattattcatcttttttattattgccatcctagtgggtgtgaagtggtacttcattgtgttttgatttgcatttccctattgatgaatgataattgagcataatttcctgcacttattggccatgtgatatacctccttcagagaaacatctattcaaatccttttctccttttttaaaatcagtttgcctttttattaagttgtaagaattctttatatattctagatactagacccttatcagatatgaattaccaatattatcttccattctgtgagtcatctttatactttcttggtgatatttttgaagcacagtagttgtaaattttggccaagtaaaattcattgatttttatttggttattgtttgtgcttttggtgtcatatctaagatgtactggcatttcaatgggactcttacagctattagatccttaacctacaggattgaaactttaatattgtgattttaagccccctggtaggtggcgtcaggagcagtgttggtgggagtggctttggagcagcatctttctagttgatacattatcaccgtcctactctgagcatggtaaagcctccatgaggacatggaagattcacctctaacaagcgtaatacattggtcatagacacagcgttggaggcaaatagacctgagtttcaatccagcatttacttgctagctgcatgtccttgagcaaattaacatatgtctcataatttttgtattctttaaagggaggataataatactctccttcatggggacgttttgtaaatagctaaatatcacatgtgatacgtagtgcatgcttgataaatgttatcattgtcatctatattgttaataattattactgtattctttactaatcattacatatggtacagaactaaaaatgatcatttccacattcagtggttctgcattgtctatgcaacatttcttctctattagtgtgactaattgaaagatgattgcacagataaacctcctttattttcaatcaaaatttgctattgccatgtagcttagttatatctttctccatgggttttataatgagacgtctattggtcacctgtataagtatagagaaagttagcctagaaatgtgtgtggaatctagccaaggccatttccttactttagctctctgcaatttattattaggacatcatgaaaccttgggggttaatttcatttacttcctgagtgctgcaaatgaataagttgctcagagtcacctgaggtggaaatggctgatttgcgtggaagaaatgactgtgactgtgcactcactgtcatcagggcacttttctaactgtgaagttaactccttatccaaggaaggaggtagcaggcagctgtttgggaggaggtggttctaaatctggcagtccactttggcctcaaataatggtgtacttgcttagatggcagtaacaatttaacagggtctagaaagaggaaataatagatttagctcagaattcagccgcagggttgttttttcagggcagagcagtgatcgagtgtaatcactttaagaaattgtgcgttgtttttctttattctctgagctgatgaaatgtatgcaaatcagctgagtaagttctgcaggtgtggctgggttaacaagtaaggatgctaaagacactccctaccccagaagtctggctaacagagtagaaagggctatgagacgaaattggtttacattggtttaaaccgctctaccatttcccatctctggaccttttgtaagtccccacgtctctggaagtcaatttcttcaactgtagagttaaaaaattctgttggtggttgttaaattatttcatttttaaaaagacaatgcatatatactgcagcatgaaattcaaacgtacaagtgtatatttcagtccacagtaggcaggcacttttgtagcctgctcatttctctttccattgtattttgagcaaatatttccataggtttccaagtcatttttgtaactatcatttatattcttcactaataggtctgtttgtcctagctgttcatcaagataaaagccctttgtcttctattataaatgctttgaattttatttaagttaataaacatactttgtatatttaccttgtatcaggtaccatggaatgtattcaggattatgatagaaaataacacagaaaatgtccttgcccttacagggcttatgttctagtggaggatgtagatagtacactagaaaacacaatgattttagacggtggttggtattttggaaggaaaccgtagctgtgatggagcaaaagagggagtggacctactttatagaggatgtatatattaatgcatgtagccttttctaccttcttttttttgagacggagtctctgtcacccaggctggagtgcagtgggtcaatctcagctcactgcaacctctgcctcctaggtttaggtgattctcctgtctcagcctcccgagtagctgggattagaggcacgcaccatcatgcccagctaatttttgtattttcagtagagacagggtttcaccgtgttggccaggctgatctcaaactcctgacctcagatgatctgcctgccttggcctcccaaagtgctgggattacaggtgtgagtcactgcacccagccttctaccttcttattgactgtttccttttaacgtatttgagactaacatttcaaaagatagtaacaatttcacaaactcttgatagcagacacaggttttggaaatagttttgccaacatgaatagcaacagcatcatgtgattctgcagcgtttccaccccaggaatcctcagagtgtgtctctctcactattgtctgggactgtgggtgttagaagttggactgagctgattaaaagctgaactcatgatcatctattgaagtttggtttgcaggtctatgttttattccagcctgggtcactgctaattgggtgtaattaacaccctcatgacatgtaaagactccaggattaggagcaacgggagcactagggatctcttctcatatccgacactaacttgctttgtgtctttgagagagtcatgaacttctctgggattcaattcctctgctgtaaaaatgagggggtaatttgtcatgaaatagcttctagatttcatcccatgtgccagtgttccactggatccatgagaaagagcacacagcagtgggctgtgggcaagggacaggggaagatgtaacacacttgacttgcatttgctaaccccaaattaggtaatttttctagtatcttatctaactataaaaatctgctacctttataaatcagaatctcaattctttgaaattttctgcatcctaatgacccacctaaacaaaacagatacttgctgattttggacatcccagcacgctttggagactctttctctccttctctctctctctctctctctctctctctctctctctctctctctctctctccccttccctctctctctctctccttccctttctctctctccttccctctctctctctccttccctctctctctccttccctctctccctccttccttttatctctctctctctctctctgtgtttctgtttgctttttcctctagctgtcaactcatcatcattagaagaatgactgtaactgtcaggctttgtgtaactccgcaggagcctcaaaaccctacacaaaaaataatatttctatcctttgggatagacacggtgcctctgctaaaatgcttagcttagaagcttggttaggcttccagatgtgttctgactcaggaggcagtttgcactttcaaaactgggtctccaacaatgctggttgaaggtacacagctggctcaatgtgcttagaggcttgctttcttccgaaagatgatttacctgaaaaggttgacattcctgagcataagaatctctctgtgcctccccgacttccaccccccacctccagacctccctgccacccaacaaaatgcttctattggaggaagaaaaaggttctgtcctgaaactaccataaatagcttttcctttctttagacattatggttaatttcattacagtatataatgaatgaaggacattcagcatgaaaatgtatctatctatccactgtaattacatcaacatttttaagcttaaaaaaatgttagagaaagaactctttcacatctataaccaagaatgctccatgtgtttttacaagaggataataaagacactaaatgggatagatggggctaagtagttttacagatggtggttgcatattaaagattaaattgctgtctataaataaaaccacttttacattaactaggttactgctttatcttaatttaggtataattgagagcattagcgttcttcataatagcccagtgaatgttcccgcagactgtaaacaggactccatggaatgctagctgatgaatttcctttgccactgagaagccctaacttaaaaggttgccctagaaactgctggtttccagctcttctgtttgactactctgacctaaaagtggtacatatcttttcattgccttatgtcgatgagtgtgtgtatacattgtacactgatatgttttgatccccaatgttggcttttcttctgtattttgatcaatatgactataggtagccagaattattgatcttcaaatcttgacctcctatctgcctggtaaaatgagaaccataaggtcaaaatggttacaaaataggaatgtattttgaagtgtatttatttaatttgaggatgaggaaaaaatgggaaatacaaaatatcagctttagaaagggaagggagaagtagagctataacttctcactttgattgtgctgtcactgccctcagtccggtgttcatgattgagaatgagatgttagcaacgtgattataagtgtggtctaaggagctggactagcgggttttagttctccccccgtactatttgtgacctctgtgaccttaggaaagtcacttaacctctctgtgctttggtttccttctctacaaaatgacatcataacagtatctgtcacacaggattcctgtacagattaaatggatttatccatgtaaaactgtggaagcaattgtgatgcatagtgataaccccaaaatatcacacacacacacacgcacatgcacacacacatacgcacccatgcacacacaaacactgtgtttttaaccgtcgtgtgctcttgaaacaattttattcattcattccttcaccaaatgtcaggggaatatgtactatgtaacctgtactgtgctagttgccagggagagaaaaatgtaaaaatagagtctataatctctaggaattcttgtaagaatatatattccgaaaaagcaggggtcttgtcattctaatccagtagcctcagtgcctggcatgtggttggtgcgaaagccacttgctgaatagacaaaatggatcatctgagatcctgaactccacccacagagccccaggaaatgcaggcagagaggtttcccttgaagcaaaattaatttacttttgtcaaaagaaggcattataggtgctgggcagcaaagataagtgtcccctatagacacagaaaagtgaagtctatttgtgtgagtttagaaaaccaaatggaaaagatgccataagacaaagtgagtcataaagacagttgcactggggtaggaggtaagagaagctcagtgtaggcgtgaaaattctgatggaccttagggtgtggagagggttttgatggctgaagagaactggactaggatattattgtagtgagaagcaggggtctagaaactcagccagcttcagggttctagagaaagacaaatcttaatcaaaagccctttttatttactggttttacaatgtgttttgtgatttctcccaacagggtttacttccctaattaaatttatcttaggcaaccattcaaaaacagcgtctttagcataaagggacagatggccaaagttctacctcccttccctggccgaaggagctgagtccaagaaaaggtgggctgggtaggaataattgttatgcaaattaccctttggtaaaattcctggaatgaaatgatttcatgaggatgagataataaggcaaagaatgtgaatcccagactcctcacactagagctcagctataaaatcgtagaattttagaattggaagatatctataagccctcctctccaactcctttattttatagttgagaaaactgaggctcggatacattatgcaaatttcccaaggtcatccatcaaatagtggcaaacctagagctttagcccaggtttctgcaagcatcagcagagaccattatgccctgtgcctgaaagaaagttgagaacacagaaaggatgttaaacagatctagacaggattctaaggatgggataacacaggtcgttaaaggtctgcagggaatttcacggcgttttattgggaattctgtagaattacagaacagattcttcagtgagattaatttacactccttctacttaccatcaaatcattccttaaatctgagctgggaaggtgtgatttggagcacaccgtttctgtacagatagaaccatataaaatttctaatcagtgactattttggatgcccagaaatggaagtttctgtagcattcaatctaatacaatataacacacaaatgagtgcttatttgctattctgagaacacagcagtgtggccaggaataattcatacttcctgaatcccctaaccaaattttccagtcctgctgtggccatgttgccttaatcaaaattcatctttctcctataatcttggtgtgcctcatagaatataaataccctattgggaaacctaggtgtttaaaaatctgataatggaaacatattttaaaagtcacagtgttctcacaagtaggagccgaacaacaagaacacatggacacagggaggggaaaaacacacactggggactgttgggaagttgatggagggtgggagagcatcgagaaaaatagctaatgcacgcagggcttaataactaggtgatgggttgacaggtgcagcaaaccaccatgatacatgttcacctatgtaacaaacctgcgcatcctgcacatgtatcccagaacttaaaataaaagtcatagcaatcattacctgttactgagtacttaccataaatcaggtgctgtgctaagtgctttatgattgtattttattctcattattaccctatgaggtataaaacacctttgttaatctctgttttacaggaggggaaaatgaggatcagtgagattaagcagttttgtacaaagtcaaactagtgttcaaacctgggagacagaattcaaactcaggtctgtctgaattctagatctgtacttttgactttcactgtattctgcctttgaaaaataccattgtactacatcctcctctcaagtcaccttttctgtatttgttgaaatcctcaatgcaaatgacttgcatttcctaaggcactactatcattagatggtcctgacttttcaaaagtttgtcctaatctcttacccaaaatgcctcccattccctttccactcattgctttgactcagccctgtggtatacttattacaaaaagacatcaatttcagtttaaccacctgcctaagtctgcacaaggtaaaatgagatcacattaattagaatactctactggggatgaagtatattggcctctcaagcagaccgtgaggataagaagtagtcctttaatttctttttagtgtgatctctggtataacactaggcagcagcagcctctccatggaacagctttggcaatcccatcttttcagggttcagaagcataagctggaaggactggtttaaatagcctcacattgcctggaaattaattttcagggcatttctgcatatacatataaacttacttaccctcttggcagttgcctgttccagggacaggcaactcatggtgatgtgtttgggcagaaataacattatccatgggttgcttaaagggtgggagaagtttctttttctttttcttttttttttttttttttttttttttttgagacagagtcttgctttgttgcccaggctggaggctagagtgcagtggcacagtgttggctcactgcaacctctgcctccctgattcaagtgattctcaagcctcagcctcccaagtagctgggattgcaggcatgccccaaccccaccacacccagctaatttttgtatttttagtaaagactgtttttaccatgttggccaggctggtctggaactcctgacctcaagtgatccacccacctcagcttcccaaagtgctgggattacacgaatgagccactacacccagtcaaatgtggaagaggtttcaagtctttattttgcttttctataagggctttatcaaagcatccaaagcatctgtgctatgtcttctttttgactgaagtcttcagctcctaactgtgtgttctttaagagatcagttctatacgattgagcaggttttaccatgaacaagcatctgcgatcaggtaagtttattaaatacaatgaagcagatttcttcctctcaattcaaaatttatctttatttgtcaaattatttggatcacgtttgttgcacactagaccataagttttgtaagggcggaactaagtctgaattttctcaccactgaatctctagtaactagttcactgcctgagaaattcagtatgtttgtgaactgaacaaataagtgagtaaaagaatgaactgaagggacttagacaaggaaggatagggaaaaggcctgagaatttactaggaggaggaaaagaacaagattaagagaataaaaaagaaggccaggcttggtagctcacgcctgtaatcccagtactttgggtggcggaaacgggtggatcacctgaggtcaggaattcaagaccagcctggccaacatgttgaaactccgtctctactaaaaatacaaaaaaaaaaaaaaaaaaaaaaaaatcagccgggcatagcaacaggcacctgtaatcctagctgctctggaggctgaggcaggagaattgcttgaacctgggagttggaggttgcagtgagccaagaatgcgccactgcactccagcctgggtgataagagtgaaactccatctcaaaaaaaaaaaaaaaaaaaagaaactttttcgacttcagaatttctccaaagctggtcttgctatcaactctgtgtgtgcatatttgggttatttggcttcattaagatggatggttatagtcatttgtagtgtctgaaagccaaaagctgcgtattctcaagatgggaggaaggatgtgagcatctgggtacaaacttactgtgagcaccctccttttgtaacccttcaaaccctggcagctggtcagaggagtctggttaacagttgctgctgcatttcaatattattctgtcttactcctctcagaaagcttcggtaggctacagtctgcattgtccatttttcctggagattggatttgccacctttgctggcagcttggctgttatcattgcccaaaacagccaatttttcatgtccacatcatcaatgggaacctaggtgcagagctaggaaacaaaaatgtggacacatgtttaaagcctgccccagctcacataggtcctatgcacactggatagggggcttaaggagacagtaaagctgccaaaggcaggaatttggttcagaaagagagttcttaaagctgcatttaaaagtcatctaaagtcactctacatttttctagcaaatgtaaataaaccagaacaagaattgcatacagtaagctgagacattcattaaaaaaaaaaaaagaaaagaaaaaaaagttagattaactatgtatctaatttggaaggattttttgtgttccagattaagagattcaataaacagtattctaattgttttctattgttatggtgggagttgtggaatcctattgccaacaaaacactggcattcattttcaaatcataataaatattgtgtagaatttcaattgctttttaaatgaaaactaattaagaggaggtagctggaacttaacatagaaacaaattaaatcagcgtgtgtgtttgtatgtatgtgcatgtatgcgtatatatcatttgaaaagtactttctttttatattaaggtaatatagacattatagaaaatttcaaaaaaaagagcaaaaaaataaatgaataaaatgtatgcagactccaataattcctgaaagaagggttttattttctgtttatccagggatgggcagacagattggacagtccatgtactttcttttttcctttcttccatctctcccctcccttcccttcccctccccttgcctctcctcccctcccctcccttcccttccctctttcaccatactattttccagcagcctttttcaactaaaaattgatgggtttgattagtagatcagtttaatgccatagatgtgtgggtctgggttcagtgaggcatttaacaatgtctcttattacatacttgtggacaagatggagaaatatagtctggttggcagcataattaggtgagttcatggctggctgaacagtcatacccaaaggaccttgattaatgcatagatttcaacaagcaggaaggtccctgtggtgttgataagagtatgtttaatagatattatgttcagacagtccccaggatgtgtcctgttaaggaatttttaaagaagtgttgatctgtctactccagataccaaaatcttgacaaaacttcccatcggagtccattaggcaatgatggagcagtcttggaagaatggaatcataaaagtagagatgatagccttgaaattgctatgggcacagagaaatctgccctccagcactgatttgctaccaagcctggagaagttttgataactaaaggttttaccaagaagacaaaagttatgaaatatttgctaaatccttactcagtgaactgctgagtttgctaaatagttaacctgatgtgcagtagaagaatatcaaactacaatatggtacaggcaattacttacacttcattctgtctgcactgagaagttattgacatacttagctaatgaataatgaaaatatttctacctggttccatgttagataacaaagccattggcctttgttgagctgtcgttctgtgccagatactgctcaagactctatataacttagctcattgattcttccagcaaccgtatgatacaggtattagtattattgctatttacaggagagaaaactgaggcagagagaagctacttcccttgcccatggtcacacagttgacttagggcatggcaggcaatccattccaggcagtcttactcttgagcctgtgctggtcaccccatgtagttgtagtagcttcccttgacctcctgagtcaaccatacccaccgtgcttcagctgcatttccactgcccaattttcatgctcatctcacttccaatcactgcttattcttaccacgatttttcatcctcattgcagagagctcatggaccttgtagtttttcaaaaattatgctctaggtatagtctctcactaagtttttctgaagagtttatttcttttcccacatttttctttggataatgcaagctgcagctctctgcatttctctctgaccacattctccttttgctttcttcccttttctaagattatacaaccacacttaataggcttttcagatcccaaagtttttgcaaagaagaaacaaagtaccctccttaggttacacatacaaagaaatccaaattgtgcagaaacaaaatatttcttcttaggtaaccctcataacagctttcccttttatagccaccaagttttttagaatacacctaatagatgcatgccaaatgaatgaaagccaacagggtccttggattttctttcctaacatttattttaaaacataggagttagaaattacttttaataaatttctgaatgccataaagctaagattccacggtgaatgatacagtaaagattcaaattaaccctgacatgctggaatgatggctcatgtcaataaaatgaaaggtaatgtagataaatgtgagatattatatttgtgctatctcccaaatagttgcacaagaatggaataaagaaaagaccctaattaataggaatttccataaaaatgattggagatagagtgacttgagcataaatttactatgacccagccgaatcttaagctacattaggtagaatagttttactcaatgattataaacattcatcttttgtctactattagataatatttgattcagttttgaatattgtattctaaaaatgtcattgccagatgacatgtgtcctagagaagacaaatagaatagcatgaacttagaaactgtgatgtatgaaggaaggctgaagaaactaaggatttttattctgaaagggaaaaatattagaggagaaataagataatatgacatttgaagcactgtcacatggaagaggaaacaggattgacttgtcccgctagtgtagagcaaatggacaatttcttctttatgtagaaaacataaagggaactatattataaggttcagttacagaactagctgttttacaaggtagtgagcacccccaccatcacaagtattcaattaggggctggaaaattatataccatggatgctgtgaaagcaagtgttacatgtaaacatgaatgttcatagtagctgcattcacaatagccccaaactggaaacaacctaaatgtaccccagtaggtgggtggataaaccagtgatgctcaaccaggggtggttttgctctctgaggggacattttacaatatctggagatatttttatttgtcaaaattgggaagggcggtactctcaaagtagttagagaccaaggatgctgctaaatatacaatacacaggacaacagagaattgtctggctcaaatggcaatagtgccaaggttgaaaatccctggaataaaaaacaaacaaacaaacaaaaactctggtacatccatacaatggaattggtcagcaaactgctgatacatgcaagaccatggattaatctccacaccattacacttcatgaaagaagccagacatagaagagtataactttatttgtacaaaattctagaacatgaaaactaatctacgataagagaaaacagaccagcagttgcttggggccaatggtgatgggagagaatgtattgcaaagggtcatgaagaatctgttggagttagaagtgttctgtatcttagttgtggtggggctttcacaggtctgtacaactgtcaaaactcattgcattgcatacttttttaaaaaagtgtgcttgattatgtataagtcagacctcaaattaatctttaaaggaaggatatctgcattggaaaggactgcactcaaaatgttctgttttgtttctcaactccaagatattttatttaggtccattgtgttaccaatccagtggacagagaaaaaagtctgtataaaaccttgttatatcagtgagggtccaatcatgagatagaaaccacacaataagttaaagaaggaaagtttagtaaaaatagctattaaattctgatgaaagagtaacaagaagacataaggaaactttccatagtaccccggggctgtgagagattacccaaggaaggctaaactagaagggaaacttctccccaagatttggatttatactttgttggagacaatgtggtgaattcagctcattgaatagcaaagaagtttgcttgtttgtacagataggagatgctcttcagtcattggccaagcagcaagaaatcctctggagtacatacaggatataggcaattatcaactggtggtgggagtatacaaaaggaagagttcatggggtgcaggtgagccaggcatggttctacagagagagcattggcatggtggcaagagtggtgatgatcctggctgcaggagagttgagtgtggacttgaagatggaatgaaggctctgatttgaggtcaggagtgctggagcttgtgatgtgcctgtcaagaaaactgcttctaggttattgtcaggcaaagcaaaggttgtaatgttgctgaggaactgtgtgctctggacatgtggctgggtcagaactccactggaagtcctcatacctgcaatgctgatacactgtgcatcaggaaaagacgacaagaagaacctcccttctgcaatgtgccttcaggagagagttcaacatcatcttccttgtaaagaaaggacgcttaaagaaactgaccattatttaaaagcacagcacatattgaatggtgactctggagttgataagcaataaatagatacttggcatactttttttattgttagggttgaattatgtcctgcataaagatataccaaagtccttaggcaattacaacagctttacatgataggactcatggaggaaagctgccctgcccacaccatggttggggcatagccagtgtatggcagtctctgaaggcagttgcagtcaaggacgcagggtccctggctacttgtgttcctactcatgtctgcattcctagcacagatgccttcattcagagacctctttagcagggccctcctgggataatatcttccccaggtacctttgctgagggcttcttaatgggaaaaggggagaaatttcaaagactttttttttttttcactgtggcttagtactcagtacttttccactcctattcctaccctctctccttcccttggcccctgtgtccataacatgacaggggcatttttggagcctccttcggtaggaaaggtgattctcaagcctctgctgaccacctgacccttgcctggagccttgcatagaggaagaatgaaacactggggaaccagcactttctcctgtccagcttcttgataggctattacagtgattgaaggcttgatttttattttaaaaaatgtatcaaagtcctaactccaggtggctgaaatgtgaccttttttggaaatagaatctttgcagatataatcaagttaagatgagatgggccctaatccaatatgactggtgtcattataagaaaaatgccacgtgaagacagaaacaaatggggagaatgctgcatgacaacagaggcagagattagactgatgcagctataggccgggaatgccaaggattgaggaccatggccagaagcgagggagaagtctcagagggagcatggtcctgctgacaccttgatttcagacctccagtccccaaaactgtgaaagaatccatttctgttgtttcgagctacccagtttgtattactctgctatgaccatcttagaaaactagtgcagtttggtaccaggaaataggggactgctgtaacaaatatctaaaaatggggaggtagctttggaatgggataacggatggaggctaggagagtttgtggcacttgataggaaaagcctccttgaatgttggtagatgtgtacatgtttaaggcgattctggtgagggctcagaaagagaggagagctgaagagacagcatctttcctcttagagaatatgtgtatcatcatgaacagatgttactagagatgtgaataataaaggtgcttctggcaaggtcttaaaccaaaacaaggagcgtgctattggacacgagttaagaccatccttgttgtaaagtgtcagagaatttagctgaattatgttctgctgttgggaggaaagtaaaacttgtaagctatgaaggtgaagagatttctaagaaagagtttagaagtctcagcctggtgtctccttgctgcctatagcaaagtgcaaaagaacagagataaattgaggaatgaattgttaagcaaaaaaaatctctgggattaccagaagctggaagagctgaggaaagtttctctcctccaggctttagagggattgtggttttgttgacgccttaatttctgacttctagtctccacaaccataagattataaatttccattgttttaaggccacaagttgtaggtattttgttacaggagccttaagaatctaatacacttggcaggtttcattcattcattcaagttttgaattaaaacacatttagtaattataaatggtttgtgggttagaatatagacaaaattttatttttctgtattgtagtaaaaaaatcacattaaaccaaaagtaacttggtctcagtgaacatggcttgattggagcatttgcctaaggaaatatttttagtttctgaagttgtagcattcttcagttatttacattttactagaacagaaaccaaaaccacatttttatgctaactttcttatttgctttcccatgtgtgaaaatctttgtttattgtactccattcagaagctgtatttcttcaaaatagtaagggtttcagcagagacaccttattttctttaaaaatacaaatatttctaaaatagcattttttaaaaacttgctttcattcttcaagttggtcactcttgctatgcctttgatcctctaaaataatttctgacatatataaaagggcaacttgacattcgctgattgaatatgtagtagttgttcacaggaatttaaatttcttttataacctttacaacttccaaaagttaaatgcttaaaccagagtcatttccataaaaagcacaaaacagtaagtatttgacacatccattcaaaaatgtatcaaatattccatccctgaatggtggctttagatatttggggatatttagtgaagcaccaaatttatactattgttttggctcacattcaggaaaacatagaagcaaataaaattctctccactgttatttctgcctttgcttcaagacccctgcccagtaatatctgaccctggggcaaacacagtaatctgagaagatatgaaagctgaatcctttccctatgccgctcatagtaaggacagaaaaatgtaaatgtctctcatgccctacttcacagttggttgggagacatgtgttctagtccctgtttgagagcttgggaattctgagactatttaactcctctaacttgttttcttatttgggatatgtgtatgcaagtgatggtgtccaagagacctggagtccagtccaggcctttctataacctagctgagtgactttgggcggtttaggacctttcccagctatgctatgtcttccagagccactgatgtgggccaacccctccccagtcccagcctacaaaccacactgtgccaacgcccaagtctttctgtggcaaacacaaggaaaggaagagcctgtcagaaggtgcagtggccatggaaagaggagcccagcagctctgatccccacaggttcccagacctgtgctgaaggagaatcctcattccccagcaggcaggcaggcaggcacacaggccagacacactttctccctctccgtccccataaggacaactctatgtacatgccccaaataccaagacaggcatttcagttaaatattagtcactaagaaaatggggttttggaaattcactttgtaacatgtttattcttttgcgtgactgtaggttttgggggattacttttctgatatgtttgcttttaccaaaaaggaaaacttactgttgatgtgatcgatgtagtagacaccaatctgagggtcaaaccctgattcccatccccatggcagctcatccccaacacagtcagcaaatgacaagggcttcgttaacctacaacaaaccagaatagacacaccagtgattctttccctcaaaccgcatatgtcaaaattcagcaccttgattaacatctctaaacctcagatttttatttgtaaaaatgaaaaaaatacaatattcatgcagatattgtaagaattaaatgagatagtctatgttaaggataaacacaagttaccttgttaagagctcactcatgatcatcatcaccaacatcacgatcatccacctgaaatacagggactatgatgcttgaatttcaagagcatgatgagaatcacatgggagagcctttgttaagtgtttaaacaagtgactagaacatggtgagtcttcagtggattttaatttcttcttttccctcaaaacttgaaactctttgaaagatgccaattttaacagggatttttttagaggctaaagataggtttcttttttaaaggaatttaacctgaatcatgaataaaataaagccctttcaaagaatattgtaattatcttatttttcattcaacagaaaccatctaagagtgcaggatctcttgattagatgccaaagtgaagggaaaaaaaatcacctgagtccaagcaccctgaataaagtacttttttgccctttctctttccctcctgtctttgtcttctccctttgttcccaacctccactttataagtacataattgtgtgtatactatgtggcttacactattctgagtgctgagacagatggacattagataaacaggttcactgcactcaatgttcaatgttctagaagaaagcttgtagtctaagtggagagttaatagtctctcttactatcccagtcattaaatccttaaaacaggacttttcaaacttctgtgtgcatgagaatcacttgaatgatttgttaaaaacagtctcttaatttaagaaaatgagagtcaacggtttggcaactatttcccattttgcctgtgtcttggaggaattgttttgtttttctgggactcagaaatagctcagtggccacatcttacacaggaagaaatgaagagccctttctttgcttcccatgtcttctctcatgttttaaagaattgtagtaaatatttattagcgctttgataagtgcttgatgatttaaagaagagtatctaatccatttaacataccatcattgcattgaaaattagaaaaggccaattagcatcttgacttaactgttttcagtgaggcgattttcaaggtttaactaaactgatgtgtaaagtcataggttcagctggacagcatgcatttacctcctgtttccttctacagattagctaggatttcttttttatgttccctgggggtttgaacaaggaagaggtaagtattggctgaaagatttcatgctcatttacagggaaatcttctttagataacccctcctcctttccacccagactattcaaatatgtgtctttattgcatatggcaccgctataatgaaagcaaaggcatcactaatggattgataccatcaataaagcttctgtttggctgaggtctttcctttcaaacctgagctgaaggtcaattagaacaatgatggaaggcagttaatttcctgtttataaatagagactagaaaatgtagtattgattgctgcatttcaaggagggggacaactaccctcaactgtgggcagtctaggatgatgtaatttataaagccagagaggacagtgttgctgcttatatcaactgaacaatgatttatttgaccaaaaccacattaagtctttgagtctgaaataaataaaatatagccctgccttttaaaggtttaaaattttagacatgaaatcaagatctggaaatcattatcataattgtgcatatgctaatgcttttggagttcaaagatgggaaagatccactggataataggcactgcaatagaattcataaaggaaatgggatttgaccagaactttgaagaatgggaaaggtcccagttaggcatgccacagacagagagaccagacagtgatggatccagcatgagcagtcttaaatattgtgtctggttatcaatgttgttgtatgaatgagttagtgactgactgactgactgaatgaatgaatgataatctggggcctgttaccctcagctcatttatttcatagcctgagatagttaaggggtgactcactctagtataccacaaccccagagtcttaaattaagagatacagtataacagcatctacaggatgttaaaagatggttcacaaaaaggagttccctaaccaaataagttttcaaaacactgaggtgaagttaaacagatcacattttactgcaggcttcttggaaccttgaacaggtggctatgccttgtcattcttcaagaagttaatagaatacacaacatttcccaaaatgatttggccacagaaataatgaaattaattaaatatgtgtgtaaatatagacagatatagtagagatttttatttccagaatagctcatagagaaagtggttccagggcatactttagaagctgctcacacaaaaccgttttcttttgctaggcttttcttaaaccaggagtacctttcaatgtgagtctgtgcctatgtccagacttttcatttcttacagcaactcttcccctttgtaatgtcaattctaaaaagcatgtaaaaatgtcagaatatgtggtataagatgtgtattgcattcttattataaaagcatattgttttttaatagtttataaaagatatataattaggctatttgatgtacttggtctttcctgttgagttaacaaatgtcaaaaaacccatcatatactcaaaggagtttctgtaacaggataacattaccagaaattctggaagaaagaaaatgaggagaactttattactatgaaatgagagtaaatttaatgtgacaaacaagcggataaaatgaaacaattttaattttgtattaaagatagctataatgaaatataattttcttagggggaaaaacctttcaggctataaattagttttcatatataaaatattgttaataaattcatttttgccatggattttcactctttttttctcgggtcctttccctttttacttatcaggaaagataaggactctactctggagttaatgttgataattttacttcacataattaaatcccaagtcactcatatttactcaaggagcaataagcctttaggttctacttaggagggagatatgaagtagaaatctcacacttactcatttgactttcttcctctgaaaatatcctttgtgactgaccaggtttctttccttccttcctggaaaataaattctgcattgcctctagtgctgtatattaaatcaaaaaagtttggaccctaattgtaccttgagaccttgagcttcctacctgcatagttcttacaaatattagagatttaggccagaggaagaagtatgagtgaaggaagaaatatgtgaaaagctgtttatacaacagtaacactaaattttatgtactgaagttcaattatataatgactcagaggacaaaagaaatggatgggaggtgggagtgaaaagaggaaaataaatatctgtgcttttcctcttgttcaaatgaggccttggccttttagttccatggcccaggaatccacagccagatgacaataacaataaaagctaactgtgaaatgttatgtttctaacaacccagcttctggcttgaaggaacaatgatttaaaattccaaagttaaccaagactatgtgcatgtatattttttttctaccttatgacttctgacacctattcctacttaagatgctactctactgaaattcacattatataaccttagaactgaaggaaaccaaagagatatttcttagtttaataactcttacttaactattggagaaatcaagacacaaagaaaggaaaggacttaatttactaaattttgggtgggtagatacaattttgatctctttaattctaacaaagtatccatttcactgtgcttataaatcagataacctaacttattagaattatgtatagaagaggattaagtggattttgactggctagcaatagaaataatagtgaggaaagtattcttttatgaataaaacacaagtgtttagaatatacagatttttctttattctcatagtgaaattctcaacagaaaggctataatggtcttctttaattttatggatttacattaggttggtacaaaagtaattgcagttttggccattactttcaatggctaaaactgcaattatttttgcaccaccctaatagaattgtatgagtttagcctttatagaaggctataattttatgggctatgaacttatgcagacttatgaataatagacaattataattaatatgaattctgatgaattatattgtgattcatcaagagcttcttattcttgagaaaagttcagcatgaaataaacccaactctctcttctttcaaactcttccctcaatttggaaagattgtaatgacactttgaaagagtggcccactctggaaaacatcagagacagtgtgtattaacagcagtttgtttttttggtttgtttgtttgtttgtttgtttgagacggagtctcacactgtcgcccaggccaccacgtctggctaattttttgtattttttttaggagagatggggtttcactgtgttagccaggatggtctcgatctcctgaccttgtgatctgccttccttggcctccccaagtgctgggattacagacatgagccaccgtgcccagccttaatggcagtttttaaaaaggtgttgacttttcccaaagaaatcccttttagagagcagacgtatagtcttggctttcaagcactgataaatttgtaataaagttctatgggatttaggctttgaggcacaatttttttttacctgaactatactttttttggataaattaatctcaagagggaatgttttttgttgaaattagtgtggtgttttctgaggtatggatggctaaaaggaacagaaagggagaactgagtagatctttgttctcctaatatcaagagcataagattgtgcctttgtcactgaagttctgtctccttcacttacttcactccagatgggtgtgataaaaactgcccagctaaggccaggtgcggtggtgcgtgctagtaatcccaacactttgggaggcccagacgggaggattgctttagctcaggagttctagaccagcctgggcaacatggcaagacctcatatctcaaaaaatcaaaaaaatgagccaggcatggacaggaggattgctttagcccaggaggttgaggctatagtgagccatgatcctgccactgcactctagcctgagtaacagagcaagaccctgtcttaaaacaaaacagaacaaaacaaagctgctcagctaatgatgatgatgaaaaacaaattttagctaaatttactatgtgccaagtaccgtgctcaatgatttgtatgcactgtcttgtttaaaactcacaacaatcctatgaaatagtcactattatgatatccattttacagatgtggaaactgaaactagaaaagattatgtagcttgcccccaaatcacaccactagtaagtggaagaatctaggtttgaatctacatattttttttttttttttttttttgagaaagagtctcaccctgtcacccaggctggagtgcaatggtgtgatctcagcttactgcaacctgtgcctcccaggttcaattgattctcctgcctcaccctacagagtagctgggattacaggcatgtaccaccatacctgactaattttttgtatatttaatagagacagggtttcaccatgttggccaggctggtcttgaactctggacctcgtgatccacctgctttggcctcccaaagtgctgggattgcaggtgtgagccaccatgcccggccttgaatctacgttcttaggcaccattttatatgagaacatcttcagaacagacatatacagaaatatagggaactgtttcttcatagtgttcttagagacccttgttgaaatcaaagcaatggtaagaaagggtgcttgattcaccgaatcccacttttaggagaaaactgggaatagtactttaacttcctcttcatgctttctcttccccttgaacgaacatggcttgcacaatacaccacagttcatgaatgttccgtgttatgtttgtcaaataacgtaatgacatttaggagtgggtggagtgtagcagaggtattgtagcccccaaataattgaaaggcttttatattgctattgatttttttaaagtcaaaactccaaccattctatggctttaacattacggcatttttctatagttgaaccaaaatgctacttaggataaggacattctgcacacttcagattcgttgagctctcttagaagcaaattttccattgtctcagctgcagcttgaaaataaattggatgttactggacactcatccacagtgctgtacccaggggcgtgtatgattaccagagggattcagggaggggcgtgtgtgattaccagagggaatcagtgttacatcctctaggattccctccaggaaacctcctacctacctgttacaggtaaggaccttaggtgtattcttagatggtggttctcaaaccttcatgtgtgtatgaattactggggagccagtgaaaatacagattaaaattctgtaggtctggagtggagccatgtggtgctgatgctgctgatcctcctagctataaggaagaaaacttttgtatcctagtgaaatgaattgatataccttgttaactttgggaaaataaaatctttaggcaacgttctacagttacttctggtaaggttcatgagaacattgtaaacttggcaaaatttctttttagacatctccgtaagtacaaacgcacagcacagtttgtttcctttggtaactctcactccccagaccattaggtattcatgatcttctaccctggaggccgcctccaagagcatctctctttcatcccacttggctctgtatctccaagactgttgccgctcttgtctctttctgacccacatcaaaagttaactttctcttgtcccacacttccagaggcttaccttcaggctcgttccaattgaatcaattcaaagcctttatctaaaaacaaaccagtcagggaagttggatagagatttggcaccggaggaaattcctgggacccttgaggtgatgtcacacagatattggttattgtttgcagcaacaggactcagcactttctactaggctagcagtctcttgtactcattacttgagactatcagacttctttgctaatggacattttgtttttgtttcagaagttcgtagttggtatgtgttggaaaagaaaaagcaatatacttattccttcccctttgggacaatatctttcaaatctctcatttctgtgcagcctcccaagctttctctgcagccagcaatgtcatatacaagttgtagataacaccggaaggcagcttaaattatttttcaatatattgtgagagtgaaaacgccaagtcatatattttagtgaatagatgcaactataaaaattcagtgtttccttaactggcgaactataggggaggattaggtgacaagggaagtcatttcatctcttctcttggtaaaggcttctacaaagactctagagagtaaaatgtttcaagaaataaatttttttaactcttgtacacaactatttattttcaaaacatgttacaaacactgattaaactacctactagcttaaagaataatgacgactatcgggcgttcaattggtcctcatgtcttaatgaaaaagtttttcttctgtttctggtaggttttgattcatttacccaactctcccctcagtcacttcagcacagtgcaagtcagagagaatgtgtgggaaagtgattaagagtacacactctttccagagtcaggcaagagctggatttgggttcttactagatgtgtgggcttgcacggataacttagatgctttaaaatttgatttccacatctcaataatgggtgactgctgggacagagaaacattatgatgtagaaggattgacttctccattaagaagagtaggtgcagtatccacaatacttttagatcccccacaaaagtattttatttgaaaattataccaaaaaaagaactttctagtcaaagaaaatgttttaacatacatttgatttataccaatgtagtcataaaatgcaattttttattttttttaatgaagaaagaggccacaaagacaaaagtgcctaggacccacaaaagccacaaagggcctgtagtgtatgccgatcactcaacacagtgactggcacatgggagacatgttgaaggttgataaacatagagggccagacggtattttaggctttgcaggccagatggtctctgttgcagctactcaactctgttaatgtagtgtgaaagcatccatagacaaagtgtgaacaaatggggaaggctgtgttccaataaaactttatttacaaaaccaagtagcaggctggatttgattcataggccttattttctggctcctaacttaacactaagaatttcgtttttggtagtattgaaaagaattttagttttattcatttaattatctataaaatatcctcaagggaaaaggatatacctgatatattttggagtattccagacagtcaaataaaagagaattttgttaaaatctcagttattcaggattcatctggttagaacaaaccatcacattttttctcactgcactaaagaaagaaagcaagcataagataataaaattctatggttctacctcaatgttcccagaaacacctgtatggaaaaataaagcactaataaatgcaaacaatctctcttgagttgtgatatgtgtatttatataaatccataaacagagatggagcatgatgacatatgtagctatgttctgcaactatcattgtattaatactttcaatctctagaaagctgcttcctgtgatttctttggcagatcaagcacttgcttaaagagaaaagacacatataattaaattggaagggcaggcaaatcttcccacagactaagccttcagtacaaagaactatgaggccctaaagaagtgggcatgagcccatatattaaagatatgtatttatagactataggttgctgttcatattctctggaagccagaagtttagttcacatcaactttggactaaggaacaaatgtctagctttgttggaagtgtatgtgaactgtggtggctattagaagtaggaggaaagggaaggatcatagcctgtagaagtaaattcagagtttgctgcttgctcactctgcagtgttaggaagctgatttaagtctgagtttttataactataaaatggggttaagaatatttataaattggccaggtgttgtggctcatgcctgtaatcccagcacttcaggcagccaagatgggaggatttcttgaggccaagagtttgagagaagcctgggcaacataatgagaccccatctttgcaaaaattaaaatatgcatggtggtgcatgactatagtctcagctacttgggaggctaaggtgggaggatcacatgagcccaggagtttgagaccacagtgagctatgattgttttactgcactttagcttgggtgacaagagtgagaccttgtctcaaaaaaaaaaaaaaaaaaaaagattataaattgtttatggccactaagaggattgcatgagattttacatgtaaagtccttatatcattgattgacataaaagaggtactcagtaaatcattatattttaatatttactaaaagtagaaataattattgctgggttaaatgacaacagagaagggacaacctaaaaagaacaagtgctaaaactgtgggctctagaatttgaatcatccccgttgaattgttaggtgttttatactgcacaggttttctttgtctgatcttgaatttcctcatttgaaaaatgcatacaaatagaacataccacataagactgttggggatattaaatacaataatgtggctgtgtgtggtggctcatgcctgtaatcccagcactttgggaggccaagatgggtggatcacttgaggtcaggagctccagactagcctggccaatgtggtgaaaccccgcctctactaataataaaaaaactagccaggcgtgatggcacatgcccgtaatcccaactactcaggagactgaggcaggagaattgcttgaacctgggaggcagaggttgcagtaagccgagatgacgccactgcactccagcctggatgacagagtgaaattgtgtctcaaaaaataataataataaggtggataaactttggcctagtgtctggcatggtgcaaagttcctgacatattgtaaatattatttacgtctttctccttgtctttgcttattgcaaggcatgggttcttggaattcccctagagacacatgaagagcatataaatcctctagaaactctgtgtctacccaagcttgtgttttttgttgttgttttgagagtttttttagtccatatttgcatttttctggagttgaagtccatagcttccatccacttctcaaagatccatgacacaaaaggattaacaaatcgtgttattaaacagtccaaaagcgtacattttgagggcatctgccatagcctgtattatgattgcttattatgataatccaagctattaagaaatcattccctaaaattagtataccatatttaaagagctacccaagtatgcatagtaatatattttagcaagatttccagatactgaagaacagatttttatatttatttaaaggagtgaatattagtattttggaaaatcaattgaagtgaaacaactcattccttaatgattctggtaataattgcaccatggggcagaaatacaatagctaatacgcatttatcttttccagtaccttccttacaagtgacttatatatgtattatgtcatttagtcctcactacaaccccagggtaacacactgtcattgctagtttcttacttgagattagctctttcatatgttggtgtaagatgacagctcgccatcgatttgattgggaatgaaagtactattgttctctgctattggtaatgaatacttggtttgactcagctatgagaagaaatgctatgagggacagatctgtcaaataacacattcagagatgcgtaaacatgggccaagttaagctgaggcctctcatgctgctagttctcaagtctccaaagttcacactggtttaataaacttagaaaatatgctgattatagaaaggggcacagtttctgcagtaatcagcttctactgagaaatatgtatacattatattcaatgtttccatgccaggctaggttgctaagggccttgggaaaataagttcacttgtatggtaaaacagcctttttctggatgtaaacaagctttcttcaaattcatttatttcttgagaacatgagaggaaagatacatttatatataaaaatacttgtatattcaccgttagcttctcagcttacttctgggatattacgtgagaagatattaaaatagaagaattattccatatgctatttgtctaaatatgaatgattgttacataattcatgaagttgctgatgttttgagttttttttttatactttaagttttagggtagatgtgcacaatgtgcagtttagttacatatgtatacatgtgccatgccggtgtgctgcacccactaactcgtcatttagcattagttatatctcctaatgctatccctcccccctacccccaccccaccacagtccccagagtgtgatgttccccttcctgtgtccatgtgttctcattgttcaattcccacctatgagtgagaacatgtggtgtttggttttttgtccttgcgatagtttactgagaatttttttctatcatttcttttgctccaaatttttctcaaaaagactttttttgctaatacaagtttgtactgtaacaaaacatttgaacatgagcaaatacagaggatctcaaaagcaatcataataaggactaattttactcaaattgtgttcatctctaataatgataaatgttgcattactgatttttggttgtaagcaacagtttccttaaataaatatttggaaacgtactgcgtaacttactaaactgaaggaaaaccttaatgactaaagtatacagaagtataaaagctaggtcacctctagggagctcaatcaaaatccctaagccttctttttttttgatgttgaatctgaaggattcatctgttcaaatttaaattttgaataaagggatttaactaggcagcattagctgggtgacttctcacccattgctaggctataggtagtattattacaatagacaaatacagcaggatttacatggaatggagaagagactattctctaggagagaactattaaaagacataattaaataaagaggtataccatagtcattgagcagaaaattccatatttttaagatacttctcatcacattcatctatagtgttaatgccgtcatgatcagtgccaaacaggcttaagaaaatgacacactatttctgaaatttatgtaaaaatgcagaggactaagatagccaaaataattttttaaaaagaaaaatgttgaagaacttacactaccagatttagtacaaatctaaagaattaagataggtatgatgttggcaaaagaactaataaattgaataataggacaaaatataaagtccagaaattgactcatacatatacagtcaacacacataccgtcaattgatttttctatgagagtgctaaggtcattcgatttgaggaaataaggcatttttacaaatgtgtaggaaaaagaaatttattttaaaagaacttcaacctctaccttacactatacaaaaaattaatctgaaatagttcatatactaaaatataaaagctaaaactattaaactgctagaagaaaacataaagagattatctttataagtttgagagtcaaatatttcttaggacataaaaaagcactaaacataaaaaaattagttagactttctcaaaataaaaacttctcatcaaaagacaccattaagaaaatgaaagggcacaaaagacttagagaaaaaatatacatacacaacgaatttatatcaataatgtataaatgatttgtataatcaagaataaaagacagtgatttttaaaagggcaaaagacttaaacactgcacaaaagaagatttatgaatggccaattaagcacatgaaaatgtcctcaacatcattactcattagggttattcaaattaaaacaccaactaggtaattttccatacactagaacagctaaaatggaaagattgactaaaccaagtgttgaggatatgaagtaactgaaactctcataccttgttgctgagactgtaaaaaagcgtaactacgttggagaattgtttggaattttcttaaaaagccaaatgtataccgatcttatgacccagcagctaaaagaaatgaaaacatatatccaaaaagggctttcaaaagagcatttacagcagctttttcataatagctgaaaaaatagaaataaatattcatcaacagaagaatggatacattttggtatattcctactcaccaataaaaaataaagaactaatatatacaatgacacagataatttttttttcttttcgaggccgagtctcactctgtaacccagtctggagtgcagtggcatgatctcagcttactgcaacctctgcctcctacgttcaagcgattcttgtgccttggactcccaagtagctgagattacaggcatgagccaccacacccggctaatttttgtatttttagcagaaatggggtttcaccatgttgaccaggctggtctcgaactcctgacctcaggtgatctgcctgcttctgcctcccaaagtgcttggatgggattacaggagtaagccaccatgcccagccatgatacaaataaattttttaaaatgctatgctgagtgaaagaaacaagacaccaaagaatacatactgtgtgattcaatttatatgaatttcaagtacagataaaactaatctatgtgataaaagagaaatgtttgtctatgggattaagaattgactaaaagagataggaggagactttggaaagtgacaatattagttgaaatggtggtttcatgagtgtgtatgtttatcaaaatgttataatctatgtatttcactgtatataaatttgcctacagtaaaaaaaatagctggtagaattcaaatgttatctaacataatgtacttaatttatccaatgcctacattgaataattacaactaggaattttcatctccagtctcacgaaagaattgagtgactatttcagccgtttgcctcttattttaccaactgtgcaatacttaccacctgtacttaatgatatacaatgttcccatctcatccacaggagataagttccaaggccaccagtagatgcctgaaaccacagatagtactgaaccctatacagatgctcctcaagtttccatggagatacctcccaacaaaactatcatacgttgcaaatattataaattaaaaatgcattcaatacacctaacttaccaaacagcattgcctgcggatacactgacaaagggatgattcatgcaggatagagagggacattgtgaaatttcatcatgcttctcagaatggcacacaatttacaacatatgaattgtttacttctgttattttctatgtaatctttttggactgcaattgactgtgggtaactgaaaccacagaaagaagaaccatagacgaggggactactgtgtgttttttataaattgttttctttgaaagagattgtaaactccttgggagtgtcatctgtatcagtggctctcaaactttaatatacaaaagaattacccaaggactttattaaaatgcagaatttcaggcttcaccctggggatatggtgattcattcgatttggcattgatccacggaatctgttttaaggagcaatcgaagtgataatccactgaccaccttttgagaaaaaatgatctatattgtatttgaatcatatccacaaggcttgagtgctgtatgtgtcaagaagtaacctatccgataaataaattagatgaattttaatacctttgataccagttttcaactgtagctgtttttttgtgtgtgggtttttttttttttctggacactgttagatagcatttcaggaaaggatcctaaattaaaagataattttccccagccccttcattttctccagtgggggagggagagcactttgtctcccacaagacacttggcctgtctatagatgtttttgtttatcccaacatgggtaggggttggcatggctggcatttttgggtagaggccagagatgctgctaaacacccacaggacagtccccatgaaaaagaactatcaagcccaaaatatcaatagtgaaagatggaaaaactgtaggatagtctttttggaatttaatgaacccagatactcctcagagtgattcagccttgtgcaagcaccgtgtgtcaggatctcacccaggcactctaggctgtgctatgcacttatgcgtacccttcctggcctgggacctgaggcctggctgctgacgctcctttcctgtaggtagcttgtactgactccttagcgcttctatagcagcttgtctcatttctttgacaaagcatctgccagcagcagggcagggagccctgaacatgggccactccaagcttgccgacagctctctttagtgagattggagatgctccagctggtcacagaaagaggcagccagctgggtttgaaaggaaaacagatttaattttggtccccattgaagcagaaaccaatctagagatgtgcctgctctaatttggaattcttaaaaggataattggggaaacaggtagaaaaagaaccacataacccaggatataaggaaggatggatgcccagtgagtgccagagttagtttggcctattttgccatgatattaggatgggattaacttgatatacgtgcattggatctcagtggttcagcacttcctagttcttggaccttggaaattaaataaactgctataagccttggtcttcagactacagaatggcaataataatgatgctaattccatagggttgttgtaaagactaaatgagctaatgcatgtagagaaagattttaatgtagtgactggcatataataagcattaagtaaataatagctattagccattattcttctgcaccattaacctgcaaaatatgccaggctccaccagcctctgactattcaataagtccccttctacccttttataccaacagtatgttggcacaaactatccctgctttaataactgtaagttagccattctccaagatacccattcattattttttatccattacagggtctctcccatgtgcccacaaatcagtctttcagctgcagccaccattatccctgactaatctttcttacctgagctggcttcccctccccacaaacccatttgcaactgtccctgctctgtcatagtgacagttcagactatgggtccttccaagctgctggtgttggggaggtcagagtccagctgagattcatgcagaagagaaaaagtatctgcaattctgtccctttttgtaaatagaccacagcacagtgcatctcttatttagaaatctttgctgactggttctatcattttgttcctttagcccctgtctccaagagaacctcagtctagccaaaagataggaaggaggagacaagatactttgtaattcctattttctccccgaagccaacacttccagccaatacttctagcaagcctgccgctaaccaagtaaacacccccagacaaaccaacagctgcaaacaattcctggagagttcttccgaagtgtatatttctttgatggtttcaggccccccaactcagcacattacaaggaattctattagaatactagaggatcaggacagggtcccaaaagaggagctatgaagcacttggaggggaaggagaccaaacctagggaaggcagaaagaaaaggagaaaaataaagatgtggaggacaggcagcacattccttgcagcagggtgcattggagcttgaaggttaagcttcccagggctgcagagtgagaaatcagggagggaggcaattgtctgctttgttttgacttgccgtggctgagggtaacagtcagctgtgacctcttcctcatgactaatgctgagcaggcttggctagcctaggttcccatgtaacttatcattaagccaagccaagaactggacaacatctaagtagtcccctacatggctgtttctgggggtataggagaatagcatggagatttgtggggatcctgcaggcctgtcagcaacctccagtgcagttctgggggtctactttttaaccaagtaaaacagtgagttttcagttaatctctgaaaaaattagtaaaatccacaaagtagtgagaaaagaggacattccagaaaggagctgactgtgcataagtgagagcggccgaagtggaagcagaattaatttgacagaggagctgagagggagtgaattaaaagaaataaaagattccataatctttattttttacctgtaacagctagaaagaccaaattctagtacagtcattctttttaaacatggccataacagacttaaaatttaagacttttaaagcgaagcatttgaaataaattgtgaaatcagggcatagaagaattatatctgaaactggagaaaagaaaaaatgccttcaagaaaatagggcatagtataatgcttccgtagctaaatgttgcacacaagggaattggaacacagtgaatggtaaatcccaaacctcttcagcaagatcattgtagaggaaaattgtcacctgagggaggaacccatccaggctgcttcagttataacaatgactctgggaatcctaatcaggtgtctgataggtaaactaaatccttgcacttgaaaaatacacctccagtctggctgatattacccatctaagtcacaggtttgtcttgaaatagatcttagcgctgtgatctcagcagggatttcttctttagagaaagatattttatgagcctagaagcagctttgttggaactcacaatatccttgaactgcaagcaacagcaattttagacagagcgttaattcagtgaatttcaagagaaaaagaaaaaaaaaaaaaaaggaaaacccatacagttgtcagtgctaaatgaactgaaaagcagtttgaaagagcatttcagagtcagtgctttctatgttctgttgttatgtttaaggaatcctttagtattgtcgagccccattgagtagaatggtaccaacaaaatatggtatttgtttagatatgtatgtttttatataatactttgggagatccggtacattgagcaagtgagactcacaagatgcaaccagacagtgaggttattcttccaagtacaatataacccatagaacccactccttatactcagcatttttctcatctttggataaacataggacaggccccatgacttttctggccactcttagataatgaggagtcatctgaccaatttgagtcacaaacaatctcatttcaattattctagacagaagatataaaaggaaagggaagtattccttggctaagtacacttgtagctggtagcagtgttctctgcacttggcctctattaaggagactttctgtctcatgagggactttgcaggcatctctcatgagctgttgccttgatggcaacaatagaatcatcctggttttttatagacaacacagcttaaaagtatttgagcaaaaaaaaaaaaaaaaaaagtgatgtcaaggtcataggcacttcttctgaattttgttttaatgatttgaactaatagtaatggaggtaaaaggtaaaatgggcagctaaaattttcctttcaatctattattttctatgtcattaggtgcaaaatgcagcatctctacaagaatattctctggaatgtgggttccatgaatggttaacagtagagaaaaaataatatttttatgaaatgctcatggaatctctggatcaaactgtcgtcaccatttaggcagtgcaggaaatcataaagaatggaaggagtggggaggggaatgggaaatcctgggagaacaatcagagggggagcattggtcagtgggagctgggtgctggagtcaagggtagggtgttgtatagcatttctcgcccttacctcatctgttaagtagaaataatggttcctacttcaatggttatggctgcttcatgtcaagtcaaatttctttattttcattacttatctttctgtaatttctgagtgtactgtcactaagattgataagggacctatatcagaaattcgagtgggctcctttcacccagccaggagttgagctcagcctcagacctcaagggcagtcactgatggcgttaatgccccaccaatgaggttcttttgagatcaggcacctgtgcaggtggctctgctccccctgggctactctgagccacacgcatctttgtgagacctcttgcgattactgagttgagctttcagtcctgaaaggaatccatggagctatcctactcagcaattctgtcgcttggtgtctgtgtttaagcagtttgggggaaacaacaggccctccattcaccttctacatctggctgaatcattctccagttgacttttttttgtttttgagacagagtctcgctgtgtctcccaggctggagtgcaatggtgcaatctcagctcactgcaacctccgcctcatggtttcaagcaattctcctgcctcagcctcctgagtggctgggattacaggtgtgagccgctacgcctagctaatttttgtatttttagtagagacggggttttgccatgttggccaggttggtctcgaactcccaacctcagatgatccactcaccttggcctcccaaagtgctgggattatagggctgagccactgtgcccagctcagttgccatttttagaagccaaaccctactacctcttagtcctttctggtaattcagccagctcctctgattgtctttcacctgagagccaaatcggcccactctcatgttttatttgatcttgtcagtgttgggaggggatatatgtatacatacaaaaatttaacattaagacacttttagattaaaaaatataattcaagattctttatttatttttatttttttcctgagacagtctggctatgtcacctaggctggagtgcagtgacatgatctcggctcactgcaacctccacctcccaggttcaagcgattctcctgcctcagcctcctgagtagctgcgactacaggcacgcaccaccatgtctggctaattttttttgtacttttagtagagacggggtttcaacatgttggccaggctggtcttgaactcctgacctcaagtgatccagccgcctcggcctcccaaagtgctgggattacaggtgtgagccaccacacctggccagatttcaagattcttatcaaagatatttaactggagctgagaaactctgccctgtcagggtctgttctctctgagtttccatgtgggtgcccacttcagtcattaagctcatgggcccaacctctgtaggcatttgagtttgggacccctgtcttagactttaaagcactaagacctagggagtattcacccattttgctcctacccctgtggcatcttacctatgctcacaactccaagaatccctgcatttgtccttttgttccagtacaatgaagagtagaagaaagaagatacaaatgcacttaggaaacaggcctggctttcctaaaagtcttggagtgatttctttcctcttctttctttctttaattttgttcttagagaggaggtagaaggcattgttgacacaaatcacccattcacaggttactgactgatacagcgagtttcagaatctgctctcttggttcttccaacactttccataaagaagttacccgctttgacctgaatatatgcagttgctacaatttcaaaccaaagcagacaccaacagctgctgtcttgccctgggaggagcccctgtgggtggaagatcagccctccagctgtcttggcttacatttcttcaccatctgactgggatggctgatgcaacagcaaggcaagttgctgtcacaaacactctgagtagtcagtagggaaatgtgccagtgagcatgttcccttggtcttgagggttgtctgactgtcatttctctgaacttacctgtatgagtatgttcaactctacctaacagctctgccttgattagacagactgtaatggactggtaagtaatggaagagttcagaggaagtgatgctttgattggagttttgattccattcatctgaagttccctcagttgtattgctctgtttcgttggattcttctcaaatgctttcactcatgatagcaaaatggcagcagctgctccaggcattacattggcataccacatatctacagtatgatagagcttgtctttccccagtctcttcttgaataaaaaccctgggcttcactctaattaaaccaacttatttcacatgcccaacctgaaccagccactgtgcaaaggaaatcagatgaccttgatggcttttagctgggatctttccttgacactggtggtagagtcatactgcatggctgctaccccagatggcacatgggccgttatagtaagtgttctaataacttctttagctaactagatttgtgggggaatgaattaatgtttttctgaaaccctgctctcttctggagataatgctgggtgctttacctactttgcaattgccactactgaaaatcaattgttcttttttaatttctctagaaaactctaaaagctaaatcttaggtgattaaggaacgtgctcaatgggtcttaagatgtccattaggcattaacactcttattgccttcaaaggccacaactacagaatactatgtaaaaggtcacaatatatctgagaatttggtgggaggagtgctataaagtaatggaaagatgattccaggagcgagttccaacccatccactaatcgttttacattatcacagttttgaacatatttctgaatttctcagggcattggtttttgtcatctgacaaatcaagagcacagtaatagtatgactccataatgttggggtaaagattggtataattaatacggtataaaagcacaaagaaggtccataacaaaagtaagtattatctcacctagaatattggtatgcattaagctagggccacaaactcaaaaacctacaaggactggctagtgacaagtagataaaaaggccctggggaaagttgggggatggtagaggtctatgttattggggaaggctgggagatggtaggggtctgtgtcattgatattttggacttgatgtccctgaccctgtggaaaggtgagtggctgctcagccagttgtaataatgtgtgaatttgggccttcttgctaaatcttatgacttttcaagagaaactcataatctaagtgtcttagtttttgctttcctttattttttattgaatacactttgtggatccaaaaaaactacatctgccagcccaaaatagcccgtgggtgcctaatttgaaacatctgttattatatgtctcttgatctacatgaccctggggttttcttatctgcatctatcagaagagggagataataatagtacctgcccccacaggattttagggaagaagaagaaatgtttctactgtgagtttcagatcccttactagggtgagttatgaaaggagactaacagaagcctgtttcatggaaacatctgaggtcaaggagcacacctggacacagaacccaggatcagggtcggaacccagggccaaggatttgctttctctactccctgtggcctctgtgagcaagtctttgaagaggtgccagcttccttttgcatcattaatcctgactgatcagacaccacctgcttatgccacgttcagggacaactgtagacagtgactcaggaatcagcgggacccacagaccaggcagtctggtcccagtcccctcaaacagaaacttgctcctttcccacatctgtgcctgggtgtcacagtccgaatgtcaggtatttaatgagatgttgaggaaagcaaagcagttgctgagactgaaatatcagcatttgagccaaggcggaacccaagggattaggtgttggattctagtgctatggggtaaagcaagttttgcaaggtcattgcagcctgaaagatcactatgatttcagttcgtgctggaagttttcaaaaattgaaatcctgaaaaaaaaaaactgctaacatatagaagatgcttaaatctccactgtccgatatggtagccaccagccacacacaggaacactcagctcattatctattatataggaagggtaatattgtttcactttgttgttagtgttttacacatattagcattccataataatcattgaatcaatgaatgaaataactataacttcgtttttttctccttgaagaaagggtcatatgtttcttctgccatttttttaaatctcaaaaatagggacagtaatggttgctaactaggctttgatagataagaagctctatgttctctttagaaaaatgatcctctttaaagtcaaagtatcataattccattgtaaatgagtaagatgataaatgccttttaagcctacttgtatgatctgaagaagtatcaagagctaaaaagaaaaataacatttataaaacacttttcaagacacttatgtgaacattatcaatttctatcctccctacaagataatgagttagagcaggtagtattatccttttggtcagtttttttttttttttttttttttttaagtaagctgagactagccatatttgaattgtttagggtggggtttctcaaccatgggacttttgacattttggactggagaattctttgttgcacaggacagtcctgtgtatcatagtatattcagcagcaacctcagcctctagccaccagatgctgtttgttcccccactcccccttgtgacaactaaaaatgtttccagacattcttgcctcatctaggcctcatgaatggtatttgagcaaagacctgagttaagtgaaggagccagctgtgcagagagcctggagaagagccttctgggcagagggagtagcagatacaaaggttctgaggctggatccatttagtgtgttcagaggaccagtaagaaggtcaatgtggctgaggtggagttgtattcttctcactttgcctcctagcccccatgatcaagcacttgccttagatgaaatctttcctttgcttaggtgcatgttcaatatttaacaggtgtcagactgagacatttttagaaggcaaagaatctcagatgtctgactgtgagggagaagggagtcaccccaaggttgaggggagagaattgatacaaattgcagctgacacagtacacaggggcatacttgcagtcaatgcttactgacttctgctacacacccacgttcatgttacctcatttttgcatttgtgcatcgataaccaaacagaaggcgaggcctgggcatttggcaacttcatttgtatgtggagtcaaccatggggtgcattcggattatttcttttcttctgcatttcttaatctctctcttgagagcagtcaccttggtaactaccctggtgccttgcacatggactatggtgagtaaaatgtgtttttatgaccctcaaaataagagccaaatactactttatccattaaaaatgagattcacttctctatgtggcattgtggccaggtttttaaaaaatacctggtttgggggcattcccgctaacattcttaccaactttgagacagtgctcagagcaagtgcactgagctaaatcgagatgaaagaggcaataatctgctgcctagtagaatggcttttgcagcctgatgttaaaggtttcaggatttgaaggttaatctgcagcagcagaaggaaactgttagtacttccgctagtctgaaattgacatcccagaaaccggccctttctaataaacagagaaacaaactccagtgaatcccacatgtcaagcctagacctaagggaaattactctgtgggcttctgtctgaatccactaaaaaactcatactccagtcaacgacattgtcattaaagaaaagggaaacgtgaaataatcctagcctcagaaatctctaccattaacagaaggccttctttttcctgaaaagatagagtatgtgaaggccacatctctatttttaaaataaagcaagagaagtaacatttatggagcacacacaacatgccatgtactacactaggtgacttgaatatgttgttaaatactttatagaggaggaaactgcagataaaagtatcaagtgacttgcccaaggtcatgtaagtaataaagagcacaaccggcatttacgaatgggtcttctcagtgctaaagctgctactgcaatactctgtaaaagacatttataaattcgaagttaaggaagaaagtattgaattattccctaagctagtatcttaattatataattgcttgttaaactgtacattttttcaagctgttcatattcccctcttatccggatactcggaaatggcttttttgtattcctgtacctggtctcattctcacatatatattagtcatggttacaatatacagtttttaagactttctcattagaagatatggtgtgatgaaaaaggtggctgaaatgatgaaagatgattgaagagtttttctcgggtccccttggaatgaataacacatggccatttatgtcacagtgtttccttctacctgagcctggtaatttccaggggtcatcttggttaaattagtttttaattccaaaatattgttgctggaaatgttcccactggccaattcatatctcctgaataataggatttgagccaaaattgaaaagtgccagtaaagtaaatgaggaatatctgccatataacctttggaaacaaacttttttttttttcataacgatttttacaagtgtaagaagttgttactgcaatgcatgtgtctgacattcctaagaaacagaggtactcttcaggacattctccagctaacttgaggtctccctcaccaaaccttttagacatggactgagggctgttttattctatgcactcattttgtgtatctctttcttccacattttgagtataagggaggcttcctgcttgttaatttttctgacatactcaagttgtacagaatgtaggaaaaaactatttcttccttatactcaaagtatatagagagagccattaataaaggtggaaaaaggaaatgctagaggggccttcaaaatggctgtgtgggccatgcgtggtggctcacacctgtaatcctagcacttttggaggccaaggcaggtggatcacctgagatcaggagttcaagcccagcctggccaacatggtgaaacctgtctctactaaaaatacaaaaatttagctgggtgtggtggtacacgcctgtagtcccagctactgggaaggccgaagctggagagtagcttgaactcaggaggtggaggctgcagtgatcacgccattgcactctagcctggatggcagagcaagactccatctcaaaaataaaaaaaaaatcgctgtgtgtggagatgcccagcatttgcctcctccacaaaaaatacaggacaaagcaacaggtagataatcccacactgaaggagcgtctttgtgagaacactgaaactcagcagggaagtgatattggagctctgaggcagggaaggagagagaagtgaagcagctagtccagctgagatcagttcagagccaggaaaaactccccagtgcagagaaaaggtgagagatccccagcagttcatgttcccaccagggactcctgcaatcctagttacagaagagctcctcaggttttgcaggtcctgaaactagtatagagagataccatgcaacagcagtgttccagagagggagtccacactaggtcccacatctctccaaagacccaagcaactgtagcatgatgccattttgagatcccagctctcagcagactatatcctgccctgaggcccaagaatccctgcatctccacattcctggagccccactgccatcccttcatgtccacccagaaacctgtgtgtcacagttttctgggtggacatgaggagctagtggtgcatctagatcttcagaactctatcacacatgatgtccctactccttgggaaacaggcaatgcagggtacgccagaaaggctgcccctgagacaaaggagactgaagtgggcacttccaaaaacatcagaactgactgcctgaagccagtgccactgataacaaccctgcctcctgcagtagcagagctgttgtgcacctgtacatgccttcaaggggtcttgggactggccctgctggatgtccttttgaaacctgaggatctcctctgcctatcaccacccctgctagtgcccatctgtactatccatgagctagaaggtcacccagccccacccactgatgtcaatgcctgcatacactattgcaggcctgaggacagcatcatctcacctgccactgcctgcacttgttatacagggggctgggaatagacctgtcccacctgccaccattggcacctgcacttgccttccaggggcatgagaatagaccccttttgcctgctgccaccacgtgcatgtgcctcctgaaggatctggggactggcctgcccagcctgcaactaccacagacacccacccacatgtgccacttgggggcctgggaactggtccactcagccagcctccaccaccaccagtgcctatgtgtgcccctcagggttccaagaattggttcactgcccctgttaccaccactgataccacacatgccacccagatgcttgaggaccctctgtcatccaagcctacctctgccactgtcagctatcagtacccaagcacaccacctggaggcctaaggagaagctcactcatactcactaccaccagaggtggtatatgctgccaggaacccgaagatgcatacccagcctgctgccatgattataagtgtttgaagactagtgcaactgggatccctgtctcaagcaaagcctcaccacagctttcactaacaacttcagcctaagccactgacagcataacttgcagacaccattcattctaattaaaactgaagaaatcatatagagatcacactactgcacctacccagaatcaaagccaaagcatcctactcaatcaacactatagatgcatgtagaggaaaaaatctttccctatggtagccaagacataaaataagaaaaatccactgttacaccagatgtgcagataacaatgtaagttcaagaaatgttaaaaagcaagaaaacctgacacctccaaaggaacacaataattcaccatacaagagcttaacaaggtcaggcgtggtggctcacgcctgtaatcccagcactttggaaggctgaggcgggtggatcacgaggtcagaagttcaagaccagcctgaccaacgtggtgaaaccccatctctactaaaaatacaaaaattagccaggcgtggtggtgtgtgcctataatcccagctattcaggaggctgaggcaggagaattgcttgaacccaggaggtggaagttgcagtgagccgagattgcaccactgcactccagcctgggcaacagagtgagactctgtcaccaaaaaaaaaaaaaaaaaaaaaaaaaaaagaaagaaagaaaaagcttaacaaaaaagaaatctatgaaatgcccaaaaaagaattcaaaataaagtcagtgagacatgaaagaaaaaaaaatacaaagaattcagaaaaaattcataatctcaataagaaatgtaacatatattatatatatatatatatatatcaaaatgaatcaacagaaatcctggagctgaagaatttaatgaataaaataaaaatggaaagctttaacagtagacaaaatcaagcagaagaaagaacttctgaacttgaagacaggttttttttttttttttttttttttttaaataacccagttagacaaaaaataaaaagaaaacagtgaaaaaagtctgcctaacatatgggacaccatgaatattagaatttagggagttcccaaaggagctggacaatggcatagaaatcctatttaatcatgtaatagctaaaagcttttcaatttttacaaaaggtgtaagcatcaaatagaagctcaaaaccccccaaatggattcaacccaacaaggtcttctctaaggcttattatagtcaaattgtcaaaagacagagtgagaattctaaaaagaaagagaaaagtcacatatgagggaattcctcatcaaactaacagagatttctccatataaatcttacaggccaggagagaatgggatgatacattcaaagttaagaaagaaaaataaaaaactgcagccaagaatactctacctagaaaatctattattccaaagtaaaagagaaatatttctcagaaaagcaaaaactgaggaaattcattatcacaagaccaatcctccaagaaatgcttaaaggagtcttacatctggaagccagaacatgatatctaccatcatgaaaacacataaaagtataaaactcactgctagagcagatacacaaatcaaaaagagaaagaagtccaacattaccactacagaaaaccaccaaactgcaaaaataataagaggggaataatggaacaaagtgtatccaaagccagaaagcaactaataaaatgacaggaatgatttctatcaataaaaaccttgaatgcaaatggattgaactttccactgaaaacatatagactggttgaatggattaaaattaataataactatatgctacctacgagaaactcacttcacctggatagacacatttagattgcaagtgaaggaatggaaaaagggatttcatgcaaatggaaaccaaaagaagcaggggtagcttttcttatatcagataaaacacactttaaatcaaaaactgtaaaaagagacaaagatgatcattatataattacaaaaggatcaattcagcaagaggatataataattctaaatatacaagcacccaaaaccagagtatctaggtaatatatatataaagcaaatattattggatctaaagagaaagatagactcctatacagtaatagttggggacttcaacactgctctcagcgttggaaagatcatttgcacagaaaacaaaggcatcagatttagatagtatttcagacataatggacccaacagatgtttacagaacatttcattcaacaactgggtaatgcacatttttctcaactatacatagaacattatccaggatagaccatttgttaggtcacaaaacaagtatcaacaattgttttttaaaaatcaaacatatcttgcatctcctcagactgcaatgaaaaaaatagaagttaacaacaacaggaactttggaaactgtgcaaatacatggaaattaaacaacatgcttctggatgatcattaggtcaataaagaaattaagaaaatcaaaaacatttttgaaacaatggaaaatggaaacacagcatacctaaacctatgcgatacaggaaaagcagcactaagaggaaagtttatagcaataagcacctacaccaaagaaagtggaaggatttctaataaacaacctaatgatacacaacctcaagaaaagcaggaataaaccaatcccaaaattagtagaaggaaaacaaataataaagatcacaatagaactaaataaaatagaaactaagaaaaaatacaaaggattaataaagtaaaaaatctgatttttggtgagataaaatggataaagcactacctagaccaaccaagaagaaaagagagaggactcaaataattaaaattagaaacaaaggagacattacaactgatccgacacaaatgcaaggataaagactattataaacaaccaaactctaacaaattggaaaatctagcggaaatggataaattactggacacataaaatgaacaaagattgaaccaggaagatacagaaaacacgaacggaacaaaaatgagtaatgacattgaatcagtaattaaaaatcttctaacaaagatgagcccaggacgagatgcctttactgcagaattcaaccaaacgtacaaagaactaacactaattcttcttaaactgctcccaaaaataaagagaaaggaatcctttctaactcattttatgagggcagcattaccctgatttcaaaaccagacaaggacacaagaaaaatagcaaatgacaggccaatatttctaatgaacatagactcgaaaatcctcaacaaaatactagtaaaccgaatgtaacatatcaaaaaaaaaaaaatacacataatcaagtggaatttatcccagggattacaaggatggttcaatatatgcaaatcaataaatgcagtacagtacatcaacagaatgaaggacagaaactatataatcctctcaagaaatgcaggaaaagtgttttataaaattcaacgtcccttaatgataagaactcccaataaattaggcatagaagggacgtaccttgacatactaaaggtcatatatgacaaacccacagctatcctcatgctgaatagggaaaagctgaaagcctttcctgtaaggactgaaaaaagacaaggatgcccactttcactgctcttattcaacatagtactagaagttctagcaagcgcattcagtcaggaggaaaaaattaaaagttatccaaactggaaaagaggaactcaaattgtcccttttcacatagaatgatcttatatgtagaaaaacctaaatactccaccagaaaactcttagaaatgacaaacgaattcagtaaaatttttgtacaaaaattagaagtatttctaaacaccaatagaaaactagctgaaaaagaaatgaagcagtctcatttataattgctaccaataaaaaatgaaataaaatacccaggaacaaatttaaccaaggaggtaaaagagctctgcaagaaaaactataaaacactgatgaaagaaattgaagagaacataagcaaatggaaaaacatcccctgatcatagataggaagaattaatattgttaaaatgaccatattacccaaactaatctatagatttaatataatccctatcaaaataccaatgacactcttcacaaagtacaaaaaacagtctcaacatttgtgtgtaaccacaaaagactctgaatagccaaacactgagcaaaaagaacaaagcttgaggcatcacactacttgatctcaaaatgtactacaaagctgtaataacccaaatagcatgacattcttataaaaatggacacatagaccagtgtagtagaatagagaatcccaaaatggatcagcgtatttgcagccaacagattttcaaaatattatgtgcactccataaataagtacaatcatgtatcaatgaaaattttttaaaaacataaacataaataaagataaaggtaaatcttttaagactcttctagaagcatgtagactacaaacctaactagaagcaccctactttaatttctaattggctgcagtaattgtaaattcttaccaaactatgcccaacatgttttcatttcattaagcagttatcttattagtacctgtggtagtcccattcctagcaagatcaagattaccctgagctctttgtagttgtgacataactcatttttatatagccacgttttcatcttgagcctggcatctcattctgggagggatcctaaaaaattttttaacttgttgcttgacaactcctgatactgttctataattgggtttccctgtcatcagaagtagaggtgactgtcagtctgtgacaatgatggctattgttaccacaaagcctaaaaaaagtcttatgtcctctaaaaaagagagagaatgattgcatgtctttcaggagtgtgtgatggatatagagattgtgtaacatgtatgaatcctttttgaaagttacttttaattcattgtcattctcacttgcattttgataaacatctctttctagaaactacatctgggaataaacttctctagtattttattagttggagttctccagagttacatcattcatagaatacatatgtgtatgtgtgtgtatggatttttatcataaggaattggctcatgtggttagggaggctgacaaaatcccacatctgcaatctgcaacctggagactcaggagaactgatggcatagttccagtctaagtccaaatgcctaagacccgcaaaaatcaatatttcgattccagtctcaaggcaggaaaaaatcctcccctactcaaagacagtcagctttatttacctattttaaatgataaaattaaatagtatagatatttactatgtacaacatgatttttttaaaaattattatactttaagttctgggatacatgtgcagaacatgcaggtttgttacataggtatacacgtgccatgatggtttgctgcacccatcaacccgtcatctacattaggtatttctcctaacgctatatctatcctagcccccaccacccgataggccctggtatgtgatgttcccctccctgtgtccatgtgttctcattgttcaactcccacttattagtgagaacatgtggtgtttagttttctgttcttgtgttagtttgctgagaaggatggtttccagcttcatccgtgtccctggaaaggacatgaactcatcattttctatggctgcatagtattccatggtgtatatgtgccacattttctttatccagtctatcattgatgggcatttgggttgattgcaagtctttgctattgtgaacagtgccgcaataaatatacatgtgcacgtgtctttatagtagaatgatttataatcctttgggtatatacccagtaatgggattgctgggtcaaatggtatttctggttctagatccttgaggaatcaccacactgtcttccacaatggttgaaacgacatgatgttttgatatatttatacattggagaatggctgaatcaagctaattaacatatctattacttcagacacttagttttaagggtgagaacacttgaaatctattagcaatgttgaccatacaataacttgttgttaaatatagtcatcatgtacaatgcatctcttgaatttactttacctgtctaacccagaataatgtttaaccaaatctcttggcacccctttgcctaatcaacttgacatgtaaaatgagccatcacagccactatcccaaataaggtttaataaatcattatgattgggttccctatggatttttaatcttcactgttaccaggctatctgcccttcttgttgagggaattaccccaactctggatatctgaaacttctcagattattaatgattccctttttaaaggatggattggctggtaggaaagctgtgggtaatacctggcatggtagttaaaagggcaaagggagggaattaagtccttttaaccaattttggtctctcagtatttaatgatttgttgatttccagttaaaattattaaacgactatcttacccagggaagaaagcagcctcaattttggcaaattaaaacaatcacttctgctttcattttcttcagtaggttgtaatattgagtgagtcctaattttattcaccttctgctaggaaatgtctaagacaaatttctggcacactccctttcacatctttgtacctgcctctcacggccttcatcccacatcctcttgacactggaagctctgctatgggtcctcttttcttttcctcttagacaagcctctcagagcatatcaaatcaagtaagtgctaaattggcatggcggggtgtcactgccataggaaatcagagaaggtagtttgaagataaagcaagatgggaataaatgtgggagctggggcctggaggatggatggggccagcagtcactatagggctgctgttgaacatatacagtgttccaggcaccacatgaagcaaatcaaatgtgcatgcatacacatagccttccaagagagatactgttagtaccttttcacacatgaagaaagacccagaaaagattctttgactagtaagtgatgggacctggactcaaaaaactcttttttttaatcccctcctattttttttttttttttgaggactctaacactcacacctatggtttgaacttttggattccaaaacctatggtctaaacaatagtgtctatggattttgctaggcaaaggaaggagggaataaattccaaaaaaaaattatttaagtttaacaaaatcacaggatctattataagacagttctttactagaaagttatttttggaatttattctgaggcatgaattcatcagagtttgtttccaaactttcacagaagtcttagaatataaaatgtaaatcagctcccgtcattgccctgcttaacgtattccattggtgtctagtcacacaaataataaaaaatccaaattcctcgtggtatcttcttcaagatgctctattgatccttcttccttcccacttttctgaattcatctcctattcctccctaccttgtgtagagggggtgtgattcaactctgatcacattggctgatgccattcttggtgatcctcaaatgtaccatactcattctccctgtactcagaccttcccaggcctggcttcctcacttcatctgggattcttagagacaacttattggacctccagtcttaagtatatcctaccctctctcttcctactctgcctcattcttctttagggcgctttatagctctgcctgtgtgatgctctgggaaaagtggggaggagagaaagtcatgtcttttttcactgagcaatcaggagtctccacaggtgcagtgatttccgcatgcggtatccactgttctgttctgagaacacatggatgaaatatgggaaggatattagagcttacaagtgcaagcaagagaacagcaatagatgtctcctctggaccactactgcttctctttagttaaggctaaacataattgcataaattggtgacacacctgaaagactgggagtatgtctgatgccatcttttggaaggccaatttggacattataacttgaggagagggccaaattaataggtaagacagcgctagtgccaggtgtacgcatactagctttcatatttctgaacttatccctggaaacctttctcacaagtatcaaaacggcactgggccctttgaagctgtaacttgaaatctcataaaagacactgtcatgtacaactgacaacttttccaaatgaaaatagaagacaggagaggtggctcccttggggtacataccccatgaaggaatctattctgggagggattttcacagtgtgtatttttaatatcactcaggccagcatcttaatcggactttactggtgggaagcactcacccagcagcagggattgtgatggtaggaatttaatctgaacacttggcataggcctaatcatatttcacttattttcttttatgtggcttcttaagataaatgagtctcctcctttatcaacaatagctcaggatttataagctcacatttttcatctaggacagggaatgtagcaacttgcactttattatccatctctcattttcttcccgtcagacaatcgataaattccccaccaatgtctctttttaaaggttgcttacaagtttctgtttcagaacaatgtgctggcattggtttttatccctaagtcctttctgaatctgagtgctcattgggagtgatttgcaagagtttttccaagaatttctttagcaaaactacaattcacccaagagggcctaaatgtagcctgtatgagttgtgggcatcacttcctgacaaaaacctacatgagttgttgtccaggtagcatctcattcctgtgcatcatagaatagaattcttttacaagtacaaatgaccttaatgtttcttctgtccaactacctattatgggtgagatgaaacagattcaaataggacaggtttgtctgtgtttgacctgacagccagaggaactgttgagaacagaagtgctatattcttcctgtaattccatggaatgtgcttataatttctcagaaacatcccttaaggatgatctttaatgtgtagaagtatacagcaattcccatgctgacctaactgttttcttggatggccagcaagcagagtactgggctgcgtaagtagtatctagggtttgttaacttttaagccagactcgactgtatgtgggaggtgtaattgtgattctttttggctaatagagacttttcatctgtaagtcaaaatgtactatctgtcttctctgagtcggggattatgacatgagattaggataaaacagatagctgtaatacttgcccctccctgctggaagattgctgtgtagacaaagaaaaataataggagaatatagccaaatatgcagtggttcttaaagcatcagctctgagttgaccctgaattgcttgcttttcactagccaaaccaatcatatgtagggaaatatagtcctacacatgcccaaagaaataaagagcagcaaagtgcttaaaatggtgactgctttgtcatctgtatccctgagtgactaccctcttaaccctccatgggcatgtagcttgggtgaaaaataaatgtttgttcttcaaagccactgagatttgtgttgtctgttactgtagtatatcccaacttcttttgactgagcagcatggattgtctgatttaatcctcaatttagaagttagaattgtcttgactacgtaaatgttcatatgaagagcatgagccttagaaagcgtaccaggaagtggttgaagcagcactctaacacttgcagtctggttccaaagcttatattcttagccaggatattaaaatgctctccctcgttttctttctcactctcctgcactctctctctctctctctctctctctctctctctctgcgtgtgttcttctgttattgaggaaagatggtttctaaagagaatcaaggaagactcccaaagaaattgatagctaagctctaaaggaaaagtagaaactaggcaattcagtagtaaagaaaattatacttattccctctctgtgttgaggcatgggtaatccccattgtttgatttactcacgcccagagaaagtgtagagcaaagaattcctgtttatacattactgttggaaaccatgaaatatggaaagcattcaaatacaatggccttgaatctgtaaatcattaaaagcaaccttatgagattttataaaacagatgagaaattacagttttgatccactgaggcagcaaagcaatttgacagttacatatgtataatgctctctagctctctcacttgtgcgcgtgctttctctctctctctctctctctcacacacacacacacacacagaaaatgatctaaccaatatatgagctttagcattatggtaactagagagtaaaaaggaaaagaaaggaaactatatattaacatcattggccaaagaaagaaaatatgaacgaagttgagattacatggcaaatgacaaaaaggatcagcagctgtgacccagacactgatggggtcatctggtcctttcccttgctgttgggttaatcatgcaggactgatgatgtcaccgtttataatgctccctagaaaagaaagccagtagctgcctcagtagcctgtcacatagtctaattgccttgatcacaaaacattctctgtgtcttattcagctctggcttgcttcactctagacacccttcatcaagttggactttaatggaaacagaacgttgcccagcatgttcctttagtaaacccacacaaagtgtgcacaaataacagtcatgttttaccctctttaacatactacctctttccccaagcacttatctctaaatcagttctctttatggattcagggaattccaaagcacgtcatagcatgtctcttgaattggattgcttttttttctgtgaacgtcatatttctcttacaaaaaaaaaaaaaaaacacctcgttagggttatatttgtatgctgtaagattgactcattttaagtatacaactgagtgatttttagtaaatttgcttttatgcagctaccaccacaatctgattttagagtatttctgtcacctcagtaaaatccctcgaatccatttatagtcttctccgccctagacaaccactaatctactttctgtctctatagattttcatttctggacaatacatgaatgagatcatgcaatatgtggtcttttatgtctgtctgctttcagttatcataatttttgaggtttgtccatgttatagcatgtacctgtatttcatttcttttgattgctaaatagtattccattgcatggatatagaatattttacttatccattcatcagttaataggcatttaggtggtttccacattttggctctgatgaattatgttgctgtgaacatttatgtataagtgtttgtgtgaacatacgtttttatttatattgggcagagagcccagagtggaattgctggatcatatggtaactccgtgtttaaattcttaacaggcaggcccttttccaaagtgactgcaacattttatgttccccttagtggtatatgaaagtacatgatatttccaggttcttgccatcatgtgtgctacgtgtgtgtgtgtgtgtgtgtgtgtgtgtatgtgtatgtgtttatgtgttttggaaactcccaaaaggaaggaatgcaatctgcaactcttcttgccttttcgtcttagtgtttagcacagggctgggcacacagtagaagcttaatagtgtagcatggcatgtgatggttaaggaattttgttttggagttagactgccaggttctgtaagcattggttttctctactgttaaatggggctaatagtgcctaccctttttagttacaatgagggttaatgaatacagtgcagaccatgtgctttgtctaacgcgtatggaaatggtagcttttgttactcatgttttaaaattcacatggatgagcactttctgaacaatctctagccgatttctttttttctcttgcaattagatatttaggtataggcaatgtactgagcccccaagatgaaataataagtagcaccttatttctcatctcaagaaatttgaagtttagtgactgaggacatagatataaatggacaattacaatgtatgtgatataagatatgagcagaaatatgagatgaaagatatgatatgaaaaatcccatgtgacccagaaaagacatctaatcataaccaaaggactgcagagaggagcagaagcattgggaagagtattgctggccaagggaagggcataaaacatttacaaagattcaaaaaggggaggggtttggaaaaattgcgagcatgttctgtgacagagtgaagggagaccggtaagagactaggatggagaagtgagcaggtgcagtcatgaagtgtgctaaagattatattaagaagtttgttcttttcttttgttgctatcattctgttaagtgttaatgtctgaggagctacgaagaagatggttcagtattctaaaggtagaagtgaccatttataaagagaagaaagctagagcagtctcaaactttataatagtcgaatacattatttctcaactttaaaaaaaaattaaccctcccttgccccagagaatgtttagacatttttccctatttgtcaccccatgaaatgtcgatattaaagatatgctgcatatgtactttatatgtaaacatatttaggctttctaaattaaaagagtaaaaattttgtatgcgtccaaccccccaataattaatttttgtccactgggggctgtatccccctggttgggaatacatactctaataaattggaatctcatgtaggaacaggtatagatgttaacatttttgtcattccccacactacctttcaaaatacaaccatttggaatgaataaattctgtcactctacagatattttctgagcgcataataattgccaagccattttttaggaactgagactacagcagtgaataaaacagtcaaaaatcccacccctcatgaagattacattctactgcaatctgtatataattgttttggatccaaaccaagtaatgcctgccattaaaactgctccagcaagagattatcttgagacttgtttgttaaaacaggtcttggcattactttcaagcctgaaaatgtgctgacagaattaaaaacccgtccaatgctgatgcagggggaaaatcaaaggagcaagaaaatcgcactttttttctgttaatagattttattagtgggaaaaactgttttacacacctatcaaaatatcaaaaattgcacaataggtctgcaacctactcatctaacaacgaccaacgtttgcctttttctgaataaacatatgcactctgggtgtttttcatcagtctttagtatccctaggagtcctgggcatggggcggatcctggaacagatcagaaatgccttttcagcagtgtccagtggaatgtgaaaaatagcactttcttaaaatcaacataatagcaatttccatccccatcccacaagaaccaacaggaagtccacgtcactcagaattttgcagacatcctggtatcttaccctgcaccagtgggaaggcctctgggagcactgatcactgccctgcactggccatgctgagagaatggccacctacatgatccctggaggtccaaatgttctgcctctcctggagaagggaaactttggcgaggctggagtgctacagccatttcctttggaagccttaacccctcctcgggacactggcaggaaaatggtctctagaattcacgggaggcacagatcttttgtctactgccccccacccatcccagtgggagaatatctcctccacttcttgcctcctttcccagcacatctagcacagttcattcaatgagattcaatgagattataaaagacaggaaaccccactgcagttaggctactgctgcttcattctcaaaatctctaagccaagtaatgacaaagcccaagaacctgtctgaaatggtgacaaagggagtcaggggaaggagacaagaggaagaaaacaagttatgtggaaagaaccaatatttcagtctattgcgctgctactctgattctctttattctgtactcatcttctatagaaaactattaaaacaactaaccaatctgggccagataaagaatgaaaagcaaatgccatagtctttgcaccagcccagagggtaattccccagattccacctacctgtgcccccttcccctgcccctagcctctgccttttctgaaagttctaactgagggcttaggggagactctaaattagactgagaaagtaataggatttgctcttgtgtttttgaaaactcctattctgagttgagtaccgcaccctgtatgggaatagtcactggtgatcctgcgatgagcagggctttcagaattcttgtcttcgctgggattacaatgggagcctggcctcctccttctgtcttagatgtactttacagacttcaggatcatcactggacagcgctcattcagtcaagacctgctatccccctattgggctactataattttcatgcttgccttaagaaaattagtttcaccatttaaagaggaaaataagatattgtctgtttttctaattactgtttctaattgttctaggaatgatattctctctttttttttttttttgtttggtttttgggacggagtcttgctctgttgcccaggctggagtgcagtggcacaatattggctcactgcaaactctgcctcctgtgttcacgccattctcctgcctcagcctcctgaatagctggggctacaggcacccaccaccacccctggctaattttttgtatttttagtagagacagggtttcaccatgttagccaggatggtctcgatctcctgacctcgtgatccgcccgcctcggcctcccaaagtgctgggattacaggcgtgagccaccatgcccagccctccctctttaatttttttagagagaggattttgctctttcccaggctggagagcattgatgtaatcatagctcacaatcctgggctcaagtgatcttcctgccacagcctcctgagtagctgggactacaggtatatgttaccataccaactaatttttatttttattttttaggatggtatcttgctatgctgcccagtttgctcttaaactccttgcctcaagaaatcttcctgcctcagcctctcaaagtgctgtaattacaagcatgaaccatcagtcctggtccaattctcaatcttctaaatacctcttttacatcttattgggagagaagttgtagttcctaattgacctcaaactccaatcttaataatacccaaaacttcttatgtagtaaaagatgaaatgttttttaataaagctcatatcaaggtactttgatgggtttccaatccagcctcattgttccaaagctagaaaggagactataaatgtgggaacatattatttagttggtgactctaatcagttttgtgttatattttggaaatagaggccagtaacaaaaattcacactatttgatagacctttcccaccaaataccattaggcagaccgagagacagggaagtaggctagaaaagtgaaactgatcataagcaagaataggaaatcctgtaagtggaaaaatgatggggatttggcatgtttgaggtgagttagctgccataagatgtatatgaggaaagattaaattacttattgcaaaagagttacttggcttggattagatttatatttcttgaactgtggtcgtttctgtacctccttcactgtttttatttggctgggtacctcctatgttataaactgtcttacaggatgggatttagaggggccttctctttttgtaactcgtcatggcacacagcacatgattatacacacagtgggctctccaaaaatagcagaagattccttctgattatgtctgggggtgggtgaatgttgtgttgtagttaggatcccttcgactctgagaaggtgtaataaaagtatctatcataaaaatgaatggtgttaggcttaggattaaggatggttctatctattaatatcactgactgcagttacccagtaagctaaaatcaaagtgacattaataagaaacccagcaggaaccataagggcattacttttgtgtatattgaggattgggttacccttagctattatcctaatgactacgaatgtaaagtctgaattggaaacagttgagttcaaattcctagttctgtcattagctagctatataattttgagcaagtaacttactaacaaatttgctcacttgtaaaagaaggaaaataataattatctcataagaacattgaagagatgacatgagataatttatgtatagcacttagtacatgaggtatagtgtacattctaggtaagtgttgatttttaaaataaatcaccaaggaaaactttattttttgttacttaagagtttttttttaattactattggtgtttctagaagattttagaaaattagaatgtacagcccagtcatggtggctcatgcctgtaattccagcactttgggaggctgaggcaggtggatcacctgaggtcatgagtttgagaccagcctggccaacatggtgaaaccccatcactactaagaatgcaaaaattagccaggcatagtggtgggcacctgtaatctcagctactcaggaggctgaggtaggagaatcacttgaacctggaaggcggaggttgcagtgagctgagatcacactgttgcactccagcctgggtgacaagagcaaaaaagctctgtctcaaaaaaaaaaaaaaattataaagtacagataagcaaaaagaggaaagtagaaagcactcataactcagacatacaaagtattaaatattaacatttgagtataattccccctagaatttttctccaataaaatttccttgagaatttttgttatatgtacatgagtatatgtgggtgtgtgtgtgtatatatatatatatatatatatatatatatatgtcaatgtgtatatatattaaacagttatttttcagtgggctcattacatatttcctcaactgattgtttcagtcaataatgcatcatgaatatttgcctgcactcttacatattcctctgcaagaactacatcatattccctatagtgtgttcaattattgtaacatgcaactttacatagtttttattttttctcttattaactgacatggtgacgaacaactctaaagctaaatactttcacatttacacagttatttccttacgatgaaatccaagaagtaacataataattttcagcaacaatgaaggaactgaggtaaatcgtgaaaagcacagagtatagtaagtcagtcatcaataaatgttaaggaaaggggatatatgtaagtagtgtaagaaaagaaggagttgtttggaatagacttgctataataccccaaatataatcttttatttaagaatgtttaggagttcttgtttgtttagtaatcgtatcatgcatgtaatcatatgcgtgtaaacatatcaatgtcttctgacctcaatgggaagaaatgtcaacatagcatgcagacagatgaagcagcgcagtcagtttatcgaagtcaggttgaatatgtgtttctgtgaaaaggtttgcctctccagctatcagaaatgatcactaataatgcaaaacaagagctaatccatctgtctattttgggagggttcgaggtgcctttggacatccgcattgccgtgtttccctttgttgcaggttccacctgctgcaggtgagacacgtgccatgtcccccagcctgttgcctctcacactgggtttgattgcccagttgggttctcttggcagagctgtctccatgagtgccagaatagaaatatacagatggcatagaggaacaattttgacctgcaggatctgttctgatccacaggctgaagtgcatttatgaagacaggatggggaaaagtacccattttccacttggtcattcaaccccctgtgtggcatccatactgaacgtgttgaggtatacagcacaatagcaatggcagacagaagaagctgcaggaggctgaaataacatagataacatagtgaggtaggttgggtggagactgtgcaaactagagactgtatggtgtgtccaggcaggggcggctgctgctcacctcagtggatgctggcaacgtaacagcaggcccagcatggccattcctgtttcactggagaaactagaaacctggatttttcattcatatattttgctttttaaatgttattagaaaacagaggaatacataagaaataacaaagcatgttcatagtgtgtgtgtatatacaccaaacacacacacacacacacacacacccctacccctgggaggagaaaaaacacggtggagcaatgaaaatagaaatttgacttctttgaatatttgttattttgtagatttgactttggtgccacatacatagtttacataaaagaaaattggactttaaaaaaacagtcatgaaaaaatgagaagaaaaattgaaacaattcagcctccctgggtatcatgttaacagcataaccccacagaaaggaattatttcaagtgactttgaaattccacagtttgactgtattttcctagtaggatatactttaaagatttttaaaaactaacaaattttacattgatttttattaaccataatgttagtacaatagtgacattggtgttctgaaactattctgtgtgtgttgtgagttaaatgaataatcatgttggtattattcagaaaagggatttttggtatgaaagaaaggtagtaacattataaaatccaggagataaaatggaaatcttcaagtcctgaatttgagttaaagtttcatgttaaatcatgttatttttactaaacacacactcacacacacacacagacacacacacacacaccccttattttccagttccgtccgcagaaacaaaggctcatccagtaacaatcagtattcaaagctcccagttgtggtttctaaataccatttcccactgaaatgaaccagggcttcttactaaaaatggctgattgcagtcctggggaaggactgtaggatcaccctgtaacatctcatagagaagcaaaagggccatcaaagactacgtggctatattaaaagggtgcagcagtcaactggaaaaaaacccttgactgaagtagggaaattagaaaattatagggataataattgggctagaatgaaacaaatgaaaatgtttatagtcatagttaaaaagtaaaaacctcattggtttggaagatactaggtggaagatgttagatagccaattcagtattttaaagatcaacaataaaggagggaaaatccaactctgtcaattcctctacaaactaaaattcagagttagcaaatagttgatgagatgaactttctctggctagtattcccagctagtaaattaagaataatagaattaggatataaccagtttgaaacctctagtgaaatcatgggtcctctaggcaaagactacattggctgataacctcatggcaaaaattgttatgtgcctactgatagaagaacctcccatgaagtaagtaaaaaattgcgcctcactccacctcaaagatgttcatgtataatctcagaacccatgaatgtattatattacatggaaaagggcaattgagattgcagatagaattacaattactgatcaggtgatcttaaaatggagaggttatcctgggttatccagatgtgcccagtgaaatctcaagggtccttgagaatggaagaaggatacagaagattcagagtcaagagtggttttacatgagaaaaactcaatcagccactgctgactttgaagatggaagtgaggccatgagcccaggagccagaaagagaaaggaaattgattctccctttagagcctccagaaaaggacatagcccttctgacaccttgattttagcccattgtgtcctggtcagaattctaacacacagaactgtaagataataaggttgtggtgttttaaaccactaagttttgttatttgttactgtgacaatagaaaactaatataccccatttcctaggatatagtctttctagaaaattgcatctgaatctgatcaagcctcttgatgtaactaccaatttacaggaaacataacgaatagaggaacacattatatgaaattatgggaatgttcagcaaaatctaaactctgggaaattccatttttaaaatgacatttatcaaataaagtatatgtgtatatatttgtatatgtgtggatgtatgagagagaaaatgactgactggaaattttaggaactggcctagtattttatgtagcaaacaattgctgtaaggaacttaattcaaataagcaaattatagagagaaaaaaacatattagtgaaatttgaacatggacaataggtgtttgatattaaggaatgattgttacttctggattgtgtgtgtggtaatgggattattgttatatttaaacaaagaaggggagtgtaggtggcagtaatagataataatagccataaattgataatcgctgaagatgagtgataggtacatatgtgtttgctatctgttctttctacttttgcatatattatttccgtaacaaaatatttttaaaaaatattagcaactaacttgactctttacatgttttgtgactcaaacacacacgtccaaagtctggatttaaccaacagactgccagcttgaaatctctgtagagttctggaaataggatctttcacttttcctggagaattatccttttctctcctcctacttaccttctccctccattctttctgtgctgcctagcaaaattgccccccaccccaatctgtgtgtgtggatgactagggggcattacaaattgcttggaatagaattttctcagaaagagtgaaaaagataatatgcataactgcattaaacaatacctcctaatattttacatgttttttgaatacccgtcctcattccacaccttcaaaaattaaaaaaaaaaaaggctataactacgttttttacagcctgaggtgttttgaaattttggctaatcatatcttccttgttatctctgtgttctatttcaggatggaatgggaaacctgaggatcacagaaaaaggtctaaagctagaaggagactctgaattcttacaacctctctacgccaaagaaatccagtcccgaccagtaagtttctgctgagagaaggaggcattattgttgctctagaatctaaatctggaggaattgatcttgctatcagctgagtacagagaattggggtggggagtaatactggtattaagatgaatttgctttctcttctgaatctttgagtatcatcacagcagtggtactgtaagcaagtgagatgacctctctgagcctctttccattcctgctcaacccctgctacccagctttatagattgtgccacaaataaggcaaaacagcaaatgtggaacagccataaataatatatgaatgcagataatattgctgtttattttattcatcaagtacttcaaagccatttttagaaacacagaactgaagaactagaattttgtttttcattaagactttacactgtgtagccagtgttggttaggatcaattcaatatcaagctgagtacagtggctcacacctgtaattccagcactttgggaggccaaggtgggcagatcacctgaagtaggagtttgagaccagcctggacaacatagtgaaaccctgtctctactaaaaatgcaaaaatttgccaagtgtagtggtgagcacctgtaatcttagctactagggaggctgatgcaggagaattgcttgaacccaggaggtggaggctgcagtgagccaagatcacgccactggactccagcctgggcaacagagcaaggctccatctcaaaaaaaaaattaattcaatatcaacagctacattctgaaatggtatttaaataatcactacagagtgtgtaccctgttctaggcacattgctgttctgcatgcagtatcattatctaatttagttcacagatttgtccactgaggtggggactattgttgcctctattttatagattaaagaattgaggcttggagaagtttcatgtaaaaagcttcatacttgtagcaggacaaagatttcaagccttctctgttaaccattatttcctacctaagcttttcctttcattccttctttattgctgtagcagtgattcctacatacataccttgcctttgttaaccactgttattccaagttgtgtgggtttcttttagtggttttatttttcgattggttggtttcatttatttagtctttatttttgttttttagtggagtggtagaatttgctggttgaaaaggattattaatgcatttgctctgccttggattgatcccccttcacctgtgagcaaggcataatgtgaaagttcccccaaagcactacttgcattgtgtgcattgattagcataattattgaaattcagcaacttggtgcagtggctgattttatctgaatgttatacaaaatcttgaattgtattaaactggtaccactactaaatttcaaataagtttactttcttgtgtgcttagtaaaagagagggaacaaggatgttaaaactatcaaaaatagcaaatgaatttagccatacaatgattatttataaaatgtaactggaacctatagcatattgtcttgggtacttaaagtacacagagtattgtgaacatatttactgtcattgagaaacctataccctagaaggagtaatgaggtgaccctgtaacgtggagagtcagatgataattctgccttggacagaatagagacagtttaaagcatttaaaaaatatctgttatatgcattgctcttaatttatatcttgttttcccaacctggcaatttggttagttgtcattgacctatttctagttgaactttagactaatagtcttacctgtattaaacttgtttaactcactagtttagtttagtcatttccttctatggatgttggcataccttttctgtaaagggccagaaagtaaatattttagttttattttaaactttttttttcttttttacagctctcaaaacttgaatagcattcttagtttgggagtcatacaaaaataggccacaggctgtcattcaccaacccttctaatctatattaggaataattccataaatatataaatgctcttatgagactggaagtggtaaaaggtagattttaagaacataagaagaacagttgatatgtgttgagtaaaacatcctgaaataagtttccttggtatagaattagtcatgtcaggatattaggaaatgtgttttagaagacttgaaaacagggtactgggtgcatctgttgggtctgtatgcaggaattggatgtctagcaaatgtgttagcaagcctctctggaaattgacagacagctgatcctaactgagagatatacctgcttgtaagcttaaaaagtaacaatacttacgtttatatttaattacttaccttaatactgaaatacatgagctatatgcagtgctttcaaatcactgtttaaagaaaataaaaagccctcaaattcactattttccattggttttaataactttttttcaaaaatagtaaagttttatagccttacatgtttctaacaacaaaagaagtatcttctaactgaaggagaaaatacacagatatgcatacataataaaatccgtaagtcatgtgagctctacctgaaacctgtgcccaaattcattcactcttctgcatcacacaccacaccttaggtcaagccactgtctgttctcacctgcaccattgcaacagtctcttcgctgtctgctgccttacccttttagcttcattatacaaattgtagccaaagtagtcttcaaaatgtcaaatcgctccacctcttcacaaaggatttcccattggtttcctgttgcatctggaatacaatctaaagtcctcactaagtcctgtaaaatgcattattaggtgttttcattgagggctccttctgttcatctttgtatcagctcagatgtcacctgtttagaaagacctccttcacccaatcagtccatttagcataatagtcgtatataaacagcacattggtttttattccttataactgtcattctttcacattcttatcatgtttatatgtttggaagagcagcagattgtctggattttccccactgtattcctcagacctcttgctgtacctagcacatagtacatgatcagtagatgtttgagaaactgaaccagcgaatcactgaaaatgaaagtgtctcttaagtctattctgcagaggcaagcactgttaagaatttactgttttggctgggtgtggtggctcatgcctgtaatcccaacactttggaagtctgaggtaggtggatcaagaggtcaggagttcgagaccagcctggccaagatggtgcaaccctgtctctactaagaatacaaaaattagccagacacggtggcgggcagctgtaatcccagctattccggagactgaggcaggagaatcacttgaatacaggaggtggagcttgcagtgagctgagatcgtgccactgcactctagcctggatgacagtgagactctgtctcaaaaaaaaaaaaaaaaaaaaaaggaacaattgactgttttatcaaacattttccatgcatatgtatttttcaacaaaaccataccttgaatactattctgtactgatgcaatgatggtctcataagattataacaccatatgtatttttactgtactttttctatgtttagatagatacttcccgctgttccagttgcctacaatattcagtgcaggaacatgccataaaggtttgtagcctaggaggaataggccatgccatacagcctgggtgtgtagtagagtacaccatctaggttggtgtaaggacactctatgatgttcatgcaatggcaaaatcacctaatgacatgtttctcataatgtatcctcatgaagtaatgcatgcctatattgtttattttgtatatcttatatttaaaattttaatagctttcctgaagtacacttctgataagttacaatctgataagttctaaaatatgtctgttcacatgaaaccaccacaatcgagataacgaatgtatccgtcacccctgataatttctccttgctccattttaatccccccatcctgctgcatccttcctacttccacacccatgtgcatttcctagaactttatataaatggaatcatatagtaagagtatctgaataatgttaataataagttgtcagtttataaagaccttttttaaaaccatctatttaatgtctaacttaagagtacgattttttttttttcctgcaatggggctatgtcttgattttctggggagagatattagaagtggtccagttcataaacatttaatatttcccttctggataacatcaaagcacagagaacagaatagagaataacatattaggcatagcattaaaggaagaattagtctttctttgatatgtccacaaaaattgaaatcaagtatattggcatgaaaaggtgaaagaaaaagatttctaagatgatgatttagtccacagggcttgcctctctttaagcacagaggttattgccagctgaaagaaactggggttctggtattaaggaaggtgggagggatgagtggttggcaggcaaccaataggatctgccatttttactgagtcataacctcacatgatgctcatgaacctcacatgtagtttttagcacctttccattcaccactttgttatcttcagcttactggtcgttttctgatgtatctgactgttgtctgtagactacctctgggggcctctcatctgcatgattatctgcagtgtcatttttatgtggatcatagctgcttccattttatggggtatcaccttctgcttttcctattgaaaagagatcagtgtccagttgagcaagattagtcaactactcgaagtgaggacaactaatgaagcaacacttgacttccttgtggttttgtgttgcactgatctgagaggagctgacattagttaagcaattcacacagtgttcagcactgtatctgatttcattactgaaggttgcaaccctagtaaagtcactacaaattgattagtgtgataacaatcacttaggaagataaattaatgagaaatgttcatctttataaatatttgcatctgggagttgaatgaaagccccaggacattctagctttcagccacatggatgtacagcttctaagtggtaaagtatcatgctgtccagaaaagagattgagaaggatacatgctaaattaagcattcaaccatgacatccaaaggcagaatgtcttagaaataccacttgaatgcattagcacaaaaggttgtaaagttaagggatttaatgctatacaactctatgtttgaatgctatttcaatgtgattggatatctttttaattgctaagtataactgcaagtttttggcaggaactactagtagatagaacgaatgaatgagtactaaggaaacctttattactactttgtgagtaaaggtctccttaggattcattcattcttagacaaagttgtacatccctacttcttcaaagaggctttttacctcacatcttaggatgctaggattagattatgcttttgcataacttaatgtgaactagcaaaggaaaggaaaatagcatttattaagcacctattattgttccacacctacagcaataggaaagccgtatcatgaatttatcttcatgttcacctcaaactccatttgagggtgggtatagggctcctagcccattgctgtattgaatttagaagttcggaagaggagagggtagaaagaaaacttgaatggatcagaaaaattaacttacattaggagaataaagtggaaaattatgcaaatattgagagtatttatgtcttttaaaatattttatcccgtaaaaaatcttggctctgcctatcgtaagatagtctcatgtatgaaaaccagcatatagaattataaagtcatatataaatgaggattttagaagtggcttataccaagaggcagtgtgacaacatggatttgagcatgtgctgccttgttggacttgggtggcaactagtgctaccatttgttcagtgagtaatctttgaacaattgtttaacctttcaaatgcttgttttcttacctgcacaactgagatattaacacctacatcatgtgtggtcgtaaataagtaagataatgttttttaactgttaatacagaacttgacataaagtgaggtccagaaatggtagccgctaccttcatctccttctgacaatgatgataatgatgatgattttcacatcatcatatagtccagatttcatccgatgtttggacttcctctgaatcaaatggtcttgcaacctctgcttggatatcttcttaatgacagacttattactctcaaagaaaacccgttttatattcagtagcttttagtttaaaatttttcctttgctgtgttaccttcttctaaaatttgacttttctctcattcttcttaaacatttttgctgggtctagcattcttggcacagtctttctgaaaaaaaatagcttcatgatatatttcaagtactttaaaaatgtttatacactctgattcagtaatgacgttttcactcattttataacatagcaaaagcaaaacaaaatatttaaagattaaaacacacatggaggggtcaagatggttgattagaagcagctgtggatggctgctcccactgagaagaatgaagaccgcatgtgaatcctgcaccttcagctgaggtatccaggttctctcactgggactgatgaggtgttggtgtgacccacagagagtgaggataagcagggtggagtgatggcccacctgggagcagcacaggcaatggggagttcccgcccccagccaaaggagcagagagcgattgtgctaccctgccaaggaaaccaagatttacccacatatctgtgcaacccatggatcagaagatacccttgtgagcccacgccaccagggtcttgggacccaagaacagagctgtgcagactctcagcagctgctcgagtcgtggccagcagcagcatgctgaagactgcctgagatgaccaagtttccagaggggaaggggagctgccatcactgtgccccagccgttttcccctgctggtgccctggagactaggtggtttggatgggaaagaagtccccacagtgcaacacagcagctgtagcagattgtggccagactgcttctttaggtgggactgggctccatccctcctcaccaggcagggcctccctgtgggaatttcagcaactgcagccagaggtttacagaccgaactctaatccacctggaatggacccccagggggagaagcagctatggtctccaggctcagtagttagtctttcctgcctgctggctctgaggaggccaggcagtccagacaagggggattcccctgagcacaaaacacccgctctgccaaagggcagccagagtgcttcattaagtaagtggctgatcccatgcctcctgactaggtgagaccccccacacacacacccccaataggggttgccagatattttatgcaagagcattccagccagcatcaagtcactacccttctgggacagagctcccagaggaaggagcagacagccgtccttgctgttctgcagactccactggtgacacctccaggtgcaggaaaagacccaggagtggccccccagcaaactgcagcagctgtacagaagaggggcctgactgttaaaagtgaacagaaagcaacaacaacatcaacaaaaaaatacccacaaaaccctatccaaaggtcagcagcctcaaataacaaaggtagataagctcacaaagatgaggaagaatcagtgtaaaaagctgaaaactcaaaaggccagagtgcctcatctcctccaaatgattgcagcacctttctagcaaggacatagaactgggctgaggctgagatgaatgaactgactgacataagtaggcttcagaaggtgggtaataatgggctggacgaggtggctcaggcctataatcccagcaatttaggaggccgaggcacatggatcacctgaggtcaggagttcgagaccatcctggccaacgtgatgaaaccctgcctctactaaaagtacaaaaattagccaggcttggtggcacatgtcagtagtcccagctactcagggaggctgaggcaggacaattgcttgaacccggaaggtggaggttgcagtcagccgagctcacaccactgtactctagcctgtgtgacagagtgaggctacatctcaaaaaacaaaacaaaaaacaaaacaggtgggtaataacggacttctttgagctaaagaagcatgttctaacccagtgcaaggaagctaagaaccatgataaaacattacagaagctgttaaccagaataaccagtttagagaggaacataattgacctgatggagctgaaaaacaacacaagaacttcacaatgcagccacaagtatcaatagtgaaatagactaagtggaggaaagaatctcagagcctgaagactatcttactgaaataagacaggtacacaagattagagaaaaaagaatgaaatggaatgaacaaagctgccatgaactataggattatgtaaaaagaatgaacgtatgaatgattgaggtacctgaaagagacagggagaatggaaccaagttggaaaacgtacttcagaatatcatccaggagaacttccccaacctagaaagacaggccaacattcaaattcaggaaatccagagaaccccagtaagatattccatgagaagatcaaccccaagacacacaatcatcagattttccaaagtcaaaatgaagaaaaaaaatgtttagggcaacctgaaagaaaggttcaggccacctagcaaaagaagcccatcagactaacagcagacccccctcagcagaaaccctacaagctagaagagattgtgggccaattttcaacaacttaaaaaaatttccaaccctgaattttatatctagccaaactaaacttcctaagtgaaggagaaataaaatcattttcagacaagcagatgctgagggaatttgttaccactaggcctgccttgcaagtgctcctgaaggaagcactaactgtggaagggaaaaactgttaccagccactaaaaaaacacattgaagtacaaagaccaatggcattatgaagcaactacaccaacaagtctgcaaaataaccagttagcatcatgatgacaggatcaaattcacacatagcaatattaactctaaatgtaaatgggctaattgccccaattaaaagacacagaatagcaagctggatagagtcaagacccatcagtgtactgtattcaagagacccatctcacgtgcaaagacacacaaaggctaaaaataaagtaatggaggaaaatttaccaagcaaatggaaaaacagaaaaaagcaggagtcacaatcctagtttccgacaaaacgggctttaaaccaacaaaaatttaaaaagatgaagggcattacataatggtaaatggttcaattcaacaagaaaagctaactatcctaaatatatatgcacccaaatacaggagcacccagattcataaaacaagttcttagagacctacaaagagacttagactcccacacaataatagtgtgagactttcacacccactgtcaatattagacggatcatcaacacagaaaattaacaaagatatttaggacttgaactcagctctggatcaagtgggcctgatagatatctccataactctccatccacaaacaacagaatatacattcttcttggcaccatatggcacttactgtaaaagtgacctaaaattgataaaattccaattgtgattggaagtaaaacactcctcagcaaatgcaaaataactgaaatcataacagtctctcagaccatagctcaattacattagaactcaagattaggaaactcacttaaaaaccacacaactgcatggaaattgagcaacctgttcccaagtgactcctggataaataatgaaattaagtcagaaatcaaattctttgaaactaatgagaacaaagggacaatgtaccagaatctctgggatgcagttaaagcagtgttaagagggaaatttatagcactaagtgtctgcatcagaaagctagaaagatctcaaatgaacatcctaacatcacaactaaaagaactagagaaccaagagcaaacaaacccctaagctagcagacaagaagttaccaaaatcagggcagaactgaaggagttggagacacaaaaaaaattcaaaaaatcaacaaatctaggagctggttttttgaaaaaaaaattaataaaatagcttgctagactaataagagaagaatcagatagacacaataaaaaatgataaaggggatattatcactgatcccacagaaatagaaacagccgtcagagaatactataaacacctctatgcatataaaccagaaaatctaaaagaaattgataaattcctggacacatacacccttcccagactgaatgaggaaaaagttgattccctgaatagaccattcacgagttctgaaattgaggcagtaaaagcctaccaacaaaaaaacaaacaaacaaacaaacaaaaataacaacaacaaaaaagaaaaagcccaggactagatttacagcagaattctaccagaggtacaaagagaagctggtaccatttcttttcaaactattccaaacaattgaaaaggagggattcttccctaacgcattttatgaagccagcataattctgatacaaaaacctaggagagatacaacaaaaaaagaaaacttcaggccaatattcctgatgaatattgctgcaaaaatcctcagtaaaatactggcaaaacgaattcagcagcacatccaaaagcttatccactacaatcaagtctgtttcatctctggaaagcagggctggttcaacatatgcaaatcaaaaaatataattacataagcagaactaaagacaaaaaccacatgattatctcaatagactcagaaaaggccttcaataaaattcaacattccttcccgttaaaaaactcccaataaatgaggtattgaagaaacattcctcaaaataacaggtgccatctataacacatcttcagccaatattatattgaatgggaaaagctggaagaatttccttttgaaaactggcagaggacaaggatgccctctctcaccactcctattcaacatagtattggaagttctggccagggcagtccaccaagagaaagaaataaagcatattcaaataggaagagaggaagtcaaactatctttgtttgcagatgatatgatcctatatctagaaaaccctgtcatctcagctcaaaatcttcttaagctgataagcaacttcaggaaagtctcaagatacaaaatcaatgtgcaaaaatcacgagcattcctatacaccaacaacagaaaagtggagagccaaatcatgaatgaactcccatttacaattgctacaaagagaataaaatacctaggaatacagctaacaagaaaatggaaggatctcctcaggagagttacaaactactgcttgaagaaatcagagaggacacaaacaaatggaaaaacattccatgcttatgaataggaagaatcaatattgtgaaaaggtccacactgcccaaagtaatttatagaccaagtgctattcccattaaactacctttgatgttactcacagaagtagagaaaactattttagaagtagagaaaactattttaaaattcatatggaaccaaaaaagagcccaaattaccaagacaatcctaagcaaaaagaacaaagctggaggcatcgtgcgacccaacttcaaactatactacaaggctacactcaccaaaacagcattgtactggttcaagaacagacacatagaccaatggaacagaatacagaacttagaaataagaccacacagccaggcgcggtggctcatgcctgtaatcccagcactttgggaggacaaggagggtggatcacgaggtcaggagatagagatggtcctggctaacacagtgaaaccccatctctactaaaaatacaaaaaaatagctgggtgtgctggtgggtgcctgtagtcccagctattcaggaggctgaggcaggagaatggcatgaacctgggaggtggatattgcagtgagtcgagattgtgccactgcacaccagcctgagtgacagagcgagactccgtctcaaaaaaaaaaaaaaaaaaaaaaaaagaccacacatctacaaccatctgatcttcaacaaacctgacaaaaacaagcaatggggaaagtattccctatttaataaaacgggagctgacagaactggctagccatatgcagaaaattgaaattggaccccttccttacaccatatacaaaaatcaacttaaggtggattaaagacttaaatgtaaaaccccaaaccacaaaaactctagaagaaaatctaggtaataccattcaggacgtaggcatgggcacagattttgtaatgaaaatgccaaaagcaattgcaacaagagcaaaaaattgaccaatgggacctaattaaactaaagagcttctgcacagccaaagaaactatcatcagagcaaacagacaacctacagaatgggagaaaatttttgcaatctatccatctgagaaaggtctaatattcagagtctacaagaaacttaaacaaatttacaagaaataaaacacattataaagtgggcaaaggacacgaacagacagttctcaaaagaaggatgcatgtcgccaacaaatgtataaaaaaagctcagtatcactgatcattagagaaatccaaatcaaatccacaatgagataccacctcacggcagtcaaaatggctattactgaaagtcaagaaacaacagatgctagtgaggctgtggggaaataggaatgcttttacactgttggtgggaatataaattagtttaaccattgtgaaagacagtgtggtgattcctcaaagacctggaactaaaaataccatttgtcccagcaatcccattactgggtatatacccaaaggaatatagatcattccattataaagatacatacatgtgtatgttcactgcagcactatttacaatagcaaagacatggaatcaacccaaatgcccatcagtggtagactggataaagaaaatgtggcacatatacgctatggaatactatgcagccataaaaaaggatgagttcatgtccttcgaagggacatagatgaagctggaaaccatcattctcagcaaactatcacaaggacagaaaaccaaacaccgcatgttctcacttgtgtgggaattgaacaatgagaacacctggacacagggcagggaacatcacacaccagggcctgtcagggggtggggggctgagggagggatagcatcaggagaaatacctaaagtcagtgatgagttgatgggtgcagcaaatcaacatggcacatgtatacctatgtatcaaacctgcacgttgtgcacatgtaccctagaacttaaagtataataataaaaaagatactaaaaaagaaaatgtggtacatatacaccatgaagtactatgcagccttaaaaaggaatgaaatcatgcccttttcaggacatagatggagctggaagccattatcctcagcaaactaacacagcaaagaaaaccaaacgtcgcatgttcttacttacaagtgggagctgaacaatgagaacatatggacacggggagaggaacaacacacaccggggcctattgatggggagtcagagggaaggagagcatcaggaaaaacagttaatgcatgctgggctttaaacctaggtgatgggttgttaggtgcagccaaccaccatggcacacatttacctacttaacaaacctgtacattctgtacatgtaccccagcacttaaaaaaaaaaaagacaaccccatccccaccccccgacacacacatcagtgctgtacaaaatcctgtgtaaatgttggttcttattaaagtctaaattccacatataaaatggggcatgagggtatccaagtttgtcaatatttatcaaagttgagaaatatctgtacactttttgaaaccctaagccagtcatcctcagcatgaattgttatttttgattctgtcatttctttatttaatgaagagggagatttgtaaaaatccattttgattttagcatgatgtcaattgagatttattccatcatcctaattaccaagacatatctaggaggaatgttaaaagcacctaataatttaattagaccaattacttcatttactgattggggcactaaggctcagaaagaaagcaggatttaccaaattatacccagctaaatttagaactaaaatccagaatggcagtattcttccctgtgaccaaactgactgttaagtggtaattttttaatgatatgtttagtgtgacaagtggttacacgtggcaatttccctctcatgaggaataactttgactgaaatgcatgttgaactcatgagaagattcataagcactatgagaaggaaactggaaacaacagtggataatgcaacggaactgaagcttaattatggatgatctaatcactgggatgatattgtatacttaatgtatttctcgtaagagttaagcgaaatgattttagtgacctgccttagaaagtattaagtcagcttatgacagaagttacaaactgaatccaggtcacagatgtagtctatttgcctcacacagtatttttcttttaatatgtgtgcttctaatatttaacaatctgagaatctcacatttttttaaaaatctacattttctgattcttatgaaggaacaaaaatatggtagagtgtttcgatattcttacacggtagagttcaggggcagtctcacattttgaaaacttcatactttatatgagacattttttcttcagtttggcatagtctcaccagtcactattgtgtcatacccagttacttaactcatttatactgaggacctctgaagtaccttgcaggtgcagtacctggtttatggtgttatgaatgtacaatacgtttttacttaatgtcctcagtaggttcttagaaactgcaactttaagtagaacaccatatattaggtccttgagaaacattgttttgtccagagtcattttgttataacattggtgaaaaaaaaaatgcttttgttacatgttatttcacttaaagtggcagtttccaagaacctatggatgatgataagtgaggtcttactatatatatatatatatatatatatatatatatatatatatatatatatatatggttttacataaaactacagttttatataggtcttactatatatatatatatatatatataggtctttatatatataaagagagagtaatatatatagttatatataaaactatagtttatatatagtaatatatatagttatatatatatatatatatcatcatgcaggagttaagaaactaggatgatttcataggattaatattcactcctctttaccattccttacttcttgtttctctctcttgtgacccagtttctcctagtggtctagcttgggggttcccctaccactttattgaggtataattgacaggtaaaaattgtatatatatttaaggtgtacaaacttaatgatgttttaatatacatcatgaaatgactaacataataaaaccaataacgtattcaccacctcacataattgccttattttatgcatgtggtgagaatacctaaggtctactttcttaacaaatttcaggtatataatacatgcttattacctatagtcaccatgttgtatattaggtctccagaacttattcacgttataaatgaaagtgtgtactctttgatgaacatcttgtttcacctaccccactcccaccctcactaacaacccttctactcaatgtttctgagtttgactttttaaaattctacataaaagtgagactatgcagtatttgcctttctgtgacttggtgatttagcttaatgttctccaggttcatccacgttgttaaaaatgacaagatttcttcttttaaggctaaatagtattccattgtgtatatataccatattttctttgctcattcatctgtcagtttagatttaattcatatcttggctattgtgaataatgctacagtgaatatgggcatgcagatatctctttaagataatgattttctttctgttggatatgtacccagaagtgggatggctgtatcctatggtagttctattttactttttttgaggacgctccatgcagttttccataatggctgtaccaatttacatttcaaccaacaatacaaaaaggtcctcttttctctacatccttgccaacatttgttatctttcttctttttgataacagccattctaaaaagggtgaggtcataactaattgtggttttgatttgcatttccctgatgattagtggtgctgaacaccttttcatatacctgttggtcagttgtatgtcttctttggaaaaaggtttattcaggttctttgccaagttttaaatttgggttatttagttttatgctcttgagttgcatgagttctttatatagttttattattaatccattatcaggaaggtagttttcaaatatgttctcacattccatagatttccttttcattttgttgatttttttttttattgtatggaaaagttttagtttcatgtagtcctacttgtttgcttaattttgcttttgattcctatgcttttggctcatataagaaaaaagtcatttcaaagaccaatgtcatagagctttgcccctatgttttcctctagtagttttactgtttctggtcttatgcttaagcctttaacccatttttgagttgatttttgtgtacagtataaaataaggattcaatttcatttttgtgcatgtggctatcctgttttctcagcaccatttattgaagagactatttttttacccatcacatattttggtaattttgttgaaaattacttaaccatatctgtgggtttattgctcagctttctattctgttccatttatctatgtgtctgttttttgtttgtttttgttagtaccatactgctttgatttcaataactttttaatataatttgtaatcaggacatatgatacctccagttttgttcttcttggttttgaaattgtatgcaagttcaatggcaggcagtagttgtcttagaatttctggagtctgaagtatggccctttacagccattctctactctgagtcttctaaaatgtgcttcctttttgttcgtctaagcactaaagaacttaagctggggaaggagggagataaagatgagaaagtgttaagatttggattctgagtgctgtttatgagggaaaaaaaaagtgagaactatcatgggatggcagacacgcacacagtctgaataggttccattgataaattagttgcaaggagcaaagtcatgtctctggttagtttagaaacaaaatgaaggctatgatggcttctcctcagtaagcaaagcagctccaactcccaagtgaacacactgcacacaaaacagtattttccatgccacttgcatggaacacgagcatcttgctgtcttaaattaagaagttaactggaccatgaagtattgcctgagtaaataaaagtgatttgtactaagtcagaagggtgcattaggcctctttgcgtttctttgctcacacataaattatggatattattaaaaattggaagggtcatctataagcccatctgtactatgaagccaattgccattccccaaatgtatctgttttcctcttataacttattgtggacgataatgtgaaccagctgcttacattttttttaaacagacacataaactttgaatagttcaacacgtaatactattgtcagtttattcgggaaaacagagatacgtattcaaaggcttttggctgccatacaattaacatggctgatggggataaattgactgtgcgtgcttttcttaaatgaagcttatactagaaatgtaagagttactgagggctttggtcgatctcagttataacaatgtcagccagagttctggtaggagaagtgtgttcaaacttcaaaggagcctgagaatgtctaattgtatgagttgagggccactgggcaggtaagattcctcaaattcttcctcattgcctatcatggtacagaagggtccatcattagaatctcttttatttgaaggcttctggatctctcagtaatttttattcagccagactcatactataaacactcctttcactgatgtacaaacacatttccacaaaggtttggaaataacttataagaagtacatacagtaacatagtcacaaaagatataatgggttaagatcagaaaaaaaacataaactataattggaggcaaagatgagggcaagctatagaatataaggggagtccatagcatcccaggagtttgctcttactaaacctggagtttggctatgaatttttgaaagagagagacagtgtgttggatgtaaccttctatctgtactttctagagatttggttaaaatgtcctggatgatgtggggagttaaaactagcagcctagtgttagagaaagtacactagattcaaagtcagggaatctggcttctcttctcactgtccaagtgagcccttgagcaagttacttctcttcatgtctcagtttctttatctgtgaaccatctatctgtgaaagaagctggatctggatataatcaatggttttctgtagcttttttttaagtcatgaaatatttttaagcctaattttactttgaacccccaaatccaaaccagctggaagctgagctgctgtggttgaccaggagatggtcctgcacctgttgtcctacccaaccaatcttcctgtcaccagccacagggggccgaggcccttgctgggattccacagaccacagtttgaaaatgaccagactggatcaaaaaatagcctcattttttccaggtctctgttccaatgccattttctcgtgaagaccttccctgactgccttatctaaaatatatctctgacccagtagatttatcttgttatatcatatcatatcagattacatatgtatcatataattatatatttttacatttacctgtttgtttgtttccactattactttataaactccatgacagcagagatggagaaaggcagtactacatggtatttgggagcaggatctggaataccaacttcctgaatttgaatctttgctccaccatttactagccttgtaactttaagcaagttacttgaccttttctgtgcctcactttactcctctgaaaaatgggcataataatagcactatctcataagattattatgggattataagagttaatttatgtaaagcttatggaatagtgcattggatgtagaacactgtataatatttgaaaataatactatatattattagcatttattaatactattatctttttttgccaccgtctccttagtttctagactagttcctgtcacatgataggaaaacaaattgtttgaatgaatggatgttctcttaggatctttctgactcaaagattctctaagaagcttttggagagacaaacatctcttcaaaaggatcttatacatttattaattatctgtattagctacatactaagtattcaactatgtagacagtggcacgagcagctatgtggtgtgaggccatgagggagtaagaatagactttaggtggaagagctaagagagggctaaaggtaataagtttcatctttacgtactctgcagctttgacctcctatatgccttgattcatgccattcataagcttctgagagctcctaagtgttgagctgtgtgttatagataggacattttaatagaacaaaattagcatttccagtccttcaaagctttgggtttctcatcatcatcactatggcatttcaacatcatctaatacttttgatttcaagaacatcccagctgtctagaatgactagttgctgctgagactgcttcttgcttatttcataaattgcatttatgagaaagaaatgcataccagagtccactgcagcttggtttgttcctttagtagtaagaagattcctacctaggttaggaggcattcccacagaccgtagtaactgctgagtacatttgaggagaataatagagggaaggtagccttaagaaaggcacatgggccggtgcgccagctcacgtctgtaatcccagcactttggaaggctgaggagggtggataacgaggtcaagagatcaagaccatcctggccaacatggtcaaaccccgtctctactaaaaatacaaaaattagctgggcgtggtggtgtgtgccggtagtcccagctactcgggaggctgaggcaggagaattgcatgaacctgggaggcagaggttgcagtgagctgagattgggccattgcactccagcctgacaacagggtgtgactctgtctcaaaaaaaaaaaaaaaaaaaaaggcacatgttttaatatggtcatgtggtcttaaaatctttgtttttcttcactcctatgttgttggcaaaaaaaaaaatgttgctgtaaaaaaaaaatgctttttttcttaatgcttccatcaaaacagattcatcttctggcaactctggctgtacccagtgctctgtcattgctatggatatgttacgccgttagtcttaattttaaaaaacttgttccttgtcaaaaacactgataatttttcaggagacacagtttcagaagctgaaaaaacttttttgccatatgaaattataatcatatactgttactttgattttgtgatctctatcagcagctaagtgtaaccttttgatgcagcactctataaattattaaccatgatgttttaaatggcagtggcctaaattatgactgtgggactttgcatttccatgaatgattgtttttattagcaatgattcttcctctaggcaaataccaaatggtctgcaaagtaaatgaggcttttaagattgataaatatttcacagatgcacttgttgcatattggagggggagaaggaagaagagagagagtgacacaaaccaccatgttgaaagaatgagttaagcagactgccatgttttcttccttgcttggtgcaataaataaggtggatttctcaacctcgtaagccacagcttccattttgcaacatcagagtcctgaaaataaaaaatagcaacactctccagtaaaagacaagtacagatgttacaataattgaagttttccaccaccaagctgtgtagataggttttagccctcagttaaagctcagcagttatgtttaaaaataagagaggaatatttatggaaagattaattatccttaggtggtagctcattaagagatgtgaaatgaagttgagtttatttttaaatcattaatgcataggtatttatattattgaatgactgtatagttcccgtatttatggctgacttcagttgctaacaagccaaagtctttcacttatttcttagcattctcaatagttttttgtattgtcttgccatgtgaattttctgaaatgtgaagttcaccgccatgctttatttcttttcttttcttttccttttttttttctttttctttttttttcctcagatggagtgttgctctgttgcccaggctggaatgcagtggtgcaatctcggctcactgcaacctccacctccctggttcaagcaactcttctgcctcagcctcttgagtaactaggattacaggcatgcaccaccgtgcccagctaatttttgtgttttctagtagagatgggtttccccatgttggccagactggtctcgaactcctgacctcgtgatccacccatctcggcctcccaaagtgctgggattacaggcgtgagccaccgtgtctggccgccatgctttatttctattgctgctacaaagagcctactaaataacaaagagtttctttcttcctcatcatatcttagcaaaactcgggttagggagtgttgtggtttaaatgtgtcccctccaaaactcatgtgttaaaacttaatgacctatgtgatagtattaagaggcggggcctttaggaattgatgaggtcatgaggactcctccctcatgaatgggattaatgcccttatgacagaggtttcgtgcagtgtttggcatttttagcctctcctgtctcctcttctgccatgtgaggacatagtattcctcccttggaggatgcagcaacaaggcaacatcttggtagcaaagagcagccctcaccagacaactgaacctgctggaaccatgatcttagactttgtagcctccaggactataagaaagttaatttctattgtctgtaaattacccaggctggggttcttttggttgttgttataacaagaaacagatggactaaaacagaaatgtacaggaagtataatgaaaacaggatttgacagcattatgatagatgttacacaaagtataagaagatgactaaccccaatgcaatggtggaaggtaaaggaaaattgccttctttctgtgggtaaagacactggaaagtctttttgtcagggttctctccacacaacacatcacagggtcggtggtcctgttcgatccagcaacattgattatatggtaaagctgcacatgacagtttttaaaattggcccatatggcaaaaagtcaattcttaaaatttcccttgaaaaaaccttaaatcgcccacaaaatatagtagccatagtcttatatgcatagccttatgcataaatctaatgtccaggagaaccactgaggctaaactaagtaatgggaaaaaaaaagactctacgtaaatgtatggacatgggctaggcacggtggctcatgcctgtaatcccagcactttgggaggctgaggtgggcagatcacctgaggttaagagttcgagaccagcctggccaacatggtgaaaccccatctctactaaaaatacaaaaaattagccggacatggtgacaagcgcctgtaatcccagctactcgggaggctgaggcaggagaatcgcttgaacccaggaggcagaggttgcagggagccgagactgagccattgcactccagcctgagtgataagagcaaaactttgtctcaaaaaataaaaataaaaaaaggtatggacactaaaactgttctgttcttgagatactagcaaattgctatcaggaaatgaggaatgcttgggaagttttaaggtgttcctaagtgtctgcagggttttgctgttctaatattgaatatctgtaactttaatacatattaaaatatctgctgttgcagagattgaatgaactactagatgtgaaagtactttgcagagggcccaacctattgtgattgctcataaatgtttgctgaatttgaatccaaataccatgtgattagagtcttacattgtaatagctaacagatacagtgctaatgtaaaattatcttgtttattttatttatttatttatttgagatggagttttgctgtgtcacccaggctggagtgcagtggcatgatcttggctcactgcaagctctgcctcctaggttcatgccattctcctgcctcagcctcccgagtagctagaaccacaggcacccaccaccatgtccggctaatttttttatttttttagttgagacagggttttaccacgttagccaggatggtctccatctcctgacctcatgatctgcccacctcggcctcccaaagtgctgggattataggcgtgagccaccaagtctgcctatcttgcttatttcttatagtgaccttataaaggctctatcactttgatcttctatttagagatgaacagtcaaaggattataggcgtgagccaccaagtctgcctatcttgtttatttcttatagtgaccttatgaaggctctatcactttgatcttctatttagagatgaacagtcaaaggcttagaaaggcacagaaagaacatacatctaatactccaacccaggttgattctcacaccctgtccttaactgaaatgccatcttatcttggagaagtaaacagtagttacaggttgatctgtgctgcttacccagctggctttctcggtagccatgcaggacgcttgccagtttcatgaagaggagaccatgttatttcctttctctacccattgtggtttctctggtcattcctcacaccccctctgatggcttctgtactgtagtttctcttcacgtagtcacagtttcctatggagtccattttttctccactcaaactgcagatctcctaaattgtaccatctcctactatcctgttacttctctctgtccgtaccttttgttagaattgcattacagtatctacttggaaataatcaaggacccatgtgtgaatttagtccctgactcaggaaaaaatgccatgatattctaaggataatatgctctatagatatgttttcatccagaaccccagactatacatttttgtactacaaattttttaatgtgtaagtgttctactggtttctcagagttcagcaaaatgaaataaatggaagattataaaaacttacacaaattctaaatttccaaagacatggactttcttatctctgattccttatctaactacagaacatagaaaataagagtgactcttttcttaggttttccaattgtccaaatacctgtgccactctagatgcctaacagagatgttaatttattatatataaggatgccttagggcttaattacctgtgggacctccatcggagaaaggattgtcttcattctatattcaatttgccttataaaattcttcttataaataataagtgcaagaacccataatgattctcattccttgaactgttccttcatttcttattgaactgatgtactcagagtatacttaaaagcccactgtccccacgtagacaataaatattcttggacaaagtttttttttcctcttttaggttgaagacttttcttttatctccttcaaatgttgcagtaggtgttcatgtcaatcaatgtaacactataaatttgcgtggttttttcggtcagtattcattagtggcagcctagggaataactaagagttttccaggttatttgtatgaattttaattaaatacagacagtatatttggataccatctgtatggacatcattcttttttttttttggcatgaagatttacatgaagaaattgtctggtcctactcagctccatggagctgccagacacgcccccacattatgcagtcagcaatgtacaaaagtggaaacctagactttccatgtgttcacagtcttaggcctctacggcttgccctagccaagattttttgccatttcctaatctaccctcagcctttctcccttccaaatcatccttttgttcatggccttgccatatcctgattctttatactctattctgcttctctaactttgatggatacttcatctcttgattgtggtatgagttctgtctgtttaactccatagccttcagccatgcaggaaggtcctccctagttcccatatggaaatgctttccgtggatatcttccttcccatgggaagacttgcatcaaggtgcttgtgagggcaatatagcatagtagcaaagtacatgtaatttaaagtcagacaaaactgtgtgtgaagcttggttttgcttcttactagcttcttactagctttgtaactggaggcatattacctgacatcttagtacttcagtctctctatccgtaatatgggtaactaatagtatcatagagttgttttgaaaattaaacatatacagggtgcctacaacagtgtccgccacttaactcactataaatgaccactattattactagaggcttcgtgatagaagaaagccctgagaaaagtatcaatggattggtagtttggttactcctatgttgttaaaaatataaataagattccttatattcatctccatttattaattccagttgcaatgctcagttgactcattttgaatcctgccaaaattgtaccttctgagctgaagccaattaaaataaaaatctcttttttccagaagccaaaagccatttcccaagaggttcttgttcaacccacacatgcaaatgcagctgtgatggttttgtcagagattttttttcagaatatcacacaccaatgttagccttaaagaatgataccggggctctctgcttcttggttcatggggtatacccacaagcaaaatagaaacaaagcaaaggtaggtagccccagttggcacagttgattgactttaataggtcctgattatgctgctcatattccatgaaattaaaaagcttacaaatgttatgagccattacccttccatttaagggagcttatgacatgttagcaacgtttaatgaaattcttttcaaaatgccattggcagactcaatgagattccatgttgaaactcaacttgaagaattgtctgaggaagtttgttctctacctgcctgtctttgtaatgtgtgggacccatttcaaggccaaaggaagttctttatcagttaggggataattttcatgtatccagaagtatttctgctttaatcatgagagtgctttccagttgaagacaacatcatagagactgccatgttaatgtttgtgtttagagagcacaagaatagtctatttttacacaatgatgaattttaaaatttaagtcatttctgttcaattctgtctatatttggtgacagtctaaaacattctagtaaatattccaaaatgttattgcctgtcctgtctttgatgagccatcacagtataatttgggaaataagcctttgtgcaataaggtaattaaagcataagaaatgaggtaattaaatactatattatatggtacttattatttacacagtaaaagttcaagaaataaaaaatactgcagtgagttgacggataatttttttaaagaataagaaagatgcgtatgagacataagtaatttagggatcattggttctttctgttaaatagtctttcattatcactttgataatggggatatttaatggcaatattcatttgtcagggtactagccatatcaacatcttgttgctgatgttctaccactactttttgagatcttatgggtcaagaaggatactatgtgatttagatgcattttaaaaatcctcctgacattcttataaggtcgtttatattatctccttttacaggtgaaaactgagatgctaagtacttaggcattggtctctagttagtgtgtggagcagctggaattcaaagccaggtgtgaactaccccacagcatatattttcttgatatgaatctgctttgaaaaacagattatgccagggcagcccccattgtgaactctttgcaggcaaaattcctgttataggacttagtcatcatcgcatttatttgaccatgtcattgcttggcactcaataaatgtacgattaatgtataattaatatgttaaggaatcacaactcataacacaagtaaaatgcagctttatttttgtcatcactgatcctttaagctttgaggtgtttgtttgtttgtttgtttgtttgttttttggcagaggttatgatctggagggaatcttttcttcttcctcccacacaaaaatgtggacagttcctagggtattttctttccactgaaagttagtaaaaattctggtggctcattaagagacaaaacgcagtctcagttccaacattttaaacatttcatctaaaacacttaccaatgtttcaaacctcattcaaagttaagtatttatttcttttcctcagatacagccttgacttggtggctctctgcctttggttgtctgggccctcatcatcttctgatgtgcgagctgctttccatagtcctagaccctaccaggatagtagtaatggaggatgaggcagttctttcttggctttgtgactttgtgccgctgggactgataaatatttaagctgacttcctccctcgtgaagcattttctgggttctttggagatttccggtcctgaaactgcaaaacatctacagcacctatggcaaaagccagtgaagcattctgtttgtgaacaggctgttttccccattattctactccatggggaaacttcttgtctcccagtagtccccttggggaggatttcagatgtctccaggacagtgctctctcccccttggcacatctgtgttttgtgaaaaatgatcatccatcttttacctgacaaactttgggagtctagtctctctctgaagcaggggccctatcctgcctctagtaccttctgcattcctggtgggaagtctatggtgactttgtggatagagaacacatttcaagatatcagattggattcactgaagcctgttctcactgggcttgaggttagaaggtagcagccacacacacacacacacacacacacacacacacacacacacacacacaggtatatatatattttcacaggtcccctttcctccattcccttgacccttatatcttgaaactagcgagggtgttctttgatacttcctctatcaaatcttcatattttatctggtgccttacgttggagttctatatcaattttatcttcatgcccagttgaaaccacatttttaacatcctcctaaatgtgccctgtgattctctgactttcatagtaaagctgttagatgggctgccttagctagtcccatcccatcctgtatacaaggtcttgacacatgatggaaggaagaaaatgttggtattcacccaggatacacaagtgaatggaaagaaaaaaaaaaaagatgctagtggctagatacttctgctttcccttcttctgccttctcatggttctgggcctggaaagacataccgtcttttcttcctgtgagggttaactaaaccaaagattatatatcttttccttgcagccagatttctatgggcccgttctggtggttcgggtagagctttcagaagccatcttggttagtgataaatccttcttggctttctcagagccccagagtctctagaataatatatttggaaaaaaaaaaataccattgactaaggataggcttagtggttgactgaaagtgcttccactggaggttatggtaatgtcatttggagcaattcactttagatttttaaggaggcaaagcatgtatttgaagaatagataagaaaactgcaatgaaaggatgttgtttctaatggaactaacccagaatttagagttaaatgttttctgattttctgtttgttgcttgtttttgatacctttctttgttgactctgctatccttaagaatttgaaaatgtaggtcaagaatgattttttttctctccctgtgcctggcgacttctcattgactagagatacagcctgtaagtttgcagccatcacaaccccattgtctctgctcccagagctctatgattgctctgctctcagtgtcttatacagagcaggtatttagcaagtttgtagacttaatttttttggacttaatgcaaattaagacaccttcatttcttctcacctgttttgcttggtatataacacttaaaaaaaagcctctctgagctctttctgcttatctaggattgtattaagtgtttgaatacattttacggcccagagtagatgctaaataaatgattattgcataaatagaaagagttaaggaagagaagaggaactggagaacagaggcacaccctctcctgtgatatcttgccctacctcaatattgcaagtttcacactgtcccttcatcttttcaaaatttctttgttccagtattaattccttctcaggcaattcctagttagaatttaatttaaatcaggggtgtagataacaactaacagttttatatattatactgaagggatgtgtgcattgtggctaagcacaaaagggattcaaaaatcaaaataatattttgggcattttggcagagcctttggggagattctgacagaaggtgccctggggtccttctaaaatcaggacaaaaaaacaccacttactttgctgatatctatgtctaaggttcgtgtattgagtggtccttctcagtgcacaaagggaaggaaggggtgtgtctggactaggcacacttgggtctccctctttacatgagttgcaactctgatacacacacacacatacacacaaaattttatatatatataatttttattatttcaatagttttgggagtacaggtggtttggggttacatgaataagttttttagtggtggtttctgagattttggtgcacctgtcccctgagaagtatacacagtacccaatatgtagtcttctatccctcacccccttccatcctttcccccaagtcccaaaaggccattatatcattctcatgcctttgtatcctcatagcttagctcccacttataagtgaggacataggatattttgttttccattcctaaattacttcacttagaataatggcctccagcttcatccaagttgtagcaaaagacattatttcattcatttttatggctgagtagcattccatggtgtatatatatcatattttctttatccacttgttgattgatgggcactgaggttggttccatattttttccaattgtgaattgtgttgctataaacatggttgtgcgtctatctttttcatataatgatttcttttcctttgagaggatacccagtagtgggattgctgtatctatttttatcaatcctgataggtttcaaagtatattctttatctgaatggcaacaggatatgttggaaaaaccatggtctttggaaccagataggcatggaacaaattgttgaacctgtctaagcttcattttactcagttataatatgtgaatacgagttcatggagtcaaaaaccttctgagcaccatacagaacactaagtgaatacactttctcttttacatatgccacaccttgaaaacataaacaattgtcaatttcatctttagtgaaagaaacaggttctgagaggtctttgatttatccaaagttgaaatagtagttaggacttctaactgtaaaggccttgactctaaagtctgtatttttgagcatgatgttgtattgtctaattgtttcaaactcaatatggctctaataagatagaaatattgtatgtaaagcactttctatggttcctagctcccctacgtaccaaagtggtatgaagctattattatttgtcacttattttttttaggatttttctgtgtgtttaatagctagtcatttagaggggaagtaaaattactctctggggcaaggaattggcattaagtttttgttttcttttcttttctccatatttatatctgtggcaatgctgggaactaacaaggctagagagaagagaagaaatgtcttcccttttatatgttcccctttaaattagctaagctgcataatttaaatagacatttaacacctgttcctccctgaatatttacatgaaaatcctgggccttaaatgcttctgagccttgatagaccttaaacttgtcattaatttaacaagtatgtattgattcttatttcgcatagtttgctgctttgtcttagtacataccaaagtgttgatgaaatcctaatgagccacgttccccatgatagaagcagtaatgcagaagtgtgctttttacccaattgccttgccatcaacacagtcgtcctgattgattttgatggcaggcaattgaccacttttcccacaaagatgtattgggcatcccctgagtgctggccagggggctgagggctagggatataattttttaaaagataaacattttcccgcttccatggagttaataatctagtggagaagataaacaagaaacaagtaggtatccattttgttaagaactatgaagaagacaaagtgtgacgtaaggagaaactaatccattgttcttatgaaaggtatctctgagacccacagaagctagccatggcaagagtaatgaggataatttcaggccaaaggaatgtgaatgcaaagattctaaagcaaagcacttgctgtctatgctcaaagagtaggaaaaaaagctgatgctattagatgagtagtaacacaatggaagagctgtacaagttaagcaaggccatgttggttatgttggagggctggggttttgccctaagtcagctaaaaagtctgaggaattttaagctggcagaggatgaatatagatcttacaaagttgattgtggctgatgtgtaaaacaaatgtaccttagagtagcaagagtaggaacaaagagatcagggagggagctcctcggtggttcaggtgagagataatggtaattcccaatgggatggtggcagaaaaggtggagagttgagaaatattttagaggtacagttgacaggagctgctgacagaaccactgggaacaaggaaaccaagggaagaataaaggatgattctttttggaattatttttaaacaaatgtgtgttagtcttgcctaggtcataaactaagtttttaacatggatggatggtgatgaaggggcgcatcataagaagaaaagggaaaggagacctaacatttatggagaccttaaagtgtgtcaggaattgtgctaactttgcatgtgctatttaatcttccactttatagaaaccctataaagtaaaaatcatgacttgcacattttatgtatgctgcaatgaatctttagagatgctaaataactcaacaaaggtcgtagcattggcaaatacaggaaccagacattgagactgatctccaaagtctctttttcttccccacaacattatactatttcccagggctaaaataatgccatacaacttggcattttattccttgaaaagtgactagcattgtgctaggcatctgttgaatgttcattatatactggttaaatttaaaatcactgcaaacatttgactttcttgaaatgccaaatgtttttaaggctagtgaacctaaaaaaataaagtgtgtttcaagatgaattgatcaaaacagtagacaggcaaagttaggggaaaaaggaagataagttattgaaacagtggagaggggtttagaaagagtaagacaacaggtgcaattgggaagatggatctgtgggtttttgtggaggaagaatagagtattaactttaaaaaaaattatttggacaaagcacactattttccagatttataaaaccccaccactctttttggtcttaatccaaccacttccgctatttatgataactgttgtgcccttcaaggtagtttagtttgcattggatatattaaacatagtcacctttgaattctacatctaaatgcaagaatttatcagaatgatttatctacattgtatgagtgcaatctgacattctggagccagaagtgcaaccagctttctggaaaaaaataagttaagccctctttcatatactgctaggcaatatgcattatacatattcatgtaatgctcctagtaactcagtgaagtaggtactactattattcctatattataggtaagaaaacaggaaagtgaacctcagagacatggagtaatttgtcttaaggcttatgagctgcacgaccagcattcctacttatgcagtgtgacttcagagaaagactcaatctctattctttgctgcctccccttagcaataaccacatccttaggttctgctgtgctgccttgcaacacgctggctcagaataaagaattgtctagagtatcacagcaaatcaggggtaactgcagagcaattccaaatcagaagagccaggcaccccttcatagtcttttgagatcagaacctgcagactatgtaatctatgtatgtgaattcaggtaaacagaggcaggcatctaagatataacaaaaacacagaaatctgcatgagggcaagatcaggtctagaaaccaaagaagatcatgattctaagaaacttctcaaggcagaagctgctttatgatctgtagatgtaatagcttggctggtttcatctaaaccagtgtttctcaacctcagcactttggacattttgggctgaaagtttctttattgcgggagctgtcctgtgcactgtaggatcagtggtttctactcagtatgtgccagtagtaccccccatatacactagtcatgacagttaaaataaagtctgcctgatatgcctccctcatttataaccactgatctagataaagaaagggttcaaggaatctgtttgttcatctaacaggtgcttgctaagtgctgctcagttttcagcatcatgtgacttcaggtccctttcctggtagtaaggcaggactctcgaagtataatactagtctggagacctcaggcagtatgttgctgttagggagggcatgtgctctgaacttgactgttgtgggtctaatctactttgagcatctttcccttgggcaagtcactaattctcattaagccacagcgtctgctctgcaaaagaggtagcaacaatgctggacacatgggtttgctgtgaggatttcatgggaaaacaaatgtaaggggctgggctaagtgccagacacaaagtgctcaggggatccttatgatgacgatatcttcacctcttcatccaaagggactgagaaatagcctttgatcctccaagactgcagtttcagaaaccacatttatggctctccttttaggataaaggttaaataagtggccagtgaagaggttattctcctgtgattgtagggaaactttttcataaactctggtagaccctatggaattagtccaaagactggactggctcagcttccactgcagttttgtgattaaaggatttaggagattaacagcatctcttcaggaagtagctcagagagctcagttgggtgtattccagtgaagaggcattctctgaattaaatctcttctctgaaaagcgagatatgtttatacacagaagtgaggatgaggaccacaatttcaagttaacaaggagtcggatacccagtgtgagcaatatcccttagtctaggtgatattagcaagcatatcaaagataggcaaaaaatgagttgcatcattattcttcctttccctagttgggaaaattttgaatagcatacgataaagagctagctaaatagcttgccttctaatgctcagttctgtgagtaatttcctatgggaactttggtggatcactcaacctacctggtaataaggttacctctcaattgaataagaggattatttgagaactgccagattgtgaaatttgaaaacggccaagtcagaaaatctgaaatgtgtaactttgccaaattatgtgagaattgccactcagccataagctccaactcctagcccactccaccaaatttgaaataaatacagtgttaatgtgttggcagcagcaaacagactagtggaacaaaagtagaagtcagggtggtattacctttggccaagaagtttgaaggaaggtagggtttttttagaaggccaattaaaaaaaaaaaaaactcacactagacaaggacaatatttttcccataaatatgggtatcgagttgtttcggcaagaggtaacagtgatgttgatgattttgcatcataagctttaacatacactcaaaggtatgtacacaaatagtagcaataatagtcattactattattatcattgaccatgttaacttgctcatatattgtcacccttatcttaacgagcacttggaactggatgttaataacatcatttatgaggaaaggaaacatcgtcttagcaagatgaattgacttgcctaaggttccatagctagtttgtggaggagtccaagcattcttctgactgggtgacctcttcaaatgttggctaatcctctgagttgggtgttttgtttcctttcagcatgtcagtttctttgactgttcagtgaagaggttgttccagacagttcttcaaatctcttcttgctttaatatatctttattcttctaggtagtgactttttttgtttgtttgtttgtgtttgtcccatgaaattagaaaccttgtaataagacttgtatgtgttttcacttaatatggaggggcagtagttataccaccccacaaccaaacttgtcaaaaagtacctttttttcaatacagtgaaaggaaagagaagtttatcaagagtagtggattggcatgaagtctggagcctcagatttctaatcccagcactgccactgtttccatggttgtgaacaagatgctaagcctcgtaagggctcagttttgtcatctagcacagcagaccctaacgtttttggcaccagggagcagttttgtggaagacaattttttcatggacgggagtcggggttgggggatgagggggtagttggggatggtttcagaatgaaacttttctacctcagaccatcaggcactagactctcataaggagcgcccgacctagatcccttgcatgcccagttcacagtagggttcctacccctatgagaagctaataccactgcagatctgacaggaggtagagctcaggcagtaatgctcactcgcctgccactcacctcctgctgtgcagcctggttccctgtacccgtcttcggcctgggggttgggaacccctgatctagcaaatgggaaccacgggtgcccagcttatcacatgcgatttggaaatggaagtatggatatgtctgcgggaagcccaatactggggacattcaaagaatgttgaggacacaaaataaatggagtagagaaggattccacagcaaaatctggctttagctccaagttttatgacaaattacccagtgtgtcaagtgggtgtcagtttcttcttttgaaaaacggcagcattagactggatcaggatttctaaaactatcaagaataaatgtccctcaaaaatgtctgagggacacacatttggaaaacacagcacactctatctcccccttggatgttaatatgactgtattctgagatgctctgcaataaaaaacacacctacttttatttaactcatttgccaaattaagttgaccatggaacactgtattctggaatatgtgttaatatcccatgagacacttttggaaaattcaggattagatggtatcattctctgaaaaattataaagagatattatctgttggatgttatatctacaaatgttgggggtcactttctttcttctactcttctgacttgtttctctatgtctctcatgaagttaaatttgccttcttagtgtgaggaccagcaggtatgtagatgtgtgcacattgtgtgtattttattagcaagtattttgaacaccaatgaactactaccatggtagattctatggaaaatggaagaacaatagagaatatacttatttaacctccattgtgtacccaagaaagaaattgtagtgctggataactttcagattattttatctcattgaattctgtgaccctcatgctatagaaggaaaaaaaaaatgagattacaatgggtcaagataattagagaaagctttatggaataaatgaaattttgtgtagaccttgaaaatgtgtgaaatatgatcttgtcaggtaggaattacatggattagaccagaatggagctaaaatttgaggcacaggaaaagttatatcttgacttgttacagtgaaccctggcagctatcataagtatttaagcaaagaaatagcatgggataagtaaaagttttggtggagagggagcttagaggtaaaatcaggaggaggtccttgatgtaatttcaggaaaggtaactagatatagtaaggcattgtcaggaagtaatacactggatttcaagtaagaaaaattgaactgttacaattcttttattgaaaataatttccatctgtacaaatatttcatgattaatctgtttacctattttgaagtagttgtatttgtttgtggcacctctttgcttcagatgcccatttacccactacagaggcaattgccagtgtcttgttcatccttccagaataagtttctcagcctcagaactatgataatacatttggggccagatttctcacttttgtggggactgtcctttgtattgtggggtgtttagcagcattcatagcctgttacccactagatttccatagcacccctgccccctctgttgtgacaaccaaaaatttctcctgaccttgccacatatccatcgggggacaaaatcaccctggttccctggttgagaataactattccagagatgttctgtaaagaggaatttgttgtaccaaaagatagaagaaatgataatatgacttttttttttttttcttttgagatggagtctcactctgtcacccaggctggagtgcagtggtgcgatccctgctcactgcgagctccgcctcccgggttcacgccattctcctgccttagcctctcaagtagctgggactacaggtgcccatcacaatgcccggctaattttttgtatttttggtagagacagggtttcaccatgttagccaggatggtctcaatctcctgacctggtgatccgcccacctcggcctcccaaagtgctgggattacaggcacgagccgataatatcatttttatataaataaaagattgggaaggctgaaagttggtctcgaggactgaggcttgtgtaactagaagacagctagaatctgtattagttactatatttttggctgcaggaatcaaatctgtggacttaaactggcttgaataagaaggaaatacattaggtcacttgacaggtgatcttgaggcaagtcaaactccaggtttcattgatttggtagcacacagggtcatcatggactcagatcctttctgggctttgggcctgtcacccatagcattgggctggttccctgcagtattataagatgctatcagcatcagctgtttctaactgcttctttatttatgtccaatagtaggcacatagcctgagtcactaaagagtgagaatgtttctctcccagaaaccaccaggaatcctctttttaggtgttaatggcccaaatggacttagcaatccaccccaccccaatacctgacaatttcactggcaagatgaatatgctcagctttggaggatagaagtcgaatgtccccttaccaactttggaaggagaagagttaattggaaaagtatgaaatatggtgagttcagtatggtacctcatgctttttgagctggttgccatttagatagattttgtttggatcagtaaaagtaccaaattgaatacaaattggttcatgcaaattgaaaacatccaaaaggaaaatttgctgagagacaagagcatatagggttaaagaccataatcttggaggaaattggatatagataattaagtcatagtttaagagctttggtcttgattctaaacacagctgactcagctacctgctgggcatgtgatcttcaccaagtcacttttcctttccgtgtattttttttttatttgtcaaattcagaagataggactttccttataacagtgatatgggtggattaagtgaggcaatgtgtgcagagtgctgaatcaagtgacaggcactggagcacactaatgcacagtcactggtgatggtgagtgaggccattgcctttgagctgggaggaataataggagtccacaaaaggaaaaggagagctctggaagcacagggccggtctctgatcctgcgggaagagatgactgcacagagcatccttgagaacattaaataatgttctaaaataccctgtctccaggtaaacatcacagcactttcaaatttgattcagccttgagctccttaaggttctgtcaacctagaatacttgccagttcagacaacacactgcttagattatgtctcccctcccaccaccttattcccttccctacatcaaaatgcaagattcagttatgcagtctaaaaatgaaaaaaaaatccacctaaatctgagaattatattcaatattttaggactatttaacattctataaacatttaaatatgatattaccttgcccaaggtatgacatcatctttgatcacagattggtactgagggaaaacatctgttccatgggatttttccgtaaaataagatgtagagtatttctatcagcaaagcaggatgagctcacgttgtcagcctagatgtgaacatggtggtgttttatagccctggattgtataaatctgtttaaaatattattctactgttgaacatacttggctgcaaatatccatgtcttccatcaaacacacatttgtcaagcacctgctagatgcagggcatggacttagcttggcaccagtgcaaagtgaggatggagaactagaaggaattaatgttcattaggtgtgtactccagtaaatgggctagaaataaaacatgctgggtagaaatgtgtgttatttagtctaatgcatttcactaccttgttgcactaggccacattcatggcatttgctattaattgtggcattagtttttctttggttacatgatcctcagcattcaactgctgaatgtgtattagtagcttctcagactcttggcattctatgccattgcctaaactcacagagtcaataagcagtcgaactgaaattctactttatggctgtctaaccatggtacccaaaccctttctactaaataaatctgcttcaactatggatcaagaagtagtcactgccatcaggaaatttaccatttcatagaaaagtggaaactgaatgcaaataacccttatcaacataaaaataataactgagagtactgaactattatgtatggctttgcatacataaacccaccctgttttcatgtaaagtgccatgaggtttctaccattattataccagtttcacaaatggaaaaactgatgtgcagaaaactgacatgaaagctgacacacagagggggaaagaagtagatccaggatttaaaaccaggaaactcttttatagctcccaatcacactgctacctctgataaacatttcacaaggttacaagtgacacggaggttacaggaattgtagataagttgtatttcttatatgagtaaatggtcagggcattggggtaggaaatgagatttggtctgatccttaaggaacattggttgtgcagaagtggaggaaatggacattctataagaagggctttcttttcatgagcagaaagggaagagatgctgctgtctagataagctaagtgcttcacgacacttctgcgataagctgtaggatggtcttgtgcccctgcttacccattctcactgcagacattgctgcctgtgtgagcctggggcctgctggtgcagccagtaagagctaactttatgaccattgatttacactcagatcccttggtccacagatacatcaccaagcactccagcttctgaagtcagcgaagggaggtttatgactcaattttattcgtttgcttctgcagacaagtggcttcagttgtggaggagttgtttgagataaaacatcattattagattcccgctctctgagcccactctctagtcccatagttacctttgagctaaggctcaaacaaaggacctggttgagaactgttcctctgtgcacaaaagaaagtcatttattagctactagaaatttaagaatttgggacataatgctttttaaaggagatagtgaagggcttaggaataagcatccttcatgaagacggcatgggaattgtcactttgtttttctgccttcgtaggtcatcttgttggctttcatttttcaagacagacatcttatttagtgtacatgtttctttaccacttggctgtctcagtcttccaatattcctacatatactcattcctcatactcaacaggatcctcccctgtatcttttctgaccttgttgccacactcgccctgtcagctctttagcccttgcccctctaacacagtcatctcttacctcaagacctttgcacttcttgttcttgctacctgtggtattttagttgagatatccacctgtctcatccttcactttatccagatctctgccaaaattaccacaatttcagaacatcttttctatgaaaactatgccattcccaacaaatgccattttatttttttcctaggacttattcccactgaacatattatttgcctttttagcttttgtctatctcatcacaacccttccctacacactcaaatatgcacactctttctcccagaatcttctcctatgatcatccatattctcactctcacaatcacgatccagtacattattccttgcctctctccttggatgtgtgtgttcacgggaacagggcagggttttgcgggggcaggggagtgtatctttaatgcctagaacagtacttggcacatggtgaaaattcgacagtcactgaatgaaagaacaaaagaaagaaaaaaaggaagtgggggaggaaaggaaaagggagggataaaggcaaaggaagaaagaaaccatgcatgatcttggtttttttcacatatgttagctaaacctggttaaggtgacttccggttctaagagctacctcccatggtctagcgatcctgctgtcaatacttgctgatatattccatgccatccctgacacagaagttactatttcctgacattcccatgctgtgcattctctcattttgcttttactgtgacttctaccagttttctcctgttcttctaaggtcttacaaaaaggtcatctcctccagaaagccttttctaaccgacctgaaaaaatggggttcttgtttattttcctattcatttgacttgatcactcataccaaggcatttgatttggcttgtttaaccttaaggaagggtagcatctgttatgtactgcccaggcctttgtccatagcatggacatctgtaagcaggtcttcccctctaaggatttgctattcaaatttggagcatcagcgagaactcccatccccactgctcatgccacagacacacagcacatgtttctctctagcactgtatttccctctttatttcccctgataacatcaaggtgagagcctataaggcaaatgtgtaagtgggtttcttcttggtgaccaattcagataaattggtcctatttgcctgtagtgctgtgttgagaagatgtgaaacggagtctgaacacagtgagaaagtgagcagttaccagttggcagtgcctgacctaggtacaacagtggggatgtggagataccatggttcatgtttgccatcccttccctagtgggatctaacattctgtatgtttgtttgtaaataagtcacagcaatcatgcttatattactcatttatcttttattagaggcgagtccaaacagaagacttttctttgcctaccaccttgtacaaacaagtaccaatggatgtggagcccctgtgaatggaggaacatcctaccaagaataagggtcagctcatttgaaaataagaacatcctcctgcagtcattgtaggataccacatctgttatttctccctgagatagcaataatattattaatgataataataccaataaaagtagtatagactgttatatagtagggcacagctgtcctctgtttgtcttcagcccaaaatatttttagatttgttttcagaataccttttcatccattgctttaaacccgtcccaaatctaacttcatctttagctccttccaccttaaagagtatggtcttagtccatttagtgttgctataaagaaatacctaaggctgggtaatttatgaagaaaaaaaggcttccttggctcatgattctgatggttggcaagttcaagattgagcatctgcctcaggtatgagcctcaggctgcttccaaaaggcgaagggcagccagcgtgtgtggagatcacatggtcagagatgaagcaagagaggtggagagattccaggctctttctaacaaccagcccttgtggaaaatagcagagtgagaagtcactcacccccaatggagggcattcatctgttcatgagggatccaaccccatgacccaaacacctcccagtaggccccacctccatcagtagggatcacatttcaacacgaggtttagagggaacaaacattcaaaccatagcaggtactaagtttttcaaaagtgtttcttctttaagatgctctcaaatcacttgttcccacacttggaataagtttccctgatttgatgtatttgagcacctgcccagacccatcctatacctacctgttaattcttttttttaattgagctataattcatataacataaaattcacctttgagaataatacacttcagtggtttttcatatattttctattttttacaatcatcaccactgcctaattccagaatattttcatcatcccataaagaaaccccatactcatcagcagtcagtctccatcctccccttcttacaacccctggcaaccctaatctgctgtctatctctatgggtctagtctggatatttcatacaaatggaattacatagtacatgaccttctgcatgtgacttctttcccttagcataaggtcttcaaggttcattcatattggggcctatatctgtacttcattgctttttatggctgaattactattacgtttgggtacaccacatcttgtctatccattcatcagttgatggacatttgagttgttcctgctttttgactattatgagcaatgctacaatgaagatttgtgtacacatttttgtgtaaatatatgttttcaattatcttggttatatacagtcgtcccccttaatccgtggttgtactttccataatttcagttactcatggtcagcagaggtctgaaaacaagtgagtgcagtgcaataagacattttgagaccaggtgcagtggctcatgcctgtaatcccagcactttgggaagccaaggcagtcagatcacttgaggccaggagtttgagaccagcctggccaacatgatgaaaccccatctctactaaaaacacaaaaattagccaggcatgtggcgcacgcctgtaatctcagctacttgggaggctgagacacaagaattgcttgaaatcaggaggcgaaggttgtaatgagctgagatcacgccactgcactccagccttggcaacagagcgagagtctgtctcaaaaaaaaaaaaaaagaattttgaaagaggggtaccatgtatacataatttttattatgatatatttttataatctattttgtcattattgctgttcatgtgttactatgcctaatttataaatttagctttattgtaggtatgcaggtataggaaaaactgtttgtgtatatatgtgtgtgtgttatataaacatatgtatctatgtttaaccaaaaaaaagtatgcatatgtgtatatatatatgcatataacatatatgtatataaacatgtgcatataatatatattatatatatatattatatatctaaatgattcagtactatgggtggtttcaagcatccattgtggatctttgaatgtattccctgaagataagggaggaccactgtacctaggaatgcaattgctgggtcatgtggaaattctgtgtttaacttactgagggaagcaatccaagtgttttccacagtagctgcacccttttacattcctttcaacaatatgtgaggtttccagtttctccatgtcctcaccaacacttgttttctgtttccattacagccgtcacagtagtgtgaaatgatatctcattgtggttttcatatgcatttccctaatcactaatgatgttacacatcctttcatggacttattggccatttgtatatcttctttgaagaaatgttgattcagatcttttgtccacttattaattggttgtcattttattgttcagttgtgataagtttgtatatattttggacactagatctttaagatatacatagtttgcagagtttatttccaagaaagtttttactttcttgacagtgtcttttgccctgaagtgtttttatttttgatgaagtccaatttatctactttttctttgaatgattgtgtttttggtgtcgtatctaagaacctgttgcctaatccaatggcaagcacatttacatctatgcttccttacaaagattttacagttttagttcttatgtttaaatcttcaatccattttgagttaatttttgtgtatgttgttaggtagagggccgtatttattcttttacatatagctattctgtcgtcccagcatcatttgttgaaaagactattatttctcccactgaatggtttggtacccttgttgcaaatcgactgaccatagctgtatcaacttattgctgaatcctcaattttattctattgtctttattgctacctttatgttagtaacatagtgctttcattattatatctttgtagttaattttgaagccaggaagtgtaaggcctacaaatttgttcttttttttttttcaaggttgttttgactatttgggaatttttgcctttccatttgaatttttaagatcggctctccaggattgcatttaatctgtagatcagtgagagtatttccatcttcataatattgtccaccaatccatgaacacaagataccttcccatttatttagctctttaatttcttttagcagtgttttgtagttttcattgtacaagtcttttacttttttgttaaacatatttctaagtattttttggtgctatcatcagtgaaattgtttttcacaatgttttagggcttacataattttccttccaaagattcatctttctgtctaaagaatcccatttttcaacttggtcatctcatatcacatgtttatttaattgtcttaacagtgacttgaacacctaatatctaagaaaatactttctgatacagataagaaaaaaaaaaaaaaacccaggtattagagatacgctcagagtcagtctttatgaactcattttccttcctccaaataagccaagccaagtcacatcttactgtgttccctattagagcagagaaaccattaggaagattaaattgcccgtgattatttgttgcctaaagcctctatatcatttttgtcaccctgtgtcttttctgaagggtctttttctagaaatcttttttgcaatttcccagactcctgctgtcccaatgtccaaattgggtctgtcctttcttgctactcttctattattttccagagttttcctccctccactctatcctttgtttacaacagatctctaatgcatgtctaaaaatcaagagatcatttgtgtttagcaatggcttaaaataactaatgctaatgctgaggtcctcatgggtttaacttggttttattaatttctacatctctacagctcctctgtttgctggagtgtgtgctaaatatatatttgtgaaatagacaagaaaagaaaagaaccatttctgtagacttttaccagtttaaagcaaggagcaatgtagagtcaagtcatgtgcattttactctcagattgcctgagaaacaacttaggcttttcttaaacattttctttattgatggacaactatgtaaatcagcaaataatgagagaattttcatagtctcagaaaaaatagctgcttctttgtaactgtggttgcagcttatgctccagagagtgacatttacaaataaagagtcatatgttttaccacatgataatttctactgtttgaaagcaaatttcacatgttctagagttaaaaggtcagtgtgagctataagtgtaccttgctgtctgttcttaatatcttgtgctttctctagttttagtaatttcctggcttttgaggactagtgactttgatttccctttttcctaagaagtattcctcatttgagaaaatcaagcatggctgtgaattttccatctgcagaatatttctatctttcaaatattttcccaggaagccaccagtcagttgatcattttcagcctgcaaccggcatagttacatctgcagctgaagatgttgaagactccatagcaacaccatctgtcccttcacagaatgttttctttcagataaagatgggaggtgttaatcataattaggcaagttgcatgctgggatcagaaaatgatttgatttcccaggatttgtacaacaacaagtattgctggccatgtggttattcatgaatttgggggaagccaaaattaacagtactattatggaatatcatttttcatactagaataggagtcagcaaactacaggctgtggaccaaattcagcctgtgacctgttaatataagtaaagttttattgtaaaataaccatacccattcatttatgtattgtctgtgattgcttttaaaatatagcagaattgaatagaattgcctacacctatactggaagattattagaagaagatttactttcactaaatctgtatgacctttcagagaggcacatgtccatttgagatttgaaactgttaacttaaaacagagtagccctgcctccagaaagtcttccgtgatatatcccctctgcctcctcatcaagctgtacatagtattttcctgtcctcctcttatattgtgggcaggcctcaattactgcatgtatcttatataactttaataacttaatatctaaaattacctctgtgccttttattttctctaaacctgtgaaaattctcacgttatatcctgatttggagagttgtccatcaaaaatggaaacattattcttgaggaaggactatgtcttttttgtattcccagtgcctaatattaatacctgggatggaaaaatgggttcaaaaatgttgaatgagtgaattaatagactgagtgtgttattagtaaatacaaatatatatatatatatatatatatatatatatatattatttaactctcttttaaaggcagtttgagatattaattaagtgtggtctctagactccagggacttacaatgaaagcccattccaccacttactagctctgagtctttggccaagttacttaccctctcccatgtcagcttccttacctggaaatagcaatattgcctccttcctccattggtggagaagacaaaattatataatccatgcaaagtgataatatggcaccaggcacacactaggtatccaacattttatggccattactggtgatgatcatttattttaaacaaaattcaactccttgtcatgttgctgttagttttgccacactcctaaattactacttgcatgtgtacatgactatatccttcatgcagataaccaatttttaaattctgttctgtgtcagacactgactataccactcaccgggggtagaaagatggatcagatgttattatgatccttaagtaattcataatctagtacactgagcctaaatctgccacttaggaaagtatgtgaagctgagtcacaaaagggaacagagattgatcataactgagaattactgacctttaatttttataatgagagaggaaagccctaagtgaataagatgatactgtgtgtaaggaattttagacatcagccaaggagtgttgtggggagagaatcatccagatccccaacgaatgtgaaaacactgtttctgtctgtacttgcagatggttctgagtaaaaagacgatcaggtgttctgacctgagaaaagttctatactcattgatcttcagtaacatgtgattaacaggacattagaaggcaaaagccagcattttggtgaatggattgccaaagccattcactttgcgaagaataggactaagagctcctgttcagcatctgagagatgtgagttgaacgccagctctactactcactggctaaatgaccttatacagatccctttctttctaagatttctcatctgtacaatgaaaatggtcattgtatcaactttatcaggtggttgatatgggtttcagcccacagccttaggaacacaggcccaacttcaaaagtgcccctggctctctcagactgggaggttttccatcatgaagacatccaacttggaatacccgcatctgtcatcccctccttctctaggcttagtctctgcctggctgcttcttcagactgtgaccacaccagtgtaagaaaggtatcagtaggtcagacaacaatgccttattggtaccatgaaacttgcgaagtagaacttgggtttagaacatcaaaacaaaaaacgtacactgtctagatagatgttcagggtacttctgcatgaaaaatctatggtgacccaggtaaagtatttccacaagaggcagactagaataattaaaaacacaaactagagaacaggaagtttcaaattttctactttctaatagtgagactgggcaagttaccaacttctcctcagcttcctcatctgtaaaatgggagtaatgaagcctgactctctaaggataccttgagaattaaagggtgtagcatagtcctcagtaacagtggttgttaggcaagatactgaatttctaaacttctataggagacaggcttactagtcactaatctttagtctgttagaaaactgtgcctgcgtaaaggaatttaccttcccacagacttttcaagagaattttgagcttcagattctgagggtactgagaacactgcatttattctaaagcagtgtcagtttctgtctaatgatatttatcaactctaagaagtaaagttatgggtctctttatatttttccctccaatggaagagaaaaaaggacaatgtctgaagtttccataaaaagctaccaatggtaatggaggtcagaggttagaaatgtaagtatgcattgccatggtgatggagttagcattgttatgagcttgttttatttatggttagctatttctgtcagttttgtttcatcacctttgttttttctcaaattacaaaacaattaaagaatttggcaaggaaaatgagccagatgtaacagtttcctcttacatctcttaatagaagcaaacatgctgtaatgagatttctttttccttccatcagaattgcaccctcccgcaagttctcagctgcagagcagtaacaaagccccttgaaagcagaaaagcccttactttcgatggcatgtaattaaatttaagtaatgttacatcagctggttgaagagggaaatctggaaagaaaatcttctaatttctgaaatttactccaagcaacacccagaaattcggctaagtgttgacatgaggtttccatatgatgatggcattaatgcacctgtaggctatgtttatgtggcaatgaaggaggctcaagaaattcataaaactggaagctatgtaatagaaaacagtttaaaattcagattcagatggaatttacaacccgttagtaaggtaatattggataattgttagtgtttaggatgagacttcttatttttccctcaccctctatgttctaggcaaatgaaatttactgaagataattttaataagaaacactatagtgtggtaaaatggttacgaacagtggctttagagttagacaaacttctgtccattcaaatctgtgtcctgcctgtgttttttttggatcaaattaggtaagtcagtttatatatttgatcttcagttttctcacccaaaagacagatgtgggatgattaagtcagtaactattgacgacattattaggttgaaatggtccaatgaatgtaaagctcttaccttggcatatataatatactcaataattgctactattgtaattatttattaggcattgacattcagtaacctcatcaattagaattcattccaaggggaaaaaaatgcacagatacaatcagtcttaatgaaggatatgattgaattcaaaaatatggagagacgtacctttctataattcccacctccacacagagcatatcactcttccattaacaggatttgattcttctacattacagggctttggaagtcatttcctaaccctagccctcaggtttccctatctgtaatttatgcagtcagagtagatgccctctgaggacccttccaggtctggctttctgtcctcccagcagattctctgagcagattccaagccatttttgaagccatgactagaaataatcatcattgcctgaataaattaaaaataacgagtggctcttcatttgaaagaattaaccagtgaaaccatagcaaaagactggctgaaatgtatgcaactttgtgttagccctataagcaacgcagtgaaactcatagagaggtttctctgatgattcaggctctgattatctgtttttgattagtttgaaacatagatcagaactgttcctgttagggtggcggccagtgtcacctgcttttctgaaggtagaaataatcaacctaatggtgttgaatagacttaagtggtttttcagtgtctgagtgggttactcaggtcactccttccagtaagagtataatctgcaaatggaccaatttttgttctatatcacatagttaggttttttttattctttttcatgttttaatgtggtcttatggaaagaaggctaaatttagaatcagtaatttgggtttaaatcccaactctcacattcatgatcttggataaattactttactatttcattaagtttaagctgctttgtctttcaaataaaggtagtcttccttatattaaaggatcaccgtgaagattaaataagagaactcatgcagagccctcaggcacatgtattgtacaaggaggacactgaataaataaacaaatgactcttcatatattcttttattaaacaaatatttactgaacacttataatgtaccaggtactgttttagctacttgggagacattaaagacaaaaatagaccaagattctgtacctatggagcttaatttctagtgaggaaaatgggcaataaacaataaccatagcaaagtaagtaaattatgtaatatgcaaagatagttactgtgtgtgggaagaaagaaaagtgtagcatattatacaggatatgaagggcccgggtgagtttggggaaggttatagaatggagagtggtcataatgggtctcttgagcagtggccatttaagcaagcacatgaaggtggtaaggagataacaaaatgagggtatttcctggaagacatatcctggccaaagtgaaaggcaagagcatcttgtcacattgaggcacagcctgaaggccaatgtgactgaagtggaatgacccaggggactgcagcaagagatagtcaggcaggtggcgtggacctcctagggtctcaaacgcaattgtgaaggtgttagttttcactctgaggaaaagggagacatcaaaaaattttgaggagaggaaacgcagtatttgacttatatatatatattttaaaatgaccattcaatttgctgttttagggcaacagtggggctgggagctgagagaggccattgcagaaatccaggtaacaggcgatggtggtctgagccatgaggtggtaaggagtaatcagatgctgaatacagtttaaaggtctttaacctttatgtagttaaatatatacatataataatttatattcttatacatattttatatacttaaatataacttaaattatatttaaagacctttaaattaccttccattttttggattatagtaacaatatttacctaattaaattaagaaaccaattaacaagtatatagtgatgatagattgttattattattattattttgagacggagttttgctcttgttgcccaggttggagtgcaaaatcgcatgatctcagctcactgcatcctctgcctcccaggttcaagcgattctcctccctcagcctccccattagctgggattacaggcatgcccacaacctcacctggcaaatttttgtatttttagtagagatggggtttcaccatgttggccaggctggtcttgatttactgacctcaggtgatccacccacctcggcctcccaaagtgctgggattacaggcgtgagacaccatgcccagctgacagaccattattaacactcttaagtaggcactgtgctaagtacccatcaccctcatgagataggtataatcattaacactttttaaccgataattagtctgagacacagagagaccaagggaaataaccaaggtcccatggtatctcagtggtagagctgggagtcagatcctatgggtctgacgctggagcttttctgcgagaaggcagtcttctacaatgtgaatagccatgtaaggccacactctgcctttccctctttttcccccaaagatagttcttactgtacaccctcaagttcttcagactaaattacagagagatttgccatacttagtctctttcctacctggaatcattatcaaagaatgaagcagctacatgcattgcttaacggaagctgtttcccctttggggggatcagttggtcagttctgatccaaagaaagttcttccctactccctcaagtttttcaatctaaattacagagagatttgccttactcagtctctttcctacctggaatcattatcaaagaatgaagcagttacatacaatgcctaatgaaagctgtttccccttttggggggatcagttggtcagttctgatccaaagaaagttcttcccctactccctcaagttcttcagactaaattacagagagatttgccatacttaatctctttcctatctggaatcattatcaaaggatgaagcagtgatgcttaatggtagctgtttacccttttgggaaatcagtcggtcagttggttggtgaatttacttattggaaaaaaataaggaataaacaattgtatcaaaacactattgtttttagttctcccaagatcaccataaatttcttaaaaatttttaattgtgggccaggcgcagtggctcatgcctgtaatcccagcactttgggaggccgaggcaggctgatcacaaggtcaggagatcaagaccatcttggctaacatggtgaaacctcgtctctactaaaaatacaaaaaaattagccgggcttggtggcaggtgcctgtagtctcagctactcgggaggctgaggcaggagaatggcatgaacccgggaggcggagcttgcagtgagctgagatcatgccactgcactccagcctgggcgacagagcaagactccatctcaaaacaaaacaaaacaaaacaatttaatttacgttatgtaaattatacataatgtaaaactgaatcatcttaaccatttttaagtatgtagttgagtggcattaagtacgctcagtgttcaatgtcaccatcatctctccacagaactcttttcatcttgtgaaacaaactctgtgcccattaaaaaataactccccattccctatttcccccagcccctagcaacccccattctgctttctatttctatgaatgtgaccattttaggtgccttatgtaaatggaatcatgtagttttcatcatttttttggctggcctatttcagttaacataatgtcctcaaaggttcttccatgatgtagcatgtgtcataatttccttatttttttaagactgaataatattcctttgtacatatacaccacatgttgtttatccattcatctgttgataaaacagattttaacaatcttgtagcacattgacttaacagcttgaattttagaagtcacatcatcttagagattcaaagtcagaaagtctcttatttgctcctagcctgtaaacaaggatagatctgaaagatcagagacttagcaactgacttatttaaattaacaggacagtctcacagttcccaggacataaatttctattgacttttatttcataaaatcataaatgtggagcatttctccctgtacattatcatctcatgtataatgtttcatttgtcttaatcattttgtttgcacaatttgcttatttgggttgtatttaggttttatgaaatgttagtttccacagtaagtaatagatttcttgaaatattagccttagggaaatgtgatttgacagttcttcaaagaatgtgtaaaattaattataagtgaaagtcatttcaatttcagtaatatttttttaaaaacctgccagccctagattattctctttcaactcatatcatagacctgtccatcattatggtcctacacatgcctattgaccaaattacataaatcaaagtaattgttcactacaattaatcttttggggggatttattcatattttattttaaaataaaatttgcataaattcagtttttttattatactttaagttctgggatacatgtacagaacgtgcaggtttgttacaaaggtatatacgtgccatggtggtttgctgcacccatcagcccgtcatctacattaggtatttctcctaatgctatccctcccctagccccccacccaccgacaggaccccgtgtgtgatgttccccttcctgtgtccatgtgttctcatagttcaactcccacttatgagtgagaacatgcagtgtttggttttctgtttctgtgttagcttgctgagaatgatggtttccagcttcatcaatgtccctgcaaatgacatgacctcatccttttttatggctgccttgtattccatagtgtattatgtgccacattttctttatccagtctaccactgatgggcatttgagttagttccaagtctttgctattgtgaatactgctgcaataaacatacgtgtgcatgtgtcaaaaagtggccaaaggatatgaacagacacttcacaaaagaagacatttatgtggccaagaaacatgaaaaaaagctcagcatcactggtcattagagaaatgcaaatcaaaaccacaatgagataacatctcataccagttaaaatggcgatcattaaagcaggtgctggagaggatgtggagaaataggaacatttttacactgttggtgagagtgtaaataaattcaattttttaaaaaaacatgtctaccaaaataaagatattgccggcatttatttaacttctgaaagttactcatgtggcttattttacctgttttagatggcatgctattttaatattgcaataagatcacaccagttttaaaggccccagcatgtcatcaaatccctgggttagaagaaacattaaaacttaaccccatgctaacttgagctgaatctacttagcagtctgtggtcttccatcctttacttgaatgccctgtcacctgctttcccaaaagttagtcatctttgtacccctggcatgatttaaggtataactgtgtcccttccttaataatatttatttaatatgttcctgttaataaacccctgtttttctttgataatctaaaagagaaatataacactattctaagtgaaaaaatcaacatgactttccatgaatacatgacagatataaaaataaataatgatatattaaaattaagactgtttctccctttgataaaaatgtaaatgtgaaggtgttacagagatattaatgtcatcatagacctaaaatgagacattatctttaatataatcaaaaatattaaaaaggaaattgaaaggaaaatgaccttctcgtacataatgccaagcattatgatacctgaaaccatcttacatactagtgagttctaatctttggggaacatagcttcttcttctcattgcatcctttgaacagcttagctgttagaaagtcctcttctcattaagttgacatctgtctatatccattaagtatccacaaatgatcctatacttcagagccattcagagcaagtttgatctcttgaacaagatccatgacagttttttggatactttgaaatattttctcttggttaaactccctcagttcttcccatttttcctcatatgaaataattctttagtagtactcacctactttctgcttttcaatatatttactacctttctcagttagtattctccagagaaagagaaccaatagagtgtggagggggtgaatggatggatggatggatggatgaattaatgggggaaggagagagggagggagtgaggcagggagggagggagggatggatagataaatagatagatagatagatagatagatagatagatagatagatagatagatagatggtagctcatgtgattatggaggctggcaagttcaagatatgcagggtgagccagcaggctggaggccttaggaagagccattgtccagttcatgtctaaaggccatctgctgaggagtttccttttgcccagggaaggtcagccttcgtcctgtttaggccttcaactgaatctatgaggcctacccatattatggagagcaatctgctttacccagagtccactactttagatgtaaatctcacccaaaaatatgctcataattgacaacgtgagctcagaatagttaagtgatttgtctaatgcatactttgcagcttcttagaatgtagtagactcctgcatattaaaaatataataatctccaaaaaagttgaacaaagcaacccaaagattgtggtcagtccgtgatggatgcgggatgatgacagtgatatgatctttattattggccatgtcaacaacagtggctaacatgatattgagagtgtgctttctgctaggcacagttctcattgcttttctgatattatgtcatcctcatattaccctgtaagttaggttctacttttatttattttgaatggatccagaacctgaatgatagaagaattaagtaacttgtccaggtttatatggagcttctaagaggtagggataagactcaaactcaggggctgggtgtggtggctcactcctataatcccagcactttaggaggctgaggcaggcagatcacttaaggtcaggatcacagcctggccaacatggtgaaacctcttctctactaaaaatacagaaattagccgggcatggtgatgtgcacctgtagtctcagctactcaggaggctgaggcaggagaatcgcttgaacccgggaggcagaggtagtgagccaatatcgtgccactgcactccagcctgggcaacaaagcaagactccatctcaaataaataaataaataaagactcaggtagctgtaaccactaaatggtcctaatccctactcttccccccattgaaagcactggctgcagaatgtaaccgacggccataaagtctggaaatgtaggtgcctagttgacttattggatcatattaggtggctaattgatgtcctagtgactggctagcaagtcactcagagtggctacaacagaatggcatactgtccacacactgttgattgataatttctaaagcctgaattgggccatgtgcacttgtacagtgggctaacatgtgtgccagatccaaactcttctgacatgctaaaagtgcagatttgcttagtgaatgtcagaggcaagaatcacctgggacagtgcatcatagatataagttcaaggataagggaaatgcattaatgaaccacatttgtttcagtttctcacagttcattgaactacgcattgctaatgaggaacaacagagtgaacatattatgtaatatcactgatcatatcacgtactgtaatagaataccatgaaatcattattatgtatgtacaccaatattacagaattcatggccatacagtagtcaccatcttggttttcacctttttcaatatctttctttaaagtgtagggtctggatctgaacattgtattccagatgtgctcttactgtagtgggtaaagcaggaccatcctcccctcttctaggtaccacagtctaaaagctttctggcagtcagcgaactcagcgaactcatattggctttgatatttattcatgtgaaaaatatttttgtacccaccatgtacgagacacttgtatgcactggggatgcatgggtaaacaaaagaaagtccctgcctcattgatcttttattatactaggaggagacagacaaaaaaaaatagacaatcagccgggcatggtagcacacgcctgtaatcccagcactttgggaggccgaggcaggcggatcacctgaggtgaggagttcaagaccagcctggccaacatggtgaaaccctgtctctactaaaaatacaaaaattagccaggcatggtggcatgcacctgtattcccaactactcaggagactgaggcaggagaatcgcttgaacttcggaggcagaggttgcagtgagccaagatcgccccactgcactccagcctgggcgacagagtgcatattgattttttgagaccctgtctcaaaaaaaaaaaaaatagacaatcagacttataataaaattctaagccatgctaagtgaaatgtggaaagagagagcaagagtaagaggatggagagtaaagaggctactgtgttaggcaaggaggtcaaggcaaccaggtggatatggaggacagagggaggcacttccaggcacagagaaaaagaagtacaaattcctgtaggcaggaaggtatgtggattgtttgaagaacagaaagaggccaatcctgctggagtagtaataatatggagaaacccagtaagaaagaaaaatattgaggaggtagtagcagaccggatcatgtaggatcttgtagttaggagtttgaatttaagcctagctgtgacaaaaagccattgaaggatttttttcccccatgagagtgacataatctgtgttgaatttgaaaaggattacctgactgctctgaggataatagaatttaggagggcaagagtagaagcaggaaaatcaatatggactaaaacagctatgtttacatttccaagatatgttcatttttaattatctttttaatttgatttataatttaatggcactaaagtcagaaaatgtattctgtgtggcactgttgtttggcatttctttgtgaactaggacattatttttgcaaatggtttagtataattgaaaataacgtagattctcaatttcttgggtgcagagctctacacatccattagttcaaactagttaaatatgagcattcagggtgtccacattcttgctattatttggtcagcagaatctatcattttctaatagatttttgttaaaatttaatgctagcatttgctaaatttccttcatacttctgacaacttttaattaatgtgttttaagctacattgatagatacatacctagtcatgatttatagcttccagtcatattttgttgtttttatatgcagtctctgtggagtacatgaatgctttttgccttaaatactgttttgtctaatactaattttgatacccagctttctttttaacttttaagttcaggggtacatgcacagcatgtgcagatttgttacataggtaaatgtatgtcatgagggtttattgtacaggttatttcatcacccaggtattaaacctattaatagtatccatgagttatctttcctgatcctttccttcctcccaccctccaccctctgataggccccagtgggtggtgttccccagctttctcttagtaagactttgcctagggtgtcttttgccatatctttatttctagcctttctatattgttttgctttaaatatctcttttataagtagtatttacttgcaattttgtacatgttatggatattttctattcctactatcttggtttgtatttcttctctaccattctctttcttttcatcttttttgttttttgtttcattttgtttttgttgagacagagccttgctctgtcgcccagcctggagtgcagtggctcaatctcagctcactgccactctgcctccagggttcaagtgattctcctgccacagcctcctgagtagctgggattacaggtgtgtgctatcgcacccagctaattattgtatttttagtagagatggggtttcatgatgttggccaggctggtctttaactcctgacctcaagtgatccgcctgcctgggcctcccaaagtgctgggatgacaggatgtgagccactgtgcctggcccttcttttctcctttttaaacatattttttttggtctttctttctggcagtttcttttttattccctctctttatgttctactggcttattaagtatttatattctctctcttagatatgatatagggatcagtctgctttaactgtccagtaacctctatagcaccctttcctctctctccccctgaatgtataaaccttgcagcagtgagcttcactgctgtctcatctctttgagaactcttaaggtcccctctaattcacttgagctaagcacacaatcacagtctccgtggcctgcttctagatccttatgccagcaagcctttggctacagccttcatggtagttagtatttctgcttctggtccacaaagatgataatcccccaaaactgttttactgtggtaaaatacacatgatataaaatttaccatgttaactgaagtgtataattcagtggcatcgagtacatttataatgttgcacaaccatcaccatcatctagttccatgatgctttttattaccccaaacagaaacgccatatccattcagcaatcacttttatctctttctccagctcctggcaactgctaatctactttcttgtggaattgcctactctggatatttcagataaatagtatcatatagtatgtggcttttgtgtatagttcctttgacttagtgtaatgtttgcaaggttcatccatgctgtagcatgtatcatacctcatttttgcaggggaataatattccacagtatggatatatcacattttgcttattcattaatctattattgggcatttgtattgtttccgccctttgattattatgaatagtgctactatgagcatttgtgtacaagtttttgtttgaatatctgtttccaattctttctggtatatacttaggagtagagttgctgagtaatatgggaattccacgcttaacttattgaggaactgacaagctgtttttcatagcagtcgcacccttttacattcccaccagcagtgtatgagggttccagtttctctacattcttgccaatatatgttattttctgttttttttctattataattattctagtgggtgtgaagaattacccaatttttagcctcattttaacttaccgggtttccatttgttgttgttgttgttagcctaacattgctgtgggcttggagcaaaagagtcaatcaaaacatgacctgatctctccaacctgaagtcttttatcaattctggccatatttcttaagtagacaattgaatgaagcacccataagccaaagtatctgatcatatagccattacttttcaaagagtgtgaaaggagatattctctttgtgggacagatagacacatactaattgaagcaatcaaaggttgcttcaaaaaatttcctcttttgacatcacccctttccaaccaaactaatataatgtagacattagctagttaagtgaggagagtggagaatatatgtgcttttcctgtgagaattgaccttcctcaaaggattagtgacgactacaaaatcactcctcttgtctctcttttgacctgtccacaaaattagaaattttgaccagccaagaaagaaatttagggtacacaaaaataattaagaaatgtacatattacctgtatttttcaatgcttcttcaataatggtcatgtttttatgaatatttttgtattttatattaatgatatttatgattatgaacatattgtttattcatgactttttatgatcataaaaacaatacatggtcatttcttttcccaataaaaaaattggaagcacatactgtacttcttaagagctttacagactcagcagtcttagagtatgaaggtctcagccttggatttggataatgagcctgggatccaggtcaggttctgcatgacctgaagattactgcttaacttttctgtaaatctgagaatcacgtggacacaaagttgcaactactttgcctccggtcatgaaatattttgtttgaataccctcatttttgcctgcccttcatgactgccccacccaggtgaacctgatttaggaccccacatggacttagtgtttcatgtcctaactttaatcagcagttacttagcctttctccattctccccaagcctagttctctatggcagctggtgaaattcatccctcctctcagactggaaggctcacaggtaaagaacagcattgactatggaaccgtcagacacctttttggtcaaggtgccttcttatgcatcctgaatcataccagagagtcagctagatacacattctatgaagggatctcttcttgttattttttattaatttttttagagatggggggtctcactctatcacccagtctggagtacagtggcctgaccatagctcactgtaacctcaaactcctggactcaagtgatcctctcaactctgcctccccagtagttaggactataagcacatgtcaccatgcccagctaattttttcttttttgtagagacaggatctcactatgttgcccgggctggtctcaaactcctagcctcaagtgatcctccctccttggcctcccagagcattgggattacagacatgagccactgcacccatccccatcctgttctttaatactaaatactgttagcacatattgagtcctcaccctttactcggcactatgctgcctgttttgcatatatcgtcttctcacagacacctatgaggcaatgctattctctcccccatactttataggtggggaaatggagatacagcaattaagttaaacacctgcttagctggtggatggtcaggttctagttccagcctgtctgcctaaagccatgctcttaatcactacatagaaagcagaaactgaccatatcctaacatcactgtcagtttgatggagctgacagagcttagcaaccatcagtgccaaattaaccccctatttaaaaatataagtccagaggtacaaacatgatgctaaattccttatacatgctatttaatcaatttagttctgtaagggaggtactgttactatctccattttgtacattattatccccattttctagctaaagaaactaaggctgtgtaatctagggttactggttcagaaatagcacagctaggatgttaattcagggctctgtgcctccaaagccctaattaaccacaacagcacaccacaaagaaaggctcgagtaaccccagggttagtagtctgggctttgggttttttttccctgtgttattctgattttttaagaggtcatacctccttcaaatcagtcagcattagactaggcatatttcctctacaacaaatcagattgtatctctcccatgacataagccagtctctatgtagttgtttttctctccgtgttagtaattcgaatctcaacttgcacttctccctgaaagactcacattgactttatccaaacttttcctgaaagaggggttttgactccccagaatgccatgcaccattctgtgaaaggtcaaaatccaaagcaacagggcctcactgatggagggaggaaaaatatgcaaagagaaccaaagaatgtgtgggggccagccacaaagcccagacttgtgctctcagatctgcgggagctcttggccactgcaaggccaagaacaccttgcatggaagagccctgtttgcaaatgtggccaaaagccagagaagtttagcccacggagtttctgcagcaaagagtggggtggaacagtcttgtctgtattgctatctgtgccatgaaattaaccttccatgtgaaaagcgtatcttaatcttggtatcagtcaagttttaatgctttaatattggaatgtgattgacttcatggggaagagacagctgcctccttgaactgcagggttctctctgcttactggctttctcagaaaccatggtcaagtctctctccctatctatgaagaattccctaactgtccaaccagtgctgaagtcttttcttcatcacaggtcttaaacttacagcttagactacacattccactgtagtagaacaagcggaaagtgctcaactctagagtgctagtcctatctttgcaatttaccagtatgcaagtctgggtaagttgtgctccacactcagcctcagtctccccatgtataaaatggcaattatacttactcaccaggactgtagacattaagccatccaacaagttctattgagagtccaccagatgtgaggatagctacgaagccctttcctggttttaaagagataaaccatagatagctaagtcataacttgtatatataaagcaatcattaaagtagcattccctaaaatgggtcccattaacatgtactttaagcaaaaaaaaatatgattaaataaattttggagcgattgggtacacaaaggtacacaagttatgttgacataggacttctcagagcaaataaaatactaacatggactgtgcaactagaaggtaggggagagtatattgaattgcctaaactattttactcataaaaatttgggagctcaaatttttttaatactttaagttctagggtacacgtgcacaacatgcaggtttgttacataggtatacctgtgccatgttggtgtgctgcacccattaacctgtcatttacattaggtatttctcttaatgctattcctccccctgccccccaccccacaatagaccccggggtgtgatgttcccctccctgtgtccaagtgttctccttgttcatttcccacctatgagtgagaacatgcggtgtttggttttctgtccttctgatagtttgctcagaatgatggtttccagctgcatccatgtccctgcaaaggacgtgaactcattctttttcatggctacatagtattccatggtgtatatgtgccacattttcttcatccagtctatcattgatggacatttgggttggttccaagtctttgctattgtgaatagtgccgcaataaacatacatgtgcgtgtgtctttatagtagcatgatttataatcctttcggtatatacccagtaataagatcactgagtcaaacggtatttctagttctagatccttgaggaattgccacactgtcttccacaatggttgaactagtttacactcccaccaacagtgtaaaagcgttcctatttctccacatcctctccagcacttgttgtttcccaattttataatgatcgccattctaactggtgtgagatggtatctcattgtgttttttatttgcatttctcttatgaccagtgatgataagcattttttcatgtgtctgttggctgcataaatgtcttcttttgaaaagtgtctgttcatatcctttgcccactttttgatggggtttttttttcttgtaaatgtaagttctttgtacattctggatattagccttttgttagatgggtagattgcaacaattttctcccattctgtaggttacctgttcactctgatggtactttctttcgctgtgcagaagctctttagtttaatttttttcccatttgtctattttggcttttgttgccattgcttttggtgttttagacatgaagtccttgcccatgcctatttcctgaatcgtattgcctaggttttcttctagggtttttatggttttaggtctaacatttaagtctttaatccatcttgaattaatttttctataaagtgtaaggaagggatccagtttcagctttctacatacggctagccagttttcccagcaccatttattaaatagggaatcctttccccatttcttgtttttgtcaggtttgtcaaagatcagatggttgtagatgtgtggtgtgatttctgagggctctgttctgttccattggtctatatctctgttttggtaccattaccatgctattttggttgctgtagccttgtggaatggtttgaagtcaggtaaagtgattcctccagctttgttctttttgcttaggattgtcttggcaatgagggctattttatttccatatgaactttaaagtagttttttccaattctgtgaagaaagtcattggtatcttgatgggaatggcattgaatctataaactaccttgggcagtatggccattttcacaatatttatccttcctatccatgagcgtggaatgttcttccatttgtttgcatcctcttttacttcgttgagcagtggtttgtagttctccttgaagaggtccttcacatcccttgtaaattggatttctaggtattttattccctttgtagcaattgtgaatgggagttcactcatgatttggctctgtgtttgtctattattggtgtataggaatgcttgtgatttttgctcattaattttgtatcctgagactttgctgaagttgcttatcagcttaaggagattttgggctgaggcaatggggttttctaaatatacaatcatgtcatctgcaaacagggacaagttgacttcctcttttcctaattgaataccctttatttctttctcttcctgattgccctggccagaacttgcaacactatgttgaataggagtggtgagagagggcatccctgttttgtgccagttttcaaaggatgcttccagtttttgcccatttagtatgatattggctgtaggtttgtcataaatagctcttattattttgagatatgtcccatcaatacctagtttattgagagtttttagcatgaagggctgttgaattttgtcaaaggcttttcctgcatctattgagataatcatgtggtttttgttgttggttctgtttatgtgatgggttacatttattgatttgcatatgttgaaccagccttgcatcccaggaatgaagccacttgatcatggtggataagcttttcgatgtgctgctggattcgatttgccagtattttattgaggatttttgcatcgatgttcatcagggatattggtctaaaattctcttttttttgtagtgtctctgccaggctttgatatcaggatgatgctggcctcatcaaatgagttagggaggattccctctttttctattgattggaatagtttcagaaggaatggtaccagctcctctttgtacctctggaagaattcagctgtgaatccatctggtcctggacttcttttggttggtaggctattaattattacctcaatttcagagcctgttattggtctattcagagattcaacttcttcctggcttagtcttgggaggttgtatgtgtctaggaatttatccacttcttctagattttctggtttatttgtgtagaagtgtttatagtattctctgatggtagtttgtatttctgtgggattggtggtgatatccccattatcatgttttattgcatctatttgagtcttctctcttttcttctgtattagtcttgctagtggtctatcaattttgttgatcttttcaaaaaaccagctcctggattcattgattcttttgaagggttttttgtgtctctatgtccttcagttctgctctgatcttagttatttcttgccttctgctaacttttgaatgtgtttgctcttctctagttcttttcattgtggtgttagggtgtcgattttagatctttcctgctttttcttgtgggcatttagtgctataaatttccctctacacattgctttaaatgtgtcccagagattctggtatgttgtgtctttgttctcattggtttcaaagaacatccttatttctgccttcatttcgtgatgtacccagtagtcattcaggagcaggttgttcagtttccatgtagttgagtggttttgagtgtgtttcttaatcctgagttctaatttgattgcactgtgatctgagagatagtttgttgtgatttctgctcttttacatttgctgaggaatgctttatttccaattatgtggtcaattttggaagaagtgtgatgtggtcctgagaagaatgtatattctgttgatttggggtggagagttctgcaggtctctttcaggtccacttggtgcagagctgagttcaagtcctggatatcattgttaaccttctgtctcgttgatctgtctaatattgacagtggggtgttaaagtatcccattattattgtgtgggagtctaattctctttgtaggtctctaaggacttgctttatgaatctgggtgctcctgtattgggtgcatatatatttaggatagttagctcctcttattgacttgatccctttaccattatgtaatgaccttctttgtctcttttattctttgttggtttaaagtctgttttatcagagactaggattgcaactcctgctatttttttgttttccatttgcttggtagatcttcctccatccccttattttgagcctatgtgtgtctgtgcacgtgaggtgggtctcctgaatacagcacactgatgggtcttgactctttatccaatttgccagtctgtgtcttttaactggggaatttagcccatttacatttaaggttaatattgttatgtgtgaatttgatcctgtgattatgattttagctggatattttgccctttagttgatgcagtttcttcctagcattgatggtctttacaatttggcatgtttttgcagtggctggtacaggttgttcctttccatgtttagtgcttccttcaggagctcttgtaaggcaggcctggtggtgacaaaatctctcagtatttgcttgtctgtaaaggattttatttctccttcacttatgaagcttatttcggctgaatatgaaattctgggttgaaaactcttttctttaagaatgctgaatattgtcccccactctctactggcttgcagatcttctgctgagagatcctctgttagtctgttgggcttccctttgtgggtaacccaaccgttctctttggctgcctttaacatttttccttcatttcaaccttggtgagtctgacaattatgtgtcttggggttgttcttcttgaggagtatctttgtggtgttctctgtatttactgaattctaatgttggcctgctttgctaggttggggaacactccgaagagtgttttccaacttggttccattctcccagtcactttcaggtacaccaatgaaacgtagatttggtcttttcacatggtctgatatttcttggaggctttgttcgtttctctttactcttttttctctaaacttctcttcttgcttatttcattaatttgatcttcaatcactgataaccttttcttctacttgattgaatcagctattgaagcttgtgcatgcatcacatagttctagtgccatggttttcagctccatcaggtcatttaagctcttctctacactatttattctagttagccattcatctaatcttttttcaaggtttttagcttccttgtgatgggttcgaacatcctcctatagctcggagatgtttgttattaccaaccttctgaagcctacttctgtcagctctttaaagtcattctccatcccacttttttccgttgctggtgaggagctgctatcctttggaggagaagaggtgctctgatttttagaattttcagcttttctcctccggtttctcctcatctttgtggttttgtctatctttggtctttgatgttggtgaccttcagatggggttttggtgtggatgtcctttttgttgatgttgatgctattcctttctgtttgttagttttccttctgtcacgtccctcagctgcaggtcttttggagtttgctggaggtccactccagaccctgtttgcctgagtatcgccagcggaggctgcagaacagcaaatattgcagaacagcaaatattgctgcctgatccttcttctggaagcttcatcccagaggggcacctgcctgtatgaggtgttagttggcccctactgggaggtgtctcccagttaggctacatggggttcaggggcccactagaggaggcagtctgtccattctccaagcccaaacgctgtgctgggagaaccgctgctctcttcagagctgtcagacagggacgtttaagtctgcaaaagtttctgctgcctttttttcagctataccctgccccctgagttggagtctacagaggcagcaggcctggctgagctgcattgagctctgtcaggttcaagcttccctgggcgctttgtttacctactcaagcctcagcaatggtggatgccccaccccctgccaggctgctgcctcgcaggttgatctcagactgctgcgctagcagtgagcaaggctctgtgggtgtgggacctgctgaactaggcatgggatataacctcccggtgtgccatttgctaagaccattggaaaagtgcagtatttggatgggagggtcctgtttttccaggtaccatctgaaatggcttcccttggctaggaaagagaaattccccaacctcctgtgcttccctggtgaggcgatgccctgccctgcttcagctcaccctccataggctgcacccactgtccaaccagtcccagtgagattaaccaggtacctcagttggaaatgcagaaatcaccctcttctgcatcaatcatgctgggagatgcagaccagagctgttcctattcagccgtcttggaatggacctgggggctcaatttttttttaatttattttttaagaatggctatttatatattatgggaaagttttttatagagcactggaaaatgctagcaagaaggctcaggctgttggaagaaatgttgttttgtatgttgtgaagatgaaattgtaaccttggaaacatagaagagtgcattgttcattgtcaagtgccacctttccagcctatctctgatctcatacgggtttggggttgttacatgagtgttaattttgtctttctaaatgcagaacaaagatctagtaccttttgtactgctcttttatagttcccagtactgtgatgggtgcataaaagggcaaccaattgagctctagcattcctgtccacagccatgtaaggataaaacatctgcctctttacacacccaaaagcaatctctgtgacatctgcactcccacagagctgaatccaggttacactccgttgctttgggctcttgggttggatattgaggaagtcattcttagccaaggcatcccagttaaccctcttatctgacctcacccctaaagaaaatatatcagtattttttttctcctatgcagtttgctacatttcaggaagcttgactagcaaattagaattaaaacttaattttatgtctccttctgatttccttatccctagatctaagtatgtaattcaagcccgtctccccactatcctttggacacacacagacgcacacaggtgcatgcatgcacgcatgtgcacgcgcacacacacacacacacacaaacacacacagtaggagaaccactgatttttcacttcctgagaagcttctttgaattctttgtaaccttcaaactatgagagatttgccttgagatattacctttaagttaacaattgtgttttaatatgtctaccctcttataggatccccactgatgatgtctagagagcagaaagcaaattttaagctgccagaaagagtcaacatggaaatgcacagaattttgtgagagttgacagctgagatagtgtaattatgaacattttcataaaggagattttagtatacagtggaaggcacagaggaacttaaaagacatgatgtaggattgaaggcaatgccaactgtgcaccctaatacatcagactcctaggcatttcacacttaacatttccaaagctgaaccttcaagccccaaacctctcacctaccaaactctgccttcaaatattcactcccttacctcctgccctgtagctcagtaaatggctgttgcctctccaattgccaagcaacacgaggattatccctcactctgcctcctttctcattcccaagccccatcagttaccaacccctgccagttctcaaaatgtaacttgtcttgccctacctccactccagttcaggttgctattgtttcttagctgaatgactacaataatctcccacctggccactcatatcatgtactcctctttctagcagatgccacaaggtaaccagagtgatcatgtttagttcacaccttctcctgcttaaaactcttcagtgacttctcatttctgaagaaaattcaaaaccgttaaaatggagtatgaaggcaaaatgggtagatagacttaccagatatctggacataccacaaagccacagaaacaaagataatatgacattggtacaagaatagataaatagacaataagacagcctacaagtctgagtcagactcaaatatatttgggaattaatatgtaccaaagtgataccacataatagtgggaaaaaataatgattgtttggtagatagtgttgaggaaactgccttccatttgaattcctacataactacatactgaagtagactccagagagaataaagacttaatatgaaaagtaaaactcaaatgttgatagaagaaaatatatagaatgaactaggaaaggaaaggatttctttgtgaaatcccaagacgcaatccattagtagaaacaaacgttttcttacatcaaaattaaacatttctgttcatcaaagaacagcatgggcaatattaaatttttctatctcccttaagcatcaaactccaagcacatagtctttctctctgtcccttaagtatataccaagctcttttttgcagagggccaaatacacttgtctatgtttttgctaaaatgtctctcccctaacaaggtctttcctgaccacccgagttagaggaggtctcactgcatgtgatctcatttcaccttctactttgtgttcactgcaaacgttgagactgcaattatatgatcgcttacagaactcagttaagtgtctatgccccctggtagtttgtagactccggcagaccaggggctacctgctcagcctttagaacagtgctttatgcttagaagacagatgaaaatgttaatacagtggattaataaggggcagttgaaagagggcacattcactaccacatgccagatgagtgctacatgcccagcacagattccaggcatgttttgacctttatgtccacaagaatttgagtaataatgtgtgctcctgcttctttctgtcacctatgcttctttctgtcacctagagactcaacatctcaagtctaatttgtatcttctaccattccttgcactgcattaggaagtgaacaaatatttgctggctatatatctatatggcctcctcccaccacactgctttttatatgtttagattataacatcactcatgcttaatggcttgccttttgaaaactgacagttactgtcaacttttatgtaattatttcttttgttgacaactctcactctctgttgactcttaatttgatctgagcattcagttattcagcaaatatttattgaaagcctaatgggtgccaggaatatgtggggcactagaaaagctggcagtccccttgcagtggtgacagatgaacatgacctctcaaagaaatcattgagagaaaacagctaaacttagtgaagtattgagagagaccaaaatgctcccaaatttgggcacagtgcagagagtagctgaataggaatgctacaatgggaaaaatggactgtttcccagcttattttgagaaagagcttcacagtgtagcttcattattcatgactggaaaaaaatttcaaaacaatagaaatctacccaagcatatttataaaaagagactccaagaaaatagaaataactgtactatagtattgtttttcagtaacttgctatgcttttaaaaggatcaattcagagacaacttaaagcatcctattgaaaataataatgttaataatagagatatttgatgcctgctgaagaaaaacttacaaactatcctttgaaaatgattttaatgacaaatctcactttgtagaagccagttttttccaggtgatattcaaagttagtgttattttagtaaacatagagcactgcgaccaatgcattgtgatgactgtggagaagtcactatgttctgactacccagtgttgagagccttccagaagagtgcttgtgcagagagagccctgggtgaagaatttgctgtgagaggacccatggactattcctttagtatttccaaaggcaaaatctcatggaaatatattttgtctcagtataagggagaattttctaatgtgatcaaaagtgaaatcatgtgttcacagtgtatcagactccctgccaactcaaagatgggggcctttccaaggtctctttctgaaactcaagatcttagaattttgcagcctaatacagctttcaattatataataaaaaaactttgtattttatcatagttttatatgtaccataaaactgtgaagcaagtacaagggtatttctatacatcccaaactcaggctttcctattaacatctaatattagtaggtaaattttgtcacaattaatgaaccaataatgatacattattattaactaaagtccaccctttattttgattactttggtgttttttttttttaaagtaatatcctttttctgtccaaggattgtatcccggaaaccaccttatgtatagctctcatatctccctacgctcttggctgtgatagtgtctcagattttctttggttttgatgacctcgacagttttgaagggtactgataaggtattttgtaaaatggctgtcaattgatatttgctatttcctcgtgtttagatggggattatggatgttgaggaggaagaccacagaggcaaagtgccattgtctttttatcatatcaagggtgcatgctatcaacatgatataccagtcttgatgttgcttttggttagctggctgaggtagtgttggtcagatatctcaaatgtaaaattactcttttatttcccctttctatacggtgctctttgaaatgaagatactaggcacagatcaccattaaggagtgaggatttaatctatgtagattttttggaattcctctgtctgggtagatttgactattcaacctcatttatctgttcatttatatttgtatagactcatggatatttattttatgctctgggttataatacaatactgcattatttgttttgttcctcaaatgctttcagctttagctgttgaaagctctttcagttgtcttctgtgtcactttgacatatccctatgattgtaagattttggtttttttgttttttaaacacttcctttctggcattaaaagatgctgcagcctcctgttgaggatttcttgtgccagccatttctctaaggagctctcctcatgtagcttttgtttgtttgtttatagttttaaagtggttctagagtcatttcaggtactttacacatatttttctttattttggggggtctttttttcaacatcattatgtagcctttaacttcatttcacagatgcagaaactaaacagaaactaaaagagaaatgatttacccaaggccatacaattaccatagaagtggagttgttataaagcctaaattgtttgcctccagagctcacactctgaacctttactttacaaggtcagtctcacttgttacctaagttagtgttagatagaaacagtgctgctgtgaccagcctgcccttttgttaggaggaaaggtgaaaataagccaagttttcctctggcaagtctcccctcaggattccagccacgctaagagttcaaagcccttcctgaatgtgggagttgttgtgtgctgtctcgtggttttcactatttatctgaattcccagatcagattgttagctcttcagagagcaaggaaaatatactacactgtaggattattaaggtaagtaacttctgtcagccacatcacatcaaaacaggctgtgatgatatggttgctatcaaatacaaatatgaaaatctgcacctttcataccaggagagcataaatcttgattgaagtgatatcatattccctcccctttcctccacttttgaaagccacctggggatgggtgttggctgccattctgccatgtgcaggtgactggactgggctggccaatccagtctgcatccccaccagttttagaaggaaaaagacattagacagcccacaattttcttacctctatgactttcttttttcatttcaacttgataaaattgtgtctattcttttcaaggcttagcccaagtgttcattccttcaggaattcttctttgcttcctgctccacagccccaaactgagaataatctcacccttcagggaagtcccccaaacatctcatagctccgaaatcactcttgctattctctggctagcatatttgtgaccatctcctggtctccattagaatataagacttagaaggtaaagactgaactttgcctgtcttctgcttgctcacaacttgtaggacaatgatttttatgtatttggggctcaaagcattgagctattattgaattttcaggcagtaatataccagatagtgacaaaggttccaaaagccaggaatggctaccagattcctttttccatgttctgtgtcagagattcatcctttaatttatggctttagtttcctctaagaaaatgacaacttctaaaccaagtgttagcacgcagtggcctttgagctacattcaaccctctgcctcttcttgtatcaccagtgatctaagaatggttttcatgtttttaagtggtgggagggggagacaaaacacaaaaagaatatctcatgtcatattcagattatattaaattttaaatataaaattaaaattttatgaaatttagatgtcattttccatgaataatatttaatgaaatacagtcataccctctttgtttacatatggcctaaggcaagttttacaccaaaacagcagagttgagtagttacaacagggacatacatcccatgaagcctgaaatattcagtctcaagactttcaataaaaagtgtgccaagccctattctgagtcatgcccagaaatgtgtaccactgtgtgaaaaagttggggagccctttagataaagggcagagtagatacaggcacagacggcctagaggaaaaggaatctggagacaagaaaaggaagaaaacggaggcagaagcatacttggggacatcagatctcctgggttttgtatacatgcattgcaaacatctctacaaaggattcttatagttggtgggtatgcccgaggggcagatcttgggtattttacagaaccttcctgctcttctataaggactctgcatgggtcttttgaagaaaggatgacattaggagattatcattcatttctgatcattctgtataccaagactaatattttcagtaagatctaatgggctttgtgtcttaattttctctgattcaaccataataatgtgtgtgtgttctgggggaatctatattgtgtgtgtgtgtgtgtgtgtgtgtgtgtgtgtgtgcatttctttggaagaaatctgttttagatagatgctagttaattatcatgtacatagggatctttaaacatttggagtttttgagtaaagacacattgattggaacttggctaaagccatttcagccccttggagagttgtaatgacagttctttttgtttagaaatctatcattttcatgtctttctcttattttcttattgcagggtaatgccctgtacttcaagtctgccagaaatgttacagtgaacattctcaatgaccagactaaagtgctaactcagcttataacaggtaagaaaagggagaacttaacagtgcctagcccatgcgaggcactcagaatacagaattaatggtcaaaggaaacaccatatgaacctgaaaataaagtgtgctaacacattgttgagaaagagaatgtagcatgtgttccatgattctactagagggtagaatcccatccgtacacatattaaacttatgaaatctaatgatacctacttagtggggtaagaaaaaaaatttttctaagcagattttcatagaacatggcccctaaatataaaccagctgcttcatcaggtgctcagccaaagaaaagcttcttgctccaatgctggaggaaaaacaggctgtgttggattggttgagagaagaatgcagtatctataaagccagggaccatactttatgggctgtgaaagggatttttaactatagtttgaacccatgccatatttgctgtacgtgctgactttgaacctaactcaattgcaggatgtggatgtatctttactgaatatgtttgtgtgtaatttcttttaatacagcagatctgtgcctaacggctgtggaaagcacccactgtgttttaaactacaaattcctgaaatctaaacaaggactggttattcacaataatgattataatgataaacatggacctcgtgatttggtaacgtgttgagcagcacaatcaatgcccactctgtaagcagtgaacagggaggcattatgcacccccacagtggaagggaaaaggaatgtatgtatgaatggcattgttatacttacagacagaaaatgccatttgtttggcttcagggctaaaagtaaagtatacggatggacattttgagaagccagttacccaaatgcctcgaaacattactgttattgtgaataaaatatctggaacccactaataagccatggggaaacaggtacctttgtgaccatagtcttcactcctggggagggagcctcactcccactcttcccctggagtgctgcatgtagatgtctagagattcatagccagtgggtgacttggaccatctgccaatcaagaaactcagggattgaaggaactgctgcccggcagagcccataatccataaacatgttgtttcagcgtgtgactggatcttccaccttgcttatataacatctggcccacagtcacaatgctaaataattaaataaacagcttcagtaagcaatgatttaagcagcgtgtgtgaaaattgcctccaggagggtaataaatccaacctccagctcccagattttcacattcaaaaggaacttatttagcctgttgatcatttcccatttatttgtagtgggagatttggtttatttgagattttgttttgataaatctggaactgcccaaatgactattattcagcaaaagagtgagtcagtctctttttttccccccactcttcctctcccttctctccctacccttctgacaccccttttcccctccccttcagtgcttctctccctattccttcccctctctcctaccacccctttatccctttccttccccttctctcttctcgtctctcttcttcttcctctcttcccttgtttcttcctccttctccctcctcctgtgtcactattcttgactctatccctccagtggtatttggtatttgttttctgtctccctatgatgaattctagagaagacattagatatgtttaaaacatcattctaaacacacacacacacatacacacatgcaacaatacacccttaaaagttttccttcaatactctccttttacattacattaatgcacacagtggaaaagcacccagccatcccagcagacaataccttctaatgcctgttgtgctgggtgctgtacttgttggaaaacaaatcactcctgtcttctaagcaatgaggtctacaaaggctatcctgaggaataaagaattctgtttacctaaagaatgtctcaaaaacccattagaaattctaatgttagatgtccaggaagtcttttcacaggaaacaatacttcacatgatagttaagttctcaaattagatcacgaatgcctatttgaccataaggcaggctgctgatttagtatctcagtagtgggtctgaatggggaaccctcccacctacatggaggaaagcagtggagatgctttggacagcatcatgagggagtggggaagggttctagtgttaagagagttgggaagagaaattaggcttgaaggccaccaggcctttgcacctcccagactcatggagactgttgatgcattttgatggggctccagttctcctccctgtttaggagattaattaaggaggcactccacacatagactacacagagggggattaattcaagattagtttcacattaggaatagtggtttttttcttcccagagaggaacaatgagttcaacatgtgacctcctgagctgtctccagctccatttgcatttttctctagagtcatttttaaggattccagccatgtccagggaattttgcagcctcaggtgaaatcaacaaaggacaagccatctgcaccactgagccagcagttgctctgtggggttttggctaaaactaccaattactgagcttcagatacccaaagggttgtggctcttggtgaattccactttatgttctgtgaagccctgaaaagcaagatagcttaattgtactttgtgttctctgattgctgaagcatactttctatactgctatagtcctttagtatatgcttctgtatgtctcacagctgttcatgaattcaaagtaacacaggaaggtgtccttaactcctcagggaccaggatgatgatattgcccaggtccacagagaagtccaagcatgtgtgtccccaagttatacaactgcttttttatatgaatggaacaaaaatgggcaaactgctcgccctgtgcccatcctgaggtcattcattcattcgttagtacttcattaccttcccattctcaatctccctcctcacaaaaataaagtaataaccctaaagcactgacaatataatatagattttattcaaggttttgatgccatcaagaagatagctacatcttagcctttgcagaaaaactgaagccaaatccctcattggacatctcagctctttcaagatttccttctggcccttgtctccagttttctatttctccttctcctcacagatcttatttcctggctcttccagatgtgctggccccagctcccttctccttcctagacaaataaatgcccctttccttctgtggaataattctcagagctccattccagactgagacctgccattgtctctaaccttgcgagagccctccgccttgcccccatttgttctcctcatctgcagcatcaaagtggtcagataagatgacttccgggttccatcatgcttggaagtgctgtcctatctctgctgtttcagtctcctactcattagggagcctttccaatgtccttctttgtgttggagggctggtgtggacacactggcaagggatgaggtctgcttaatagatgtgattatgtgagtaaggagagtgcactaataagtactcatcatgcattcttttccacgtgttgtcccattgcagtagaatggcgacatccacaagagtggtgatgtccacaggagtggtttcctacactcacagcactttaccacccatagatttctttttataaacacaatgtcatttgattctttcaaactttctataacatagatagatacagtaggcagtgatagtccaatgttatagatgcagaaactgaggttcagaaagatcaaatgatttgccccaaatcatgttatcacagaataagaatgagttgggaaataattcatgtcttctgattcctagtccgacagtcttgacaaagagaaaagccaccccagatgcccagtggctggttggcactatcagcccagccttagcattctcctgcttcaatgtaatttttcagaacacgcgcaccagacaaggctgttcagtggccatgatggatcaagacaaaacaacacaaacacacaaacacaactctggtcatgtgtgtacatagcaaaactatcaacattgtccagaccacaaaaaagaccaaacatccccctatcctggctaataagagtgactctgtttctttattcaccacattttttgcatttccctggtctgtctttgttctagataagatttactcccattttctgatagtatttaatccagggtagagccttatttccttaaacgttccccaaaataagctaatataaggtcacattctctgataagtcctttctcatgacttctttctgagatgccctatggttttccttatggtgtgtgttgtccctcactgcaatgagtaataaacccaatttgttcaacaacaggtgtgttcctagtggtctttggctggaaggcactggggactctctcattgctatttattattaagtgacactcttttgaaaaataccagaaagaaaacaattccatgtcagaatcttctgaacaattttggaaaaagtataagatttctagactctaccctcaaatttttttctgtaggaacttctagttgaaaagatgaatttcttttgatctgagctaggttcagtgagaatgattatactcctggattattcctgtgtgtttctgtagaccagcttttgagaaccccatgaaatttaggtattcaggtagatccagtagatccagctcagatagattggaatgctttcttcttttagaaattctagctcatcaacctggtttactttttccatggtacctaaatctttctgcagttttctggtttaataataaaattttaaatgtatattggtgtgtctccatcagaatatagatgctatggaatcgggcttgatttccttgtgcagtattacagctccacattcaagaacagcatctgttgtcatctgataaactatctaaatttagttttcactgaacaaaatcctaatataaaagattgaacaacttctaaggcaattaattacagtaaccatttctgctatgaaatgatctgtatactaaggaaataaatttctcttggtgtcaaatgcagccagtgggttaagggtacaaagttaaacacatttcagctgaattttaaaaagctctttctgataattagggagggccaaagatatgtgattgtctcgagaagtgttgagcctctggtgccttgagaaatgcaagcaaaaatccacaactatttgacagcaatttggtggttagctgagggaaatcacagtcaaggattagtttggaggaagggcttgctggtcttcaaaattatagcccaagaatatattactaaaagtaattgacaagacctggctaaagtcatgagactgattttcatggtcagcttttgaaaaccagtccactgaacattgaagtctcatacaatcttgttagatatgtgtgttctatgaaaagctttttgtagtcaaagcgatgagactaatggtgttttctctctctctctctcctctctcctctctatctctctatctctctatatctctcaggtccaaaagccgtagaagcttatggtaaaaaatttgaggtaaaaactgtttctggaaaattgctcttctctgcagacaataatgaagtggtagtaggagctgaaagattacgagttttaggtaaggaaacttgaatcatttaacttgtttgatgctactgtgtacattttagaggagaagcaaaatggtgttatgaacaggatatgtcctcccaaaattcatatatcgaaatcctaactcccaagataatggtattaggaggtggagccttgaggggtaattaagtcatgagggttgagccctcatgaatgggattagtgtccttccaaggggatgagaagaccagagatccctctctgacatgagagggtacaagaagtcagcagtctgcaacctggaataggagcctcaccagaacctgaccaggctcgtatctgatctcagactttaagcctccagaactgtgagaaatcaatttctgttgtttataagccacccaggctatggtactttgttacagcagcctgaactgactaagacaaatggtgtctagaagagtgatttaggccagtttcctggattcttttaaagcaaggcagttgaacctccctgagtctggtcccctagtggaaatttctcaagctgtcaagtctttttggcacatctttcaacactgagctttgtgtgaaaatgagtgctcatccaaagaagtctcatttagaacatcctgtactcacagactggcaggcgtgcttgacgcattccagacttgcatacatgatgcagtgattcctaaacctggttgcaactgaagaatcatctaggaaactttggaagggtttaggttcatagttccaactctgatttactgaattagaagctatggtgaaaacactgagaattcgttattaaaaatatttgcagaaatttctatgatcccactgttggaattattgaatttgagcacatagcaaatgaatcttttatggctgtatgctgaaatgatctagcatggtgatttaaggatcctagaactccagctgaccgggtttttaattcctgctgtcacccactagttttgtgactttgggcaagttgctggcatcactgagccagtttccttttctgctcaataaggctaagaacatctcccatcttgagttgtccctaaggttaaatgagactctgttacatccacttatcagagcccctagcacaaaatagtgctcagtcaacagtaggtgctgctgctgctgttactacttatactactattactattaatgctaattctacttttccttctttagctccctgagattcactgtagcatagtgattaaaatctcaggctctagaattagcctgtttttaacccaatttctatcctttgctagctgtgtaaccttaagcaaagtatctaatctctctgtgcctgcttgcttacctgtttataaaattggtataatagaagtatctatcttctgagactgctaaaaagattgaatgaaatcatctatgtaaagtactgagttggctaaaatactaagtgtccaataagtgctaggtgttatcatcttaaattattagtattattataaggtacgtttacctgaaattatatttatctctgcattattatttgcactttgcatcttctttatcttccattactcctgtattttttcttggtctttacctcctcccacagtcagcttgtctggtctatttctctcttcctctctcagtacacatacatgtctaatttcctttctggatgactcttagagcttcatctccagtctggtatcttccttgaattctggatcttctttatctggatattctgccagcctctcaaattcagtggatcttgaatgcctatcatggtcaaatgcacgcatatgtacatgtgtgcatatatattccatcacctcacccccgactctcccacttgtatttgcccctgacttccttaacactcttactgtccccattatactgtcctgtcccagtctcatcctggccatcatgagctcagcatagtcaaaagatggaagtgaccatccttatggggcttaatggaggcaaaaatgcagggtgcagagatgataaagccaggtgcagtctaatccctggtcagtggtttatgtgtggcatgatctgaaacaactccctttttctttcagggccttgcttttttatatctgtaaaattagagttacctagagaagatatttttatacaatgttttccagtgaccaaagcttttaaaaataaaatttcatacatagtcccaataaataaaatagatgaaagaccaagatttctctgggttgtaggcgagtatattagtctgttctcaccctgctaataaagacataccctagactgggtaatttataaagaaaaagaggtttaatggactgacagttccaaatggctggagaggcctcacaatcatgacagaaagcaaaggaagaacaaagacacattttacatggaggcaggcaagagagcacatgcaggaaaactgccctttatgcaaccatcagatctcatgagacttattcacgatcataagaacagcctaggaaaaaacccacccctatgattcaattatctccaactgggttcatgggactatggttgctacaattcaagatcagatttgagcggagacacagccaaaccatgtcggtgaggatttgaaaggggagacttgagacattggagtcttagtatagtttgattcttttccccctctgtgtcctctggggactgcttataacttattttttaaaaccccttatgtggatactctttttataaaaggtctattgattacttgctatgatttaggtactatgcttgatatgcagtattatatttacacctcagaaacaccttgtggggtagacaccatttttatcacccctgttttacagttgacacaattgagctgagccatagggaaaggtgaaccaaagcatggctgacagctagaattcacaacctggcatgttggacatagagggctttaccttaaagccctatacttgctgtggcctctatctggtctcattttcagaaggggaacattgcccaagatcaagtgccagtaagtggaagggcccatgttcaaatccctgcctatagactccagcctcggtgcacttcactacatgtaaatatgttcctaagacttttcctattttcacaatttatgctttcctctttttgtagaaatggcattttctattttaattcttggctggtgtggagggaaacccagagacttcgagctatcctcatgtttaagagcactttgggccaggcgcagtggctcacatctgtaatcccagcactttgggagcccagtgcaggtggatcatgaggtcaggatttcaagaccagcctgaccaacatggtgaaaccccgtctctactaaaaatataaaaattatccaggtgtggtggcacacagctgtaatcccagctactggggaggctgaggcaggagaattgcttgaacccaggtggtggaggttgcagagagccaagatcgtgccactgtactccagcctgggcaatatagtgagactctgtctcaaaaaacaaaaacaaaaacaaaaaactttgctgtaccagctgtaaaacaaaaatgcctaggggaaaaagtggtgttatctcacacccagatcattctatgcaagtgaatttggcacttcctgttaattccttggtgcatcatgagtcacttcaccactttaaaatctgactttgcaatggcataggataattttaaacgtccagacactttggcttaatcttaacatccaaaactctgtgatggtatcacttcagaacttaacctctaccctaccccacccccacattcacttagactgaagactgggaaatgattataggttttggtcacttcaaagcaggtgggtattttcgttgttgtttgcagctatgtttgtgatatttcatttagagcataatgtaggataaaatctgtctctcttcatcattaggaacatttgcttttttatgtgaaatgtagaaaggaagcatcaaaataaatatcactgctgctgtcaatgctaaaaagacttggaaatgaccaccccacaaatcttgcatcaacctactcagtgaaatgagcccagtgggttgcagaaatgagcttcttatcagctgggattcagccatatggtgtggaatgacaagtctaggcagtttcattttcagcataatgagaagtttgtctttttgagtcgtcagactgtataaactcttgggaggtttgaatctggttgcacatttcatggtagcatctaacatagctgggttttatccttatcaggaccacttaggacctgagtgaccgtattcaagtatgttttctctctaagctttagtttccatttgtatagaaaaagaaaaaaaaatggaaggaagaatgaatgactataataagaaatataagtaaatgctatgtaaaaagtcaattatttaagttgatagcaagttgagtagaaataagcagtagagacctaaaaacataatgtctcttacatgtagtagctttacttgtggattcagaacaattttaaaaatttttctctggataaccacacccacctattcagtttttaggacaatgacaaccttgagcacattcaagggatcttgaatagtatggtaaaaagactagaagctcaattatttggaaacttttattctggaaaagatataggaggaataaatgtaggtaggctgtagtcactgagctctcatacatgcatgactttcctggggaaagcagagcaaccaagagccatgcagttgagtaattaaaaacacaggttttgtagctaactatatatcctggtttctgttgtaagctagtgctttgggtatgttgcttcatcgttctagggatcctcttataactctgtgacatagggtaataatgttgggtgctctgtgctgttgggagtactgaactacacagtgtgtgtagagttaatagtacagtgtgtggaacacagtaagcattcagtacatgctaactggtgttggtgatggatttttttttcaattgacacattacaggcaaacatacaatttgattttttgatacatctccatcatataatgatgaaactaaggtagttagcatattcaacaccttgtgcgtttatcatttctttttgatgacaacattcaaaaaccagtcttgtagctattttataacatacagtaacttactgttaactgtagtcaccctcctgcacaatagaacaccagaacttatttctcctatctaaatgcaacttttatccattaaccaaactccccaaccttctctcctccatcccctcccaatttatggtaaccacctttctattctcaacttctatttaatatgaaatcaacttttttaaaattccacatatgaatgagatcctgtggtatttttctttgtatgtctggttattttacttagcaaaatgtcctctggtttgcccattttgtcccaaatgacagaatattattctttttatggctgaacagtattccattgtgtacacataacacattttctttatgtattcttttttatgtatttcttgttggccatgtaggttgattccaagtcttggctattgtgactagtactgcagtaaacgtggaacttaagacatctctttgatgtattgatttcatttactttgggtatatatcctgtagtgggattgctggatcatatggtagttctattttaattatttgtagagcctccttactgttttctgtaatagttatacttatttatattcccactaaccatgttaaggattccctttttttacatcctcatcaatatttgttatcttttgtctatttgataatactcctaactggagagagatggtatctcatttgcatttcatttatatttaaatggttaatgatgttgagcatattttcatatacctgttgaacattggtatgtttttgagaaatatctattaagatcttttgcctatttaaaattggattattttgcttttttgctgttccttttgtattctagatattaactcctgtcagatgtatagtttgtcaacattttcttccatgtagttggttgtctcttctttctcttgtttccttggctgtgaaaaagctttttagttttatgtaatcccatatttttaactttgttgcctgtacttttgagatctcacctaaaaaatccttccttagcccaatatcatgaagtattttctctacgctttcttctagtattgtagttttgggttttacatttacatctttaaatccattttgatgtgatttttatatatagtgagaggtagaggtctaatctcattcttctacatgtggatatccaattttctggcaccatttattgaagagactatttttccccaatatgtgtttttatcaactttatgaaaaggcaattggctgtaggtgagtgaatttatttctgggatctctattctcttccatcggtgtatgtgtctacttttatgccaagtaccatgttgttttggttattatagctttgtagtatgtttagaagtgcaatgcctgcagtttaattcttcttgctcacaattgttttggctatttggagtcttctgtggttcgagatgaattttagaatttttttcctatttctgtgaataatgtcattgggtttttttgtttggttgtttttgtttttgagatggagtctggctctgtcgcccatgctggagtgcagtggcgcgatcttggctcactgcaagctccacctcccgggttccggacattctcctgcctcagcctcccgagtagctgggcctacaggcgcctgccaccacgcccggctaatttttctatttttagtagagacgggtttcaccgtgttagccaggatgatctcgatctcctgaccttgtgatctgcctgccttggcctcccaaagtgctgggattgcaggtgtgagccactgagcctggccgtgtcattggtatttttgatagggattgcattaaatcggtagaatgttttgggtagtatggacattttaacaatttaagaattaatctaatctgtgaacatggagtctctcttcacttatttgtgtcctcttcaatttatttcatcaatgttgtatagttttcagtatagagatcttttcacctccttgcttaagtttattcataggtatcttatttttcgtagctattgtaaatgggattgctttcttgatattttttcaaatagttcactgttagcatatagaaatgctactgatttgtatacgtccatttgatgtcccacaactgattagaattgactgttagatttcttaattctaataattttttttttggtggaatctttagggttttccatatgttatatataaaatcttatcatctgcaaacagggacaatttgatttcctcctttccattttgtttgtttctttctttctcttaatttctctggctacaacttcctgtacttcgttgaatacaagtggtgagagtgggcattcttgtcctattcctgatattagagggaacttcccattcagtatgatgttaactggtgatttcttgtatatggcctttattgtgttgaggtacctaccttttatacctaatttgatgaatttcttgcaattggattttgagttctgtcaaatgcttcttctgaatgtattaaaatgatcatatggtttttgtctttctttccattaacgtagtatatcacacttatggatttgctgatggtaaaccatccttgcattcctggtatgaatcctacttggtcatagtgaataatctttttaatttgctgttaaattcagtcagttaatattttgttgagaaattttgtatctatgttcgtcagaggtattaggctatagtttctttttttgttgtattcttgtctggttttgatatcaaggtgatgctggccttgtaacatcagtttggaagtgtttcctcttctctgatgttatggaatagtttgaaaagaattagtaatacttcttctttaagtgtttggcaagaagtcagcatgaagccattatgtcctgggcttttctttgatggaagacttttattactgattaaatttctttgctcattattggtctgttcccattgtctatttcctcataatccaatcttgttaggttctatggggtccaagaatttatccatttcatctagatcgtcaagtttgttggtagatagatattcatatagatacataataatccattttatttctgtggtatgagttgtaacgtttacttttttattttagattttatttgagtcttctctttttgtattaatctagctaaatatttgtcaattttgtttatattttcaaaaaaacaactttgtttcattgatctttttaactataatctcttttttaattctactcgatctttattatttactttcttctaccaactttgggttttgttcttacatttctagttccttgaagtgtatctttagattgcttaatataaatcattttactttttcgatataggcattcattgctatgaaattccttcttatgactgcttttgcaatgtctcaggctttggcatgatgtgtttttattcttatttctctcaaaaatatttaaatttcctttttaatttcattgttaacttattgaggagactgttgtttacatgtatttgtaaagttctgaagtttttcttctagttgatttctagttttataccattgtcagaaaaaaaatgcttgatataatctttatcttctttgttaagacttgttttgtggtataacatgtgatctattttggagaatgttaaacgtgtaattgaaaagaatatatattctacagctcttaaatggaatgttctgtaaatgtctattaggtccatttggtctatggtacagtttaagtctaatatttctttgttaattttctgtataagtgatctttccattgttgaaagtgaggtgctgaagtcttctactattactgttttggagtcaatctctccctttagatctagtaatatttgctttatatatttaagtgctttggaattgggtttctttatttacaattgttatatcttcttgttgaattgattcttttatcactatacaatgaccttctcctttctttttacagtttttgacttaaagtctactttattttatataagtatggctactcctgcttgcttttcatttccatttgaatggactgtcttttttcatttctccactttcatctatgtgtttaataatgaggtgagtctcttgtaggcagaatataatggggtcttgttctttaatccattcagtcactgtatatattttaattaaagaattttatccatttacattcaaagttatttatgataggtgagaacttactcctcctcttttttacctctgtggtgtggtggttttctgtggtgctaagatttgttttctttctctttcttgtttatgtatctgctgtaatttatttgtgattcctgtggggctaacgtgaagtcttatagttacaataggttattttaagctaataacaatttaattccagtcacatgagaaatactctagacttttttcctccctgccaacaatttatatttttgatattttcttgcctgaaaacatatatttaaattagtatatatagtatatccattatacatatacatgaaatatatgcacattatatatgtatatatacatatatacacattttatatgtatatatacatatatacacattttatatgtataatatatataaattatacactatacatatatacacaatattcacacatatatacatatataatgtgtataatatatactttatatatatattatgtgtatgtttcttaaccactaattttagttgttattgtttttgactgtgttgacttttagccttcatattaagggattgaaagatttacatagtaccattgtagcaatggggtattttgagtttgattatgaatttacttctttttttttctcttgtgtgtgtgtgtgttttattattatactttaagttttagggtacatgtgcacaacgtgcaggtttgttacctatgtatacatgtgccatgttggtgtgctgcacccattaactcgtcatttaacatgaggtatatctcataatgctatccctcccctctccccccacccaacaacaggcctcggtgtgtgatgttccccttcctgtgtccatgtgttctcattcttcaattcccacctatgagtgagaacatgcagtgtttggttttttgtccttgcaatagtttgctgagaatgatggtttccagcttcatccatgtccctacaaaggacatgaactcatcattttttatggctgcatagtattctatggtatatgtgccacattttcttaatccagtctattattgttggacatttggcttggttccaaggctttgctagtgtgaatagtgctgcaataaaaatacgtctgcatgtgtctttatagcagcatgttttataatcctttgggtatatacccagtaatgggatggctgggtcaaatgatatttctaattctagatccctgaggaatcgccacactgacttccacaatggttgaactagtttacagtcccaccaacagtgtaaaagtgttcctatttctccacatcctctccagcacttgttgtttcctgactttttaatgaccaccattctaacttgtgtgagagggtatctcattgtggttttgatttgcatttctctgatggccagtgatgatgaacattttttcatgtgtcttttgactgcataaatgtcttcttttgagaagtgtctgttcatatccttcacccactttttgatggggttgtttttttctcgtaaatttgttggagttcattgcagattctggatattagccctttgtcagatgagtagattgcaaatattttcacccattctgtgggttgcccgttcactctgatggtagtttcctttgctgtgcagaagctctttagcttaattagatcccatttgtcaattttggcttttgttgccattgcttttggtgttttagacatgaagtccttgcccatgcctatgtcctgaatggtattgcctaggttttcttctagggttcttatggttttaggtctaacatttaagtctttaatccatcttgaattaatttttgtataaggtctaaggaagggatccagtttcagctttctacacatggctagccagttttcccagcaccatttattaaatagggaatcctttccccatttcttctttttgtcaggtatgtcaaagatcagatagttgtagatatgtggcattatttctgagggctctgttctgttccattggtctatatctctgttttggtaccagtaccatgctgttttggttactgtagccttgtagtatagtttgatgtcaggtagcatgatgcctccagctttgttcttttagcttaggattgacttggcaatgtaggttcttttttggttccatatgaactttaaagtagtttttttccaattctgtgaagaaagtcattggtagcatgatgggaatggcactgaatctataaattcccttggacagtatggccatttccatgatactgattcttcctacccatgaacatgaaatgttcttccatttctttgtatcctcttttatttcattgagcagtggtttgtagttctccttgaagaggtccttcacatcccttgtaagttggattcctaggtattttattctctttgaagcaattgtgattggaagttcactcatgatttggctctctgtttgtctgttattggtgtataagaatgcttgtgatttttgcacattgactttgtatcctgagactgctgaatttgcctatcagcttaaggagattttgggctgagacgatggggttttctggatatacaatcatgtcgtctgcaaacagggacaatttgacttcctcttttcctaattgaatactctttgcttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctagtttattgagagtttttagcatgaagcattgttgaattttgtcaaaggctttttctgcatctattgagatagtcatgtggtttttgtcattggttgtgtttatatgctggattatatttactggtttgtgtatgttgaaccagccttgcatcccagggatgaagcccacttgatcatggtggataagctttttgatgtgctgctggaattgctttgccagtattttattgaggatttttgcatcgatgttcatcagggatattggtctaaaattctcttttttggttgtgtctctgccaggctttggtatcaggatgatgctggactcatcaaatgagttagggaggattccctctttttctgttgattggaatagtttcagaaggaatggtaccagctcctctttgtacctctggtagaattgggctgtgaatccatctggtcctggacttcttttgtttggtaggctattaatttttccctcatttcagagcctgttattggtctattcagagattcaacttcttcctggtttagtcttgggagggtgtatgtgtccaggaatttatccatttcttctagattttctagtttatttgtgtagaggtgtttatattattctctgatggtagtttgtatttctgttggatcggtggtgatatcccctttatcattttttattgcgtctatttgattcttctcttttcttcttggttagtcttgctagtggtctatcaattttgttgatcttttcaaaaaaacagctcctggattcattgagcttttgaagggtttttggtgtctctatttccttcagttctgctctgatcttagttatttcttgccttctgctagtttttgaatgtgtttgctcttgcttctctggtccttttaattgtgatgttagtgtgtcaattttagatctttcctgctttctcttgtgggcatgtagtgctataaatttccctctacacactgctttgaatgcatcccagagattctggtatgttgtgtctttgttctctttggtttcaaagaagatctttatttctgccttcatttcgttatgtacccagtagtcattcaggagcaggttgttcagtttccatgtagttgagcggttttgagtgcgtttcttaatcctgagttctagtttgattgcactgtggtctgagagacagtttgttataatttctgttcttttacatttgctgaggagagctttacttccaactatgtggtcaattttggaacaggtgtggtgtggttctgagaagaatgtatattctgttgatttggggtggagagttctgtagatgtctatcaggtctgcttggtgcagagctgagttcaattcctggatatccttgttaactttctgtctcattgatctgtctaatgttgacagtggggtgttaaagtctccccttattattgtgtgggattctaattctctttgtaggtctctaaggacttgctttatgaatctgggtgctcctgtattgggtgcctatatatttaggatagttagatcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccctttattttgagcctatgtgtgtctctgcacatgagatgggtttcctgaatacagcacactgatgggtcttgactctttatccaatttgccagtctgtgtcttttaattggagcatttagcccatttacatttaaggttaatattgttatgtgtgaatttgatcctgtcatgatgatgttagctggttattttgctcattagttgatgcagtttcttcctagtctcgatggtccttacaatttggtatgtttttgcagtggctggtaccggttgttcctttccatgttgagtgcttccttccggagctgttttagggcaggcctggtggtgacaaaatctctcagcatttgcttgtctgtaaagtattttatttctccttcacttatgaagcttagtttggctggatatgagatgctgggttgaaaattctttactttaagaatgttgaatattggcccccactctcttctggcttgtagagtttctgccgagagatcggctgttagtctgatgggcttccctttgtgggtaacccgacctttctctctggctgcccttaacattttttccttcatttccactttggtgaatctgacaattatgtgtcttggagttgctcctctcgaggagtatctttatggcattctctgtatttcctgaatttgaatgttggcctgccttgctagattggggaagttctcctggataatatcctgcagagtgttttccaacttggttccattctccccgtcactttcaggtacaccaatcagacatagatttggtcttttcacatagtcccaaatttcttggaggctttgtttgtttctttttatacttttttctctaaacttctcttctcacttcatttcattcatttgatcttccatcactgataccctttcttccagttgatcgaatcggctcctgaggcttgtgcattcatcacatagttctcgtgccatggttttcagctccatcaggtcctttaaggacttctctgcattggttattctagttagccatttgtctaattttttttcgaggtttttaacttctttgccatgggttccaacttcctgctttagctcagagtagtttgatcatctgaagccttcttctctcaacttgtcaaagtcattctccgtctagctttgttccattgctggtgaggatctgcattcctttggaggaggagaggtgctctgatttttagagtttccggtttttctgctgttttttccccatctttgtagttttatctacctttggtctttgatgatggtgatgtacagatggggttttggtgtggatgtcctttctgtttgttagttttccttctaacagtcaggaccctcagctgcaggtctgttggagtttgctggaggtccactccagaccctgtttgcctgggtatcagcagtggaggctgcagaacagcagatattggtgaacagcaagtgttgctgcctgatcattcctctggatcttttgtctcaaaggagtacccggctgtgtgaggtgtttgtctgccctattggagggtgcctcccagttaggctcctcgggggtcagggacccacttgagggggcagtctgtccgttctcagatctccagctgcgtgctgggagaaccactactctcttcaaagctgtctgacagggacatttaagtttgcggaggtttctgctgccttttatttggctatgccctgcccccggaggtggagtctgcagaggcaggcaggtctccttgagctgcggtgggctccacccagttcaagcttcctggccactttggttacttactcaagcctcggcaaaggtgggcgcccctcccccagcctcgctgccaccttgcagtttgatctcagactcctgtgctggcagtgagcaaggctctgtgggcgtaggaccctccaggccaggcgcaggatataatctcctggtgtgccgtttgctaagaccgttgggaaagcgcagtattagggtgagagtgacctgattttccagttgctgcctgtcacccctttctttgactaggaaagggaattccctgaccccttgcgcttcccaggtgaggcgatgcctcgccctgcttcggctcatgctcggtgtgctgcacccactgtcctgcacccagtgtccaacagtccccagtgagatgaacctggtacctcagttggaaatgcagaaatcacccgtcttctgcgccactcacgctgggagctgtagactggagctgttcctattcagccatcttggctcctcccctcgattatgaatttacttctacagtgagctttatacattcctgtgtttcatgatagttgttattgttctttcatttccaggtgtggcactcccttaaggattttttgtaagttatgacgaattccctcagcttttgcttgtgtgcaaaagtctttttttctcctttatttgtgaaagacagcatgctgagtattgtttttttggctgacagttattatcacttaacactttgaatatattatttcattctaccctgccctgcaaggtttcttttgagaaatttgcttgtagtctattagatattttcttatttatgacttgacacatttttcttaaagcttttagaattctttcttttgctttgacttttgaaaatttgattataatgtgccttggagttgagtctaattgggaatctttttgcttcctggatctttgtagacgtggcgagttttcagctattattttgttaaattagttttctgtgcctttcttcatctattccccatctggcatttgtataatgcaaacattcgttaacttaatagtgtctcataaatcttgttggctatctttattcatgcttattcttagtcctttttatctgactggactatttcaaaatacctgtcttcatgttcaaaaattctttcttatgcttaaccaaatttgttattgacactgtcagtcatattttttgtttcatttattgaatttttcaactccaagatttctggggtttttataattatctctgttgaatttctcattcagatgatgaattttttcctatttcattgaattggtggtctgtattttcttgtagctcaatgagtttcctaagctcatgattttgaattccttttcaggaattctatacattttatttttgggagggggtctgttactaaagaattattgtgttcttttagaggtgttgttttgcttttttatgtttcttgtacccctatgttgatatttgtgcatctagtggaatagtcatccttttcaattttgtgggatagcttttgaagggagagacattttcctgtagatgagtcctatgatgtttgttgagaatggtgcattggcttttgttctgggtggacccagtaacatagcctctgtgcagtttcttcagctgaaaactttgtcagtgatagctgtgattatgccagtgacctaggctacatgagtttgtgatggcagtagtgaagttttgccgagagctgaaggtactgaactggtggttgggcttggtgcatttggctactatgggctggttactcacaaggctttctagtggctggttcaccagcaggctgactgttggactggacatgtgcaggtacagcaagtcagccagctgtgtgtcaccttccccactatgcaggtctgcctgtatgggggtaagggtgttggatggattttaaggcagcatctcagctgttccactgagcctaggctctgagtagccagggttgtggtgctgtaactacccatgtgagtacagtggtatgatggcagtgtgtcagaaatggagaggtgcaatggctaccaccctccagagcagcatgtactctagcagttgatccattgttaagatgctgtggtgctgtagccacttaggtcacagtggatggaggttgcacagtggagagtcctactttggggcagtgcaactgcatgactcaactccccaaattgcattcggggcctataaagactgcagaactctctggcagcaaggactataggtgtgtgtagcagtaataaggactactgggggtatccagcttactttctcccttaaaaataaaatcactcctggctgcaagttaatcccagtagaggagataatgtggcagaggtacggtgctttgctcctctctctgtggtgctttcctgggtttccatgttccacagggatcttgccactgccctagtgatctccattgtatttcctcagtcactccagttgaaatatagatgtttgttgtttgcatccctttttgtggggagataagcacctggcaactctagtcagccatcttgctgtttcattgtggtaatagctgagtttcaaaggactcatcaaatcctgaaattgtacacagcccttgtgtgttcacaaaataaatttgcttagaacttgtaggagtattcatatatcaggtatgtttggaccaatggattttgttgacatagtcagggccagaaaacacctttacaggctaggaagtattacacagcccttttcacacatgtgtgagtaaggctggtctcactgtcatatgtattctccagttggaccttaagtaatggagagattaaaggccaggttgactttccactattcccccaactcactaagacagtggatctcaaaaatatggtcctgagatgaagagcatcagctgtggtctacttgttagaaatgctaactctcaagctataccccagagctactgaatgagaaactcagggatagacctcagtaagctgtgttgaagcaagacatccaggtgattcctatgcgaaccactgacccaagacaatgatagcaaaatcattttgccacaaatctcctggtaactttcaaatgagttcaggctcagcttttagtattttgctgcaacataaatatagctaacatatgttgagtgcttactctctgtaaggggctgaactaatcacttgccctgaataaatgcatttgatcctcacaacaaccctattaggagggtacaggctggctggcttccttccttccttccttccttcttttgctgtgtcatccagacttgggtacactagtgcgatctcagctcactgcaacctttgcctcccagattcaagcgattcttgtgcctcagcctcctgagtagctgggattacaggtacgcaccatcacacctggctaatatttgtatttttagtagagatggtttcaccacgttggctaggctggtctggaactcctggcctcaagtgatctacctgcctcggcctcacaaactgctgggattacaagcatgagccactatgcccagccaggcttattactttcattaacagatgagcagattgaggcacagagtggtataataacttgtccaaagttccacagagagcacatggcagagtcaggatctaaatccaggcagtcttcaccacactctatgacttctatcagtggactcttttccgaaactccacggcacattgttatcacaatgagagggaaagagaatggggcaatagtttccaggtattcctctcctttttggctactggatgctccactattccctaagaatgctccacaattctcctaagtctctgaccattcgctgatccctttactaagtcttctttcacctggtcacttagattcaaacctgttgactcccccacagtttagtccttttttttatgttcacatttctgtgggaaattccacatttacagatgtcctacatatggtttaaatatttgcttcttttcagatgacccctaaatctgtacttgcctcaaactgtcttctcaattccagtttcaaattcccagcagcctgtacttttcctcatggggggtctttgcatcacttccacttccttacttgctgctaaactaatgtctcctccatcaaacttccagagatttctcccctaattttccttatggggccaccattctcctagtcttcagggccttgctttcattcaggtaccagttgtcttttttcacatgaacgaaaaatgtttttgccacccccggtttttccatgttacaaaggtctctggcacaaaagaattaggcttataacttggcccattcatttaattaccaaaatgtaaagttagtatgcaagatgaggcatgatgtagtttagctttaatttcagaacacattttaaaagattagacaggaatggcctttaaaaagcagcaagaaggtaagcaacataaaggccagtgcaactaagaggcatcttcagtgacaacaccagggaaaacatgactttggttttcattaatgaccaatttcattgaacaaggaattggacattatagcatttataaacaaagcacagttataaattgctattctaattgttaattagttgtatttatactgtagattagttttttaaatatatcctctagatgccacttgatgctaattatctgagttacattattatcaattgaaaaacattttaattaagtacaaagctatttaaattagcataagacttatagaaattcaaatatggtttgatgcttaactttttttttaggactacatgagatggtacatctaggcttttgaatttgatgaaactctactgcaacgtggcaaatgataatttcagtgaaaggggtgggagtgttcttagtgatgttcactcattaaatgtgtatgtctgtcatatgtattgtatatgatattgccaaatcactgctacaggtgccacaaatacactgtgatgattaccactgttcctgctctctatgggagctctctgtctaatcagggagatagatacacttggcagatctgggagcccaagaagaaaacaagctacataagaagtatagaaacaaagtgcctataaaatccagctgcggttgggtgtagtgggagagagagagtttagaaatcttcttaaactttcaattaggtacatttgaactagattttgagtatagatgaggagggaagaaaaatatagtcttggcttggtgaatggagtcagatgtgtttatcattcgggtctcacttggttgtgatataaatccaattcaaagggagaggcaaggaaatttattgcctcatgtgattgaaaagcccaagagtagttggctgcaggctagcttcagtggctcaaataatgaaaccaaaacttagtctctctctctttcttttaatcatgtctcagctctattttctaatcttgtattctgtcttcagctctgctggtgagcagaaaaagtggttatcatcctaatataaatacaacgatggcctgagttttattctgtgtggactgtcatggaccataggtccatccttgaactagttagtcactgtgatcaggatgatatagtgtgctggttagcaaagcctaggtcatattcccactgctagagctagggttggaatgactgagagtgaaatagagcacttctccaaaggaaaattggggtgttgttatcaggagagggaataggtgctaggaaaaaaatgcaaatacttgttatagtagtcagatgtatgagcatagaaaatcatgatggttggatggttgtatatgagacagtggaacccaggcattgtgaagggtattagtggaaaatacttgataagttgtctctcccttgcttgctgagctcctaacacaatggtaccaagcatgtttttacctcctaacatttttacttactgttccctctgcatagaatcctcttttccaagatgtactaatggcctcttcctttgtggctcaaacatcgccttatcaaagaggtcttccctgaccactttataaaaacagcatgttcccattatcactgtctacatcaggaattggtcaactatagactgccaaatcaggccaaaaccactgcctagttttgtaaataatattttactggaacatgatcacactcatttaagtctgtctgtggttgcttttgcagtacagtggcagagttgagtagttgagacagagatcatatggcccagaaagactaaaatatctactatctggccctttacaaaaaaaaagtttgccagttcctgatctgtgcctccattctgctgtattcttcttcaggctagttatcacaacatgacatgatgtatatttgttcattttctttctatccttcctcattagaatgtaagctttatgatagcaggaagttttgtctcatagacttagaatagcacctggcacataataactgctcagtaaaatttgttgcatgaatggattgaaagattttgaatactgaaatgtctcacaactcacctgacagtgtagtaaaaagaagcaggggagagcgtgcccctaagttgcaagaatactgtaatacattcgttaaagattcataaaggcctaaactaggatagaaagagaagagagaacaaatagacacgataccttgagatagaactaatgaaacttggcaagtaatttcatgtggaggatcatggggaaggaagttggggatacctctggtgctgttagccttgtcagtcagataactgtgacatcattaacagaaatttataggagcaatggcagatttgggattggagattaacagttcagctttagatgtactaggtcttggagtttgacctctgccttggagaggtccactgcccagtgggagaagccaggcaaaaagcccacaagagatgactggctgaggagagggatcagagagtctattcacgtaacttaaaacagttggaagtgccccaaagcaaatactcagcaaaggtcgttaactagagcttcacccaacagcacccagccacccagcccatttctttatctgaagaaggctccaggggtggtttacagggccatgattgccctccctggtacatcctcagaagtccagggccctatcccatgttcctgtgcttttcctcacccactctgccttttaccatgacaaggtgaagcaactcaaaaggctttagaatgcaacaaaacttagttctgtcacacttaccagccacgtgaagttggccacattgttcaagtcacatggacatcacttaaatgtattcaggttctaaataaacagtctctctccttcctttctctttgcttctttttccttttttctcttcctttctgaagtatttcatcagtacgcagaaggaagcatgagaatggctgaaggattatattttagagtggaacatggtttctcagatagggtagtgaaaatagaatagtccaaaccttgatgcctgggaaatgagagcctacgaatctaatagtaacatttgagtaataaatcctaaaactcaccagggaccaccttctgctcccagttatcgttagcagagataatctgctgggtattcaactgtttagaaagaattgctggttgtctagttcttctgtggcacctcatttaaaagctggtttattatttacaggaatacaggaataatgtattagatcataaacatacagttcccataaataatgcagcaagaaagccaaatataaaagtctcagatgaacaactgaacaaccacgacctaataaaccagagatacttaatgagaaaaagcaaaattctacaatatagaaataataatggggtttcatttgaaatgctacagggagtacagcactcataattctcaaaaaaaaaaaaaaaaaaaagagccagtccgaaaacctaggtgatttcactgcctagtagcgcgcattcacccactgatgtctgtaggcagcataagctacagtggttcggttttcccctcgcaagcttgaggggtgaattcctgatgcagaaggaaaaggcatttgttgggccccacacagttttccctttggcaagagggaaatgtgatttaatatgagcatcgtagatttatgcttctgtgtaaacttccacaaccatcccaagcagcattgcctcagcagaccttcccagctgctcagccattgcagccctcggtggtgctcagggagagtgggaaataagtaagttggggatgtttgtcagctttctagtttgattaaagagttgatgacgttcactgtgtggccgctttgaagagagccaattcctttttttttttttttcttctgagacagcgtatcgctctgttgcccaggctggagtgcagtggcgccatcttggctcactgcaagctccgcctcccagcttcacgccattcgcctgcctcagcctccagagtagctgggactacaggcacctgccacgacgcccggctaattttttgtattttcagtagagatggggtttcaccgtgttaaccaggatggtctccatctcctgacctcatgatctgcccacctcggcctcccaaagtgctgggattacaggcgtgagctgccgagccggccgaagagagccaattccaacatttaacaagggagggagatggttttgtttttctgtttgcggaactaacacaacttggatttctctatcaagccatagttagtgtgttttcaagcatctgttggcctgtttttattgtcagagttttcttctagccagttaataacaaggacagagtattttcaaatgaggagataaacttctgtcaggcatcttcaatgtcaagatctagctatattgtctcctttcctattaattatattacgcttgtagaacactcctttaccaccaacagttacctgagtagaattttttctttttgcttttccagcagaggccaaggggaatgttggtattccaccgtgataccaggaatttaatgagatgacaatgtgaataagaaaatctcagtgcacagaatagggaaggaaattaactttgttctcctttattggaaagacttgaatttcatttgcttatttgattgggagaaaagagtactaaaaatattctcttacgctccttatgcttcacctccttgcttgcactctacttttgccaggtactgccctttaatcttaactccttttgcaccgtcttccctgggaacagtggttaatggggtaagggttaatccaaacaaaggaagaaaggagagacagaggagaaaatatccagtcttcttcaaagtacagaatagaagcaaaattcaaagtttctcccctttagaacagtagtatacgtcagcagaataagtgagtatggggtgtgggcacaaactgcctgggttgaactcctggctctaatggtacaacactgggtaagtttatcaatctctgaaagcctctggtttctcatcggtaaaacagggttaataagagcactacataattatgtcaagtactcaatgtggtgctaggcacctaatgagtacctgatatgttaatgcctgttgttttccttctacatattactgttgaacaccatttgtacaactgtcaccaaactaagttcagtgcagagatgtaaggacgtagaacaaaagttcctctttaaaagttctcaaataagttatattcttgtacgggtatcaaagcacatacccagtgaaatattaaatagtgaaaatgtttttaaaaacttgaacaaaatatacgatagaacttggacatgctgagaggattaagtagatggtaagtgctgaagacaaggtaggaagagatcaggactacagaggtgttcgggagaaacttcctagaggagaaatagggggaagtgtaatggatggggacagagtttgacttcgcaagtgcaagggaatgagaagcagcttcctatgcagcagcaagaacagggactatggtgtgacagaggaggtggaatgagctgccatcgttttttccagcaaataagcacatttggatttctttatggggaagagactgtcatgtatcagcatatagtaaacaggaattacttactttcccaaagactgaattaaggaatatctcagggttgtgctagaccctcccaggaactttcctggcagtgtactgtgcaggatgtggtggaaatgggaatgggaatatttaatattattttggttctgaaagtcaaagagaaaagaattatagttagacattatttatgttgcaagaactctcatggtttaaaaatgaaaggaagtagcatcaacaagaagcttcttgacattatttaagctgtagtgtaggcagttcttctttagaaagaaattcagtcacattcaacaaatactaattgagtttttactctggccagctgctgtgttgaccaaagggacactctgggtccctgcctttctaggatccacagctaagcaagaaagttagattttttttccccctttgagatagagtctcactctgttgcccaggctggagtgcagtggcacaatctcggcttactgcaacctccgactctcaggttcaagtgattctcctgcatcagcctcccaagtagctgggattacaggtgtgctaccaccatgcccagctaatttttgtatttttagtagagacggggtttcaccgtattgaccaggcttgtctccaattcctgacctcgtaatcttcctgcctcagcctctcaaagtgctgggattacaggcgtgagctaccatgtccagccaaaagacagatgttttaagcatttacgttaaaaaaaaaatgtgcgttatgggagcaaagtataaaatgctatggaaacataaaattaggagattagtttaaccaaattttacaagtaagggaagcctacctgaaagaagtgattaagttgagactggaaggattaattaatcagtccaagcgttggaagcactaaatgtggagtagctattttgagcatatacaaagtcctgttgaagcataaggaaagttttagaagttcaacacagagagtagagatggagtagaatgtccaaatataagagggaagagatctttattttaatagctgacatttcttaaatgcttattccgtagcaggtgttgttctcatctctttgtgtgtcttgagtctcaggacagacatctaagataagtttcattcttattttcacttcatgtatgagaaaactgacaaataggcaagttccccaaggttttatagcaagtttaagggtggaagtaagctctaaacccagacaatcagactctgaaacctgtattttggttttctttaaataattattgagataaaattcacatacacaatttacccaggtagaatgtacaagtacattttttgtataaagtgcctatacttttaacataaatcatgtaggagggccagccgtggtggctcacacctgtaatcccaacgcttggagagaccaaggcaggtggattacctgaggtcaggattttgagaccagcctgaccaacatggtgaaactttgtctctactaaaaatacaaaaattagtgtggcatggtggtgggcgcctgtaatctcggctacttgagagcctgaggcaggagaatcacttgaacccagaaggcagaggttgcagtgagccgagatggcaccactgcactccagtctgggtgacagggcaagactctgtctaaaaaataataataataataataataataataataataataataataatttagggaaggaaagtcatatcttttcttcaccccttgcaagtctccataacaaagacagattttttttttgtaaaaaagaaaagcattgcaaatttaataaacattttctatgacatgagagccttcagaaatgaacaaccaaagaaatggggaaaaccgtatttttatgtgtaggtttgatgaagagtaggacaatcatgtagaagtatgactggacaaaggggggtgtgagctaatggtaatgaactgggagaaacttagcaagacctgttttttctgattcttcttggcatctctttgtcttcattcctttcctctgggtatagagtaggacgaaacctattacgtgagtgtctctgaggaaagaacggtgggagaagatcagagggtgacttttctaggttttataatcagcttcaggggagaatgacgggagcaagtcagagagtccttcttgcttctgctgttttctcaaatgtcaaggagccatattttggggtagcatgtcctgaagcccgacagtcacatttacatagccacaaatatacatatatatttttgtattgtatgttttatatgtatatagtatacatatatatttgttgtattatatgatatgtgtgtatatatgtgtatacacatgtacattagataaatatatatacatacatggatccttatatacgtgtgtatgtacatgaatctcttttagaaaaccacagtattgcagtgggcactgtgtgtcacgttcaggcgttcggacttttaaggcaatggggatgcattgaagggcttctgactggggaccagcaagatctaatttgtgttttacaggacaccgtgatgaggatcagccagggatgggttggacagatccagaatcatgagcccaaatacatccttgacatctatgttcagtgttttaattcaaaacgagatttcagaaaaagagtcgtgcagcctgctctataagactgtagcactgacaactcagattgttcttttctgactcagcccaaagaaaagaagctgagcatatgaggaagggcaggactcttccagttggaaagagcacaagcatatccaatgagttctgaacacggtgcattgttcttcccactcagttgcttgatgtgagctgatcagaggtcaaagcacatttaaagtacttgtattatatcatgggcttgtggaaaagattgcatttaactaaacaaaggaaagagccgatatgaaatcaatatgcagggtgcctatgagctatgaaggaaggtaatgtgcttttcttctttggctgttaaatgcatctcagctgccaaggaaaatgactttctctcttgacttcctatctgtctagctgactggttattggagagtattcaggccctagtggttcaactgtatgtttaatgagggtgtcccagcacaagagcctaagcaaggtcctctggcctaattcttcctccaaggactctgaagatacatctctctttagcaaattgtgatcaaagattgctggtggagcagagaaagggtccagggccttggtcttgtacggtgcaatctctcccatcattgggaacttaggctgcaatatgatgtctgagaaatgtaccagagagactcacctggaaatatcccagagaattaattgcagacacaggaatttcaaggagaggcctccactgagaagtggaaatttgagttagttcttgaaggatttcagtgggtgaagttggggaagaagctgttcccacttcttccccacttcaataactttgatgttattgaaggaaataacatcaaaaaccactcttgggccaggcgcggtggctcatgcctgtaatcccaggactttgggaggccaaggcgggtggatcacgaggtcaggagattgagaccatcctgactaacacggtgaaaactcatctgtactaaaaatacaaaaaattagccgggcgtgttagcgggcgcctgtagttccagctactcgggaggctgaagcaggagaatggtgcgaacccaggaggcggagtttgcagtgagccgagattgcgccactgcactccagcctgggtgacagaacaagactctgtctcaaaaaataaaaataaaatataaaaataaccactcttactcttgtggtacagccttgtaacaactgaagtttacaaatttagtcctgtcttctgaatgagggataaaaaatgaattctagagtacgagttgaattaactttttttttaaaaaatgatcactttcctcattctctcctcatcctttttctaccctcttttcgtctgtgattcctagacagaaaaatgatgcaagcgagaaaggccaagtttgagtcaagtctgctaccacagattgcaaataggctgataaagcacaagagctgacacatcctagagaactgacatgtgatcacatctgcatggtagcattagttacaaccagatacctgcacatttgcctctgtcatttgatttgattcctaaaaccatccttaaaggtactcaggatatgggttggtggaagataaatgaaaaaacaataaatcaccttcttagagattaagaggatgactcaggctagcgatggcacctatgcctctcagtaatagcagttaggcccctgctaggaacaagccccctccccagcaccataggaatgatgcagaaagttcttagagactggctatgattttaggacattggcagtgtttcttcactttttttttcttgtcatgggtgcctttgtcaagctattggaactacaaatcccttctcaaaattatatttttaacagcattaaacaaaatgtccaggattaccaaagaaagctaattagatacagttgccaacacattaaaaaaaagtcgtgataaaataatgtatgtttgtctttgataactaccatcatttcaaagcagcagagaccataaacacgattttgagatgtatgcaacaacttgactaggataggaaataatctgtgagttctgttggtgacagagttccagagtgatgattattatagattattttctatattctcatcagaggaaatgctagattccagttagaggttaatgaaaagaatgatgtaaaatctgccccttcagtgatcacaaacccactgaattctatctgtaaatctctggggtccattgtcccaggtgaggctccctgtcctaatgtcctaatgtaagtgcttacttagtgagcacctattatgtgcaatcactatgataagctggggattcagctagagtataacaagaataggacatgattgtaagccctgacatatgtctaggttgtttgatgcttaatatcatggaccggatgaaaggaactcctgtttcatgtggagcctatcattaaattctgaggatggggttagtctggagttggaagcgggggtatgttacaacacactagggccaaacagtgattctcaacagtggtgtgttgataggagtgggtggagattttgacccttagagcaatacttgtcagtgttgagaaacatctttggcacaatttggtgggggtggaggtggggggttgctactgacatctaacggatggaggatagggatgctacacagcatcctacagtgcacaagacagccccctacaacaaagaatgatctggccctatgcagtagggctgaggttgagaagccgtgggctagaggaaaagtatgcagagcgctgactgcagcgcccctgtaaataacctttgtgtccctggttttgtgccctgcatccccttggaaatttgtatgtcctcctttctcattctttgaggttgcagattacattctttctccctctgtagtgcccggtgtcaggccatgcacacagcaagtgagcaattaatgttaaccatgggtaagtatggcccagctatctctctagcctgagcctggtcacaaagtattgacagaagcaacaaactcaagatgagagctctccagcagaaagctctttggagtggggaagacagaagtgatgtgcatagaggtttgaatctctgcctcctgttcagagcagtgtgagcacaatgacctatttttgttggtaagacaagtcgacttctacttggtgcagcataacttttgcctttcatataggatggatattcagtttccttatttatgtaatcttatagttgaagtagacttcaaaatggatttatgacaatgctgacatttgttaagcaaccaatatgtaggtagatttgttttatactctacattcaccccattacttagggcttatattttataatccactcccccccaccctgcttttctattgagaaccagagtgatttcttcagctaaaaaggcagctcttcttggggcaaaggataagatggacctattaccccaggcatttaaaatggcaaatgctaagctgtgtgttaagtttgagaagcacaccttgtagaccactacagtaacagaggtgtgatctcatagtttgatgtatttctttaaaattctgaattgtgcagaagttagtgacatttccttctcttcctttaaggctgctttggaccaatcctgaaatgatttttcaagttatgatcaattgccctgtgggagaatgattttagtggggtccctggatctctaaaagttctttgctctaatgaattaggaggaatgtcagcttcatccatttagtgagcttctctgtgagatgtttccatttgtcatgaaaatgtggaaggggtttttgcattgcctgagttagaaggttcagaaaaatgagcctgggcctattgatttgttagtgtccagtgtccctaaaattgggccttggggtagggttttttgagaactataaaaacagagagagagagcacttaacagacctaggtagacatcttacctttaatctcaaattaatcatacttactagcttactcttctgattttaatggaatcttcttataaaatgggcagcttctaaagattaaaagggagtctttatatgatccagagaggatttcctgagtggtgccatttatcactaacatttgtattttgctgtacaggttgaaaagctcactcacctcttatttagtcttcatgataaacctgagccttaggttggtggtggatgatgcccactttataggtacaggaactattcttagaacagttaaaaggctctacattcatatagtaagtttgttgggaaatccaagacaagagcctggatattagaatatataatattaacaacaactatgctacaatgtgtaatttaaaaaaataaacaatgagtttggagacccagattctgatattaatactactataaattaagcctatatcactgcttggtaatgtttataatcaaaatttgtgatatggaaagactgccccatcacctgcaaagatgaagtgtgtgttaggccattcttgaattactataaagaaatacctgagactgggtaatttataaaggaaaaaggtttaattggctcacagttctgtaggatgtatgagaagcatgatcctggcatctgctcagctttggggaagcctcaggaaacttacagtcatggtggaaggcagagggggagcaagcacatcccatggcaaaagcaggggcaagaggagactggggaggtgccacacacttttaaatgaccagatctcacaggaactcactgtcatgaagacagtacagggggaaaatactaaaacatttatgagaaattcaaccccatgatccaggcacctttcaccagaccctacctccaacattgaggattgcaattcaacatgagatttgggtggggacacagatccaaaccatagcaaactggcaagagccaacttggttcacttaccaaaatatggagtctgaaataccttgagaatttaagatgtaaaggaaatgcctttgttcaaattcagtaacccattgaaaacttcttatttagagaatgtttcttaatgtacaggagtccaaatatttatcttccattactaagtataaatcatacttagtttataatgagaacatgggctgggatttgtttttaaagtaagacatagtaaagaagtcactgggatctgccatccttgacatctttgacaagtaaaactgatttacatttcagcagaaagcatcatcatgccagttttgttttctacttctgccattctaatcaccaaacctcagaaaagaaataactagttttacagttgtctactcaataaaggggctgcatgcaggcaccacatttgatttggtagggaggaagtgggaggggatgggtgtctgtgtgactgaaccacaggataccttcctgacctcaaccagattttaatatcaagtcttagtgctcccacttaactagagttgggatcatagcaagtcagtaacctcactgcaccttatgagtgcaatgaagatatcaacactgcattcctagatagtcactgtggaaattaaataagacaacccatgtaaaatttatactcagatatattaagttctcgataagtgtaactatgtttatcatttaaaaaattaactctcaaaacttcagtttcctcatctgcagagggaaatgatgagagtatctaaatgttgttataatgattaaataaaatagtataggtaaagtgattggcattggagtaaatcattgttcttgttagaatcttgaatgttaccattcaaggcaacacttgaatgtatgctcatgcaaaaacaatgttaaaaaaattcttactgcccgatgacatgtcaacacgcacagacttgagcaggattgctgatagtactggggacataataaggtgataataaatgggaagaaagcaggaggaccacagaataatgagttcatgctttggaagaatatttttacaaggttatcttgcctcttgtagagggcaatggaaaaaaatccccccaggaaaatcagtaatgtcaaaaccatgaagtacttttctgcaattagaacatgtcatcagatgtaaacaagttgattggcccatgcaggcaagccatcacctttttatttgttttcaattccaagggatgataaggtagaacagctaagaggatacaaagatgcaataatctaggccagggatcttttacacaaagggccagatagtaaatattttaggtttatggaccacagggtctctgttgcagctactcaacttttccattgcagtgggaaagcagccataaacaataggtaatcaaatgaatatggctgtgttctaataaaactttacttacaaaaacaggtagtgagacaaatttggcccatgggttctagtttgccagtccctggtctaggctctggttttgagactttttcttttttttttttttttttttttttagatggagtttcactcttgttgcccaggctggagtgcaatggcacgatcttggctcactgcaacctctgcatcctgggttcaagtgactgtcctgcctcagcctcctcagtagctgggattacaggcatgtgccaccatgcccagctaattttctgtatttttagtagagatggggtttcaccatgttggccaggatggtctcaaactcctgacctcaggtgatccacccgcctcagcctcccaaaatgctgggattacaggcctgagtcaccacgcctggccctaagaccttttcatcatttagtatgtgaagtctgatagcaaatacaaatgccaaagactggaaatctaaactgtgagaggtataagagcatgggtttattcaacattaaatcttcagcatctcttatagtgcctgacacataacaggtactcaataaatgtttggatggatggatgaatggatggacagatggacaaatggatagatggacaagcaggcaaactgacactagcttatgattccctgtttctaaacaagaacatcgtcacagtcaacaataaattaacatttattgcactcttactgtgtgccatgcactattctaagtgctttgcctgtaatatctcattgatgttttacaataacctatgaggtagatactgtcatagaccattgggttttagtaataacttgttgtcctcaagttgttagttgcttaatcttaaatgacttattaaagcttatcttccctggttccttctattaatagatatttatgagaatttaaagtacatatgaaaatccctataaactctaaagtgacattcaaagattaaataattgttgtttcagccctgctctggtgagcatggacccatgaaacagtgctggatagtaagatttgacattaggtgtttataggcccaaatggctctggacgaattgggagatcttagggcacattgtgggacctaaatattactactattgttcaacattatatccttagaacctaggtgagtgcctaactcacagcaggaattaaatatatatttctttataagaaaacaaaaggagggctaaataaactaacaaacagagaaacaaataaatgagaaaatatacctgccccagccaaggaagggcaatatggtcatagatattctgagtcttaataggtcctcccagaaactgaggtatagatcactatgtaaaataatggaagatgtctaatctacttactgctgccttgaaagctgagtcattttcataatgggtcagaaagacatttttcaggacaacttggtaattcatctttatttccttgtatacacagtacattccacttaaaaagagatgctaatgtatttacattaaagcatgtggatttacagcctgggatgaaatatattcatagatagtataccttaatcctgtttagggaaatcgaagaatcaactggcatcagattagtgttgattaactgtcactcagattgacaaagcagcacaagatacacttagcaaatacccaaatcgagctaaaaagctctgcagatacgggttttgacacttgcttttttttttttttttaaaaaaaagataattggttcaacatctaagaacatactctttggcactgactaattcagtcttcatagacgctatttttttttctgtttgtagggatagaggaaaaaactattaaaggctcacaaaatgtgcttgcctctggattggtaagcaaagattgggagatactagatgcccttaaaagtgtcttataccaattcacgttagaagaacaccttttagcgtacctgtttttacaacttttgcctggtattgaaaattgactagcttctgctatcctgtggatttccatttcctattaagcaggcatttaaaattgagtcatacaggagtaatggtcactcttcaaaatggacttctttgtgagctctagggaacagttcttcctgctttagtgatgtagactgttagggacagacagtcaagacatagaagcctctaccctgtgagaaaaataatgaattatttagggtatgtctaattgcaagtgacacaaagcaaaattattctagttttttaaaaatttatttaaaaatgggaatttgtagacttatcaatcactgagaagtctagatatgaccatccctggtgcttttaacatctttctctcttgtacaggtttcctttaggcagttcttcagcagacattatctcagaaggagagacagaaacaccttcattcaggcagccatagcaatctttgaaaataactgattaaccctgcttgggtcacatgcccctagaccaaacactctttctaaggagtcagatattctgattgggcagcctagatcacattcccttctgtatcctgggggtgggggagggccaagtgagcaccagccccagtaggtttctgcaaagcaataagtgttctagtatccgaaggaaagctaaaggatgttgaataggcagagacattgtaactatcccactttcctcctttgtctcatatgcagataggacaccttattttgaagacctttctttggactttgtttcttgctaagtctggaaggcttgcattggtcagtgagatggttaaatgaagctttattttttattgacctgtcttttcttcatagctatattttctaagcctagttataccaagctagagtttgatgcctgttatgaagcattggagagaaagggaaatgggaactcaagacttacacttgccatggtttgggtttatgtaacaaagccagtgacctgcaaagtctctaccaggtttcagaggccttcattcactgaagaactgccttctgagtggcattttcccttcaaagaggccaagctcggttaaagctactatggcacgtgtacctttagaccccatggagtgtcaaacatgggtatatggagatgggggaggcatatatgatcatggagacatgtgaaatgttcattttttgcaagaaacagaatccaccccagctaggtcatgggaaaacagagtattcattgcaaggttgtgagaagacagtgcaggagcaatttatatacgttcagtcaagcattatgagatcttgcagcttctagaatcaaggtgttccctctgcctctcaggggccatgtgacttcttttttctctgatttgctttctcacattttctcatggagattacacctcttgcacatctttcaacatggctgccagccccaaacctatgtttggaagttaaaagtgtgaagtcagggactaggattctcagtaagtgttagttattattgtcaagtacctgttactcactgacgatgtgcactgtgtttagtttcagttctcaagctagaatctgattggtcaggtgtagacaggtagcaactcaaacaggactacctaggtggccctttaacagaaaagcagttgtgagtaggatgtgcataaccgaactttattattccatggtggtcttttcttgatgaagagattgatggaatctgactcataactcccaaactcatgattgaaaaagtaacatgtttagcggggagttaagaacatggcctctgcagctagatttgcctgtgtttgggtcctggtccccacaatgatgctctgtgaaacctttctgtgcttcagtttctgctataataatatcatgtactagggttgcagtgagcatgaagtatgttaactcacaaagtgctttaaaaaatgtctggcaaatagtaagcactcaatacatgtcagcagttgatatgacttttattacctaaatctggctctgagctcccacagtaatctgctaggaaattccatctccattatcactgggtcgttcaagaattgacaaagcgtacatggtgtcaagaaaacgtgggcaggcctgctgctctttggtcagttaagatcatctctgataatttcatttccctagcctgcagggtcatttaaaatgcacttactctctacttccacaccacagagagggcacagaaatctttgctgaggtgtgggccaagggtactgtcttctaggggcatgacacagccatcctttctgagagatggtcacctccctagtgataactctggtcttccaaggaccccagatctctaaatttttctaagtgttctgattcttctaaatctgtcttctcttcagctttcttccaagtcactcctctctcctctcttccccacaggacaacgagcctactctccactaaggttaggtgtttacagatggcaggaatagctattgctttaaggcagtttctgcttttgacccaatgagtaccttctgttataaaactccaatgcgtcactggggcctgttggggtggggtgggagggtgagcaccaggaagaaaagctagtggatgctgagcttaattcctgggtgatgagttgatctgtgcagcaaatcaccatggcacatgtttgcctgtgtaaccaacctgcacatccttgcacatcctgcatatgtatcctagaaattaaaataaaacttgaagaaaaaacaaaggaaaacagcaacaacaacaacaacaacaacaaacctcagttgcattttgctgagtcagagaagccagacccagaactcttatctactgaatgattctgtttatatgatttgatagaaaacacaaaaccataggagaatggtggaagccaggatttggggctcaggggatggatggaatacaaaacgggtagcatgagggaatttttggagcgataaaattgggctgtatttgcttattgtggtagatacatgacgcatgtatttgtgaaaacccacagatctattaatatgcaccacaaagagtacattttcctttatggaaacaactaaacaaacatcaaggatatgcaaagggccttcccacctgcttgaaatggagaggagaggaaaatacagaaacacaaattgatgttttaaaaaattactaagccgcagacaaagctaaagagatgggttatgtcagattgtcatattaaatagcggaacttcctggctggatgcagtggctcatgcttgtaatcccaatgctttgacggctgaggtgggaggactgcttgagcccagaagttcaagaccagcctgggcaacatggtaaaaccctctctctacaaaaaaattttaaaaattaaccaggaatggtgacatgtcccggtagtcaagctactcaagaggctgaggtgggaggattgcttgagttccagaatttgaggctgcagtcagctgtgatcacaccactgcactcagcctggatgacagaccaagaccttggccctaaaagtttttttaaaaatggggctttctgacatttatgcagccaaaagacacatgaaaaaatgcacatgatcactggccatcagagaaatgcaaatcaaaaccacaatgagataccatctgtcaccagttagaatggcgatcattaaaaagtcagggaacaacagatgctggagaggatgtggagaaatgggatcacttttacactgttggtgggactgtaaactagttcaaccattgtggaagtcagtgtggtgattcctcagggatctagaactagaaataccatttgacccagccatcccattactgggtatatacccaaaggattataaaacatactgctgtaaagacacatgcacacgtatgtttattgcagtactattcacaatagcaaagacttggaaccaagccaaatgtccaacaatgacagactggattaagaaaatgtggcacctatacaccatggaatactatgcagccataaaaaatgatgagttcatgtcctttgtaaggacatggttgaagctggaaaccatcattctcagcaaactatcacaaggacaaaaaaccaaagaccacatgttctcactcatagatgggaattgaacaatgagaacacatggacataggaaggggaacatcacacatgggggcctgttgtggggtggggggaggcgggagggatagcattaggaggtatacctaatgttaaatgacgagttaatgggtgcagcacaccaacatggcacatgtatacatatgtaacaaacctgccggttgtgcacatgtaccctaaaacttaaagtgtaataaaaaaaaaatggggctttctgttgcaggacacagggactcatcaaaggttgtaaacccagccaaaaatctgtcacactgggctttgggcagttgatttgactgcactaaactggagtgattacaggagaaaatgaagctggtagaaagctatttcactgagaccatttaactacaggcttactcgtttacttacttactacttactggaaaagaagttatccagtattgcagtggtatagctgatactaacagctcatatgtctcccctacagaagcttctttttcattcttcagtttttctggcttaagtaaaatagaattcaaaatatctgagttcctgctgcttgtctagaaaagtacaaagactcccataacagggtccttggctttaagtagcttattttgtggagaagtggagaaagcaagacatagtcaatgaagacaataaaatacatgctcatccaagacataagttaggtattatggaagcacaacacagggagcaattggtgataactgaagggaaaccagggaaggcttcatgatggaagtggcatttgacctgggccttataggatttgatgcactatggggaacaaaaggaaaggaaaagtactttctggctgagaacactgtaagcaaaggcaaggacatgggaaaacccagccccactcagcagtcagtgaaaggtacctcagtacatgagagcaaaatgtccagctaaataatcactaaaaagtgatttttaaattttggtcaactggcttactactgcctaaaagctttaagtgaagaacatggccatatggaaatgtcagtttacttctctttccttcatcttggatagaatggtattaaactttaggcagattgagcaacaaaattctcttaaggggtctcaaataaataataagtagggactgttttttctcccataaaagtaaggtgatatggtttggctgtgtccctagccaaatctcatcttgaattgtagttcccataatcaccacctgctgtgggagggacccagggggaggtaattgaatcatgagggcagttaactccatgctattcttgtgatagtgagttctcatgacatctgatggttttttaaggggcttttccccattttgctcagcacttctctctcctgccaccatgtgaagaaggacatatttgcatccccctccaccatgattgtaagtttcctgagtcctcccccaagccatgctgaaccatgagtcaattaaacctctttcctttataaattacccgatcttgggtatgtctttattagcagcatgagaacagactaattacataaggccaatggtagacagttgctggcagcttcatggtatctgagtgaacatatctgaagtccccttggtctttttctcatggtcagaagatgagatgactcaggcagctccagatatcatgctgatattcagataaaaacactgaaactagccacatccttaccctcttgtggacagtaaaactttctcagtgctcctccccagtagacagctacctacatctctttgaacaaagtcatgtcatatgtccacccctagcttcaagggagtctgggaaagtatttagctggacattttgctcccataaataatactaggattttcttggccaggggaaagggggaaatggttgttgacaaggaaatgacatgctggccatactggggatgaagtcagtggacaaggtaaaaaattacataatcaaaattatctataaatcacctataaagcatgctcattttaaagctttcgtaacaggactgtattccgaaattaaatcatttaagtgttttaatgctttgaaaccttcaattctttgtccagatttctacttgctggttcttaattttcaggtcatcatcatcttcatctctcgtaaatgattttgtaagtttctccaattattttttagacagtgtttctctgtggtcctcaattaatgtttcaatttctttcaccataggaaggcatcaccacccacttgcctggccacaggaacagcgtgttctactttttcaaagaccaggaaattcttaaaatcatacactttttttttttttattttacatctcactggtatccattgaccatgtgagtcttgattgctgtcacactgtgagagacacttgagaactgaaatctccactgaggacacagcgtatcatggctcccatctcaccctcactcccaggtggaagggcaggcagaatcaatgttctttttaacttgatcacattgttcatatttattctctccctctccctctacactactggcctgattctggccacctgtcccactgaggtctggaggggagatatggatggagagccacattcacctcattcttaggacacacagtgcatcatctttgagaaccagggggtcacccttgagcacggctctctcatgatgatgtcaagcagccttctcagcttatcgctgatgctttgtttgcctatactatccttacctagaggctgccttgttccagaattttccattagtgttaaacacaaccagtgagttgaaattgtttgttatactgtgcagttttatttactatcaaaaacgatgtactcataagaaactgaaatgaagttgcttgctgcttggatggttccttttgttttttttcaagttttggcttaatgatacactgagcatgagttccggtctattggtttccagagtagagtttgcttaattaaactacttgtctcttcatatcttgccaggatgtttttatacgtgaatcttaaattgccctgcagtttcaaattctacacaatgtttaaaatgtgtactttgatggtattgccagttcagttaaattgttagagttttcaaaagagaatgtcttattttatcattctccattgttaaccttcaaattattgaatgatactcatttatctttctggctttactgtctattcttgtcttcatcactatcttttatcataataaaatatatctaccatctattttgatatgccagacatgtatagcattttatgatatattacactttaatatatatgtaatatatctcatatatacatatgtgtatatgtgtatgtgtatatgtatgtgtgtgtatatacacacatatatagtcactaatcctcacaataggtttatgagagaagtactactattattcccatttcacaaataaggaaactgaagctagaagaagcaaattaacttgtccagtatcatattcctcttcacagtcttcatggagaaccctgaactttaacactctgttttcagcattcacatgtgtcaaaattcccagcctagatgaacccaaacatccacattatgtatgcctgtgttcaggcaactgaacacatgcacctctgtgcagcctgtgccacgcagcaggctggtgcctatataaaagtgtggttactaaccaccgctaggccttcggtatctggtacccaatatccaatacccagctacctcatggtatttctcttgtcaaaaggttgtaactcttgctatattcatttcttcaccttttgcctattcttgtgcccacaacagtctgccttcagcttttgatagaatgtctcttgagatgtgtcttccatgttgccaaattcagtagacttttctattcctctccttaatttccagcactgtttaacacagataaactgttccctccttcttgaaatacatacttctttctcttggcttctgtgttaccccattcctggtcttctttctacctctattctcatgttttttttttcattttcctttgatggctcatccttccatactcaaaatttaaatgttggagtcccttaaaattctgacattggctctccttttacttttacattactctaaccattgcttggatcatatcacccttctcttagtgtccacacttatctacctgccagtgactcccagtaatagcacttccccagcaaagccttcgcaggtcctctgatgctaggctagcccctctgctcagtgttccatcagcttcttgtactacttcatagcatttacaacagtttctcagtcctttttccaatagtgctcttctgaggaatttttcttcaggcttttttctttttcttaatcacacccctcccatgaaatcttactatcatagatatactagatatccgtttatgtactatgtgaagtgtgcatttatatagctgtttatatatctatatattgctatacatctctagatatatatatacatttgtgctttatacataaatacagtaagatttcttttgcttcccaagaaccagtttttgcccccttgaagataacatcacccccattgaaaatgcatgatttacaatatctgttatttttaaaaatggatttaaatattttttgcaatatccacctgtgttgctacaataaaacttattaagagcaaagattatcttcttactgaacattgcctcagcattgtgccattcacataataggtacttgttaactatttatagacaacaaatattacaacaggcagaatggctgtagattttatgtgcatttttaaatttttttcttaacttgcaattcctaaataagaaagccagagcctattttcccccacaaaatcatgtctgacgtaggctctacataaatatttgttgaatgaattaattttatctgtactttttggataagaagaatctgtcctgattcctaaaaagaaaatatttggtatgtatcctagaaactatttgtaatgactacagatgttttgcattagaagtttattaaatgccagcagcagcctggggagacacaatgggattaaatcacctcaagtgactatttctactgaaagttactttctagcatctgtgtattgttcatgtctgggaagattttcagaagctgacagccaccttccctgtgcttaatcctgacacttgtggaaactctgcatcctcgttgatcactcagttcattttaaatctttggttaaacataacgcaactcatttccttaaaaagaatttttcactgcctattacttttaggagaaggccacaaattcatgttaggaattaaatacaaaaatctctgtttctaaggcatttcctgtggttagttgtcccataactcactcttctacaactaacatatgtgctgtagagaagactggtttgtaggaaaatgggtctcagatattaaagagtatttaaatatcagattgtagccatgtttactagcctggacttacagagacaaaaactatatctcacatatgttggaaatctttaaacagtgggagctacatgaagatacctttagctaaaactttggagtaaccagaaaattatcttgcacagaagatagtgttcattactcaaagaattattagtttattcataatttttcaaaaatattcctggtaaatatcatgggagattaaactttcattgtcatggttcttgctccttcctaagaaaaatatagttggattcagagcagcttcctttattaagtaaaggcaatttctattgtgacttaaatatcaaatactaaaaaagctggatattatttgtggagtataaagttttaatgggcatggctggctttgagcattaatcacttggctttgactgtctatttcatctcctcccgtgggccctgtgatcatccttcagtctgcttgtccagcacatcaccagatcccattagtttttctcttaaatatttcctcagccatccactcttctctatgcttactaccaatcatatgatcccatctaccaccatctctctcctggcttctctttattcacccttgccttccttaagtgtcttttccatgacataatgtctcagtcattctgggctgctatagcagatactacagactggatgccttaaaaaacagaaatttattttttacagttctggaggctggggagtctgagatcagggtgtcagcatggtcaggtttggtggggtccttcatgttggcttgcagacatccatcatcttactgtatcttcacatggtggagaaagagcactagtctttttctcttcttctgaggatgctaatcccatcatgggcactctaccctgatgacctcatctaaacctaattatttcccaaacgccccacctcctaataccatcacattgatggctagggtttcaacatctgaattttggggggacacaaacaagtaatccataacatgcagctacagtgatctttggaaaatgccaggttgatcaagtcagatcccctgcttaaaaccttcactgtggcctctgaggctctgcaatccctgagccaaactttctctctagtctcaccacatgatattcatcttttgctaagaatggcctagcagcatcagtcttttttttttttttttttttttttccaagacggagtcttgttctgtctcccaggctagagggcagtgatgggatctcgactccctgcaattccaactcccgggttcaagcaattctcctgcctcagcctcccaagtagttgagattacaggctcatgccaccacacctggctaatttttgtatttttagtagcgacaaggtttcatcatgttggccagggtggtctcaaactcctgacgtcatgatccgcctgcctcagcctcccaaagtaatgggattacaggtgtgagccactgcgcctggcccagtcttctttattaatgggaatttcccaactgtgaagcgtttccatagtcttttctactgctacattcagctcttgactacttcagttctaattatttttcaaatatcagcaaaacttcacttctttaggaaacttatctgccaaaccaggttgtgacttcaagttttatactttcaaagacatgtttcttttctttatcactactatatattttcatttctgagattaattactaggttttttggggggttttttgtttttttttttgtttgtttttttttgaaacggagtttcacccttgttgcccaggctggagtgcaaaggtgtgatcttggctcactgcaacctccacctcccgagttcaagggattctcctgcctcagcctcccgagtagctgggattacaggaatgcaccaccacgcccggctaattttgtattttcagtagagatgggatttctccatgttggtcaggctggtttcgaactcctgacctcaggtgatccgcccaccttggccttccaaaatgctgggattacaggtgtgagccacctcgcccagccaattactagttgtttaaaccaattagtgtacactagtggaggatactatattataccgtgagcttcttacctctttgcttcaccactacagcctcctgcttgatacagatttattaagttaattgaactttgggttcaccaacatactgtgctcctcttctggtacacagagtttatctgatcagttatatctagaaaataataaaataacaggagcggaagaaaccttaaagattatgtaatccacccaaatggagaaataatactaaagggaaaattgtcaaaggccatgcaatgcatctgcaaaattagaaccgaaaatcaggtttttggtttctcagtatttgggtgtttcaagaaacaaaattatttttcttccattttcttatcaccattctctagattgacttcctttctccattttataatctaatatgggtataaaactatatccttatcttgtcaagtaaaatatcattgttattaaagttatcattcaggttatatatacccaagcaatgtgaagtagaaaactgacgtttttacctcaaaccttattcatcagatattttaactctgccttttgaatctattgaacattttgccccaaggtttaaacccaacgatgatttttagttcatattcattaatacaaaagcactaatcataattatatcaatattaatcatgttcatcaggaaaaaatttaccaaagcaaactctgttaagctagtttaaattcttaaacaattttctaaagagtacacttaagtaatttctgatttttaaaagaacgcttcttgaaattcttacttttgagatcagttcttcatgtacaagaagtgattcatcataaattttctttatcaaatttcacggatgctatttgctgtcctagtaatttttgtgtctagtgtttctcccaaatccaatttttgtgtgtcacattttgcaaatctgtatttttctttcagtatttagtccacagcaattttaacatgtatatagttttaggtaattagtcatttttcataaaatttaattttctcaggtcagtctttggagttttaaagaattacgcgtttttagggctttgatgttttagttaagtttcatttttgctctctgccattttatctattacgagatttattttctggttattatttctacctattaaatgcagtttaaattggataaaagtctgttcctttttttttttccttaaacactgagaaaatgtttcgcaatttcctttcatagtacaggattattttttcttctcattagaaaaaagaggttgctaaaggcagttatctgcttagataagattgtacacctcataaaattttagatttggggttaacagtttaactctgatgcttatccctcatttaataattggggaaatccaaaaccagagatttttatctgacttgcctaagagcatagagataggactagatttcaggtctcttgacatctgggacactttgagtcaaaagtatgacaaaactgagatctggacttgaatatcctttctggagaggagaagctggttttttattacttatggcagtggagtgcatttgagattttttttttttttttacaagtttactccctacctgtgctaggagggaaaagagcccttgagctcatctttatggtgattcagaacactttagatagatcctgtcacatgctttataagttcctgattgattctatggaattaagttattgggcagagaaccagctaatggaaacacattgatgaaatcatttttgagagacattaaattgaacttaaaataaagctgaaatggctttatggatttttcactcaaactgtttatgaacatttattgccagtaaattatattgtgtcaaaagagggaatcagtaggtatggttttaatagaaacctttttgaaataataaaattgagaataattcattatctgagaaaacagagagaggatgggatggggaaattcatcctgaaggatgtttgtctactctggagcttctgggaaagtaaacaatggtgtgaaaatcagaaacctgatagcacttggaaagaaatggcctttttgaagagtattaatatctcatctcattatagatgtgaattgttttgagaagaaaggtgattgaggatttagcaagcattacttgatggtataaacattgatatttgctcatagctcataaaaagatgagcatgtaaaggagggacttaatctgctaagggagatagtctagaggagtgatcaaaggcatcagttttagaacagaaagattagagttcaaatcccacccctccgaccccttactcagtcacccctcccacttccacctagttgtgtgaccataggaaaaatttcctgacttccctgagcctcaaagatactaatagtctccacttcatagggttattctggtgatcaaatgaaaaactagaatatccagtactgtttctagttcatagaaaatgctttaaaaatgttatttttgaaaaagtcatggaagatctggataagaaggatgaataagaatcataaacattatataatattactgctggttgctttgtgccagagatctcattcagccttccaagattcctgggagataaaggtactatcaacacactttcttttgagagagggaaactgaatatcacagaagttgaacttcatgcccaaggtcactcagctaatgagtggctttgaaatcttcccctaagaagtcttatcaatgagtttgtcctccagtatgtggaacatatggacccccactggccaaagcccagcaagaacataatcaaagggtatttggttggacaatgggagctgagtgagtgggagttgagggagcatgagcatcttgttcttcacttcctttctacatccaaagcctgtcaatcatttgccaccgctgcctgtcagaacctatctccctagattttgctggcttgccattcagtgggcaccagcttagcctggcattgagaaagcaataatttaatactcccatagaagcatcagtaccatttggaaatgagtctagtagaagccttcggaacctaaagtcaacctggctatatcccatataagaccttgtccctgcctacacagagcttaagatctggatgacagaacaccacaccattcaaaagcatgttctttgttgaatataatggagcatttctagatgttataacaatgtaagaggattacaaaaattcacacatggaagtaagatattctcccctccttacagcatcaaagtgcaccaaatgtataaaaaagaaacacctttacttcaaagtacaggatactgcctcagctaagtttaattgaaaaactaatatcttgtgcaattgtctgtgaaaaactgaggcttaaatgatttgaaaacactttgggagcagacaaatcagataattgctatctttatggctgcaaatttcgactggtgttgacaagttgtaaagataaaagcttatagcacagtcaagagctaaatgtctagattgggtttgggatcaatgttaatactcaaagtgtaaaagctctgaacttcaaatgatctcttatagtgttctattttgcttaacttttcaagataataatgtagaactttatttactgaaaaacttttgctagtcattaggcaaatacttcactgttctaccatctaacccactgcgtagatgtcatatgtgttatgtgatttgtgccatgcattgcaataagagagctttggttgctgtttttcaaaacatttccggttgggtgactattaatagtttctgagagacaagagtcagaccttaccatttctaggcatcttttcctttctgaagccgagatggaatttgcctcatggcctcactctgatctcagcaagaatgctttcaaaagaagttccttgtttttcaaaggctgtttgcatgagtgattcaatgctttcctatcatggagctctaaagccagtggaaaaatatgtgggtatggggttgtgtaatggattcgctgcatttagctccaatcagtgtgctgattgtgcctacaggtgactccagtatctccaatctctgtttgcttttctgttttgtttacaggagcggagggcacagtgttccctaaatctatagaaacacctaatgtcagggcagaccccttcaaagaactaaggtaaacttctgactttggtttgcattgattaatggctattgccttgctctgtgcaactggccagtgattcattctgaataaataataagtgtcacagcgtgaatacataaattgaaagaggttggagagaaccagaagataagctacaaccaaaagaaaattttctatgagaacttaaaattgaggatctggatggggtaaaaggttgcccactttgtgaaatctagattcattcatttggaatgtttgttatgtgctgtattttgtggtacccaaaacctatccagttagagaactagttggtaattggtgctgatcagcccaaagaaaaatgatatctaaaagaagatgaagtctaaatacaatacgatgtcttattatgcaacaagctctctattacttggggtggtatggtactagaaagaacccccttctgcagatgttccaggtgctgatgttaatcttcaaatattcataaatgtgctgccttagcagaggatgactctgagatgctatgtactcaccaccagcaactaaggaaaacacaaaagaacagacagatggataaacagacagagagcctgaaaaccattccagccaccaaacaaccatgcccctgtccctcccgccaaaatgtatttaaaatggtacgttgaaacaaatagaactattctttctattgcttcaagttattcatcataactgtgatgaattcagtgaatactggcttttttttttcatttctggtagttcttttacctaaaagcaatcataaatcgccatatatggcactgaataactgtttcatgatagacaccaaccataggcacatgtacttgcattgcacaaatcatatctactctttcctgatgcaatctgaagatctatgctttgcttaaaaagcaagagccatattggacctagtgtttcttttaacagaagcacattctcagtaagtggaaaatgtatcacctcattataaaacccatagcattttttgcaaagcctataagtctggatggctgtaaggaaataaattgggccaaaggaagaggatagttggtggagaatgagaatcttttcataacaaaatcccacatagagtgggctgtatttttaagattacacatcacaccacaaggttctactttttactagcataactatcttcagcagagcttccacatgcctgaacttacctgattttctgttagctagttcctatgtttcatataaggtactgaagctagaatcttttaagcaaatacgtctgagaaaacctgctttttaggactctatgagaaagagttattgcctgagagtgcagtgaaccttcgtgtctgtgatggaagaggtcttttgagacaagctaatcagtggcctggttcccattcttttcacagtcctctgtagaagcacgtttcttacagaactagtcagtaattagtgatgattagccccaagaaaaagtgctgtctaaaagaagcaggactcccatcaacaaatgggcgaaggatatgaacagataattctcaaaagaagacatttatgcagccagaagacacatgaaaaagtgctcatcatcactggccatcagagaaatgcaaatcaaaaccacaatgagataccatctcacaccagttagagtggcgatcattaaaaagtcagggaacaacagatgctggagaggatgtggagaaataggaacacttttacagtgttggtgggattgtaagctatttcaaccattgtggaagtcagtgtggcgattcctcagggatctagaactggaaataccatttgacccagccatcccattactgggtatatacccaaaggattataaatcatgctgctataaagacacatgcacacatatatttattgcagcactattcataatagcaaagacttggaaccaagccaaatgtccaacaatgatagactggattaagaaaatgtggtacatatacaccatggaatactatgcagccataaaaaatgatgagttcatgtcctttgtagggacatggatgaaactggaaaccatcattctcagcaaactatcacaaggtcaaaaaaccaaacaccgcatgttctcactcataggtgggaattgaacaatgagatcacatggacacaggaaggggaacatcacacacgggggcctgttgtggggtggggggagaggggagggatagcattaggagatatacctaatgttaaatgacgagttaatgggtgcagcacaccaacatggcacatgtatacatatgtaacaaacctgcacgttgtgcacatgtaccctaaaatttgaagtataataataattttttttttaaaaagcaggactctaaatacagtacagatattttttctatggaacaaagcttttcattacctgggagatttgggaaatataagaggaaaggagataggctgtcttggctttaagcggtaaagtaaatcttctgtacttaaaaacaaacccaacccaaaccaatgaaacaaaaagacaactctccaagcattagcccactctagagatgcatagcctgaagaacatggagcagagtatttgcacatgttatgctgagacataatcgtagtgtttgttacacaacttataaacaaccctgaaacttacctttaaaaagttaaacctccacaatttacaagtaaatctcctaagtccagtgcaacaaaataaataaatactttgtgtagttggtttatttactgtgcttcttcaaaagttataggtatgtcccacagaggctagaaagcatgaattttttttaataatttcaactttcattttagattcagggatacacacgcaggtttgttacatgagtatgttgcatgatgctgaggtttggagtacgaatgatccgtcacccaggtagtaagagtaatacccaataggtagtttttcagccctttgtcttttctctctcctcatctactagtccctcagtgtcttttgttcccatcttcatattcatgtgtatccagtgctcagctcccacttattagtgaaaatgtgcagtatttggttttctgttcctgtgttaacttaagataatggccttcagttatattcatgttgctgcagaggacatgattttgttagttttttatggctttgtagtgttctatggtatatatgtaccacattttctttctccaatccatcattgacagatacctaggttgatttttgtgtcttagtgttgtatattgcaatgaatatacaagtgcctatgtcattttgatagaacaatttatttccctttgggtatatacccagtaatgggattgctcggtcagttagtaattgcgttgtcagttctttgagacatctccaaataatggctgaactaatttacattcccaccagcggtgtataagtgttcctttactccacagtctcaccaacatctgttgtttcttgactttttaataatagtcattctgactgatgtgagatagtatctcattgtgattttgatttgtggtgtgcagcatttttcatgttttttggccatgtgtatgccttcttttgagaagtgtccttttatttcttttgcccactttttaatggggttgttttttgcttgttgaattaagttccttatagataacatatctttgtcagatattagacctttgttgggtgcatagtttgataatattttcttccattttgtagactgtttatcctgttgatagtttcttttgctgtgcagaacctctttagtttaaggaggtccctcttgtcaattttggttttgatgcaattgcttttgaggacttagtcataaactctttcccaaggcctatgtccagaatagtatttctgaggttttcatctagaattcttatagtttgaggtcttctatttaaatatttaatccatctttagttaattcttaaatatagggaaaggtaggagtccagttttattcttctgcatgtgattagccagatatcccagcaccatttattgaatagggaatcctttccacatgcttatttttgttgactttgtcaaagattaaatagctataggtatgagactatttctggtttctctattctgttccattggtctacatgtctatttctctatgaatcccatgctgttttagttactgtagccttaaagtacactttgaagctgagtaatgtgatagctctggagtttttctttttgcttaggattgctttgggctcttttttggttccatatgaattttagaattttttttttctaattctgtgaaaaaataacattggtagtttttagattacattgggcagtaagaccattttaacaatattgattctttcattgattgattccatgagcatggaatgttttcccatttgttgtgtcaactatgatttgtttcagttgtgttttatagttctccttgtagagatcttcttcttccttggttagatgtattcctagttattttattttttgtgtggggttgctttcttgatttgggctctcagcatgaatattactcgtgtatagaaatgctattgatttttgtacaatgattttatttatctttattgaagtcatttcagtcctaggagccttttggtagagtctttagggttttctagctatagaatcatattgttggactgggtgtggtggcttacacctgtaatcccaatgttttgggaggccaaggctggaggatcacttgagcccaggagtctgagacaagcctggacaacatagtgaaaccctgtctctaccaaaagaaaaaaaaagttaatagccagatgtggtagtgatgcatgtctacagtcccagctgcttgggatgctaaggcatgaggatggcttgagcccaggaatttgaggttgcagttagctgtgatcacaccactgctctctagcctggtggcagagcaggaccctatctttctctctctcatatacacacatacacacacacatacacagaatcatattgttaaccaagagagataatttgacttcttttctttttatttatttctcttgcctgattgctgcggcaaagacttcagtactgtgttgaatagaagtgataaaagtaggcatccttgcctcattccacttcttgaggggaatgtttccagcttttgcccattcagtatgatgttggctgtgtgtttgtcacagatggctcttatatttggggggtatgttcttttgatgcctagttttttgggttttttttgagggtttttctcatacagggatgttggattttattgaatgctttttctatatctcttgagatgatcatatggtttttgtttttcattctgtttatacgatggatcacatttattgatttgcatatgttgaactatccttgcatcccaggaataaaggctatttaatcatggtaaattaactttttgatgtgctgtgggattttgtctgctagtatttttttgaggatttttgcatgtgtgttcatcagggatattaacctgcagatttcttttttgttttgtctttgtgaggttttgatattcgggtgatgctggcttcctagaacaaattaaggaggagtccttcctcctcggttttttggaataatttcagtagaattggtaacagctcttctttgtacatctggtagaatttggctgtgaatccatctggcctggggctttttttgttaataggtttttattactgattcagtttcagaacttgatattcattcttttcggggtttcaacttcttcctgattcaaccttgggaggttgtgtatttccatgaatttatccatttcctctagatttcctagtttgtgtgcatagaggtgttcataatagtctttgaggatcttttgtatttctgtggggtagcttgtaatgtcacctttgtcatgaaaacataaaaatattttcttacgtaattctaaagcttgctttttttttttttttgcccctgttgttcaaactgtggtagcccggactgagtcagggacctagaatgtcataatctacctccttcatccttttgaaattttttaaaatggtgttttataggagtatctctgaccaattgaaaagatgaccaattattgatagattagcccagaccagtgtgtctgtgaatgttttatatttgtcatttcatggtgccacatattactccatgctattgattgctattgaccttggatattgtgtaaattgttaatgaacttggtgactgactcttctggtctctgactttagcactgggccagtcttacttggccacattcacactgctatgtcttctagatttaagaaaatagagtaatttaagtgaggttcctggacttgtactagcaaacagagctagacagactcttgaggtgaagcaaaagtggtccattcttcagtggtagcaaaatggagggaaaagagcactgtgctaagagttgggcgcctaatgccaacccactgtaggggccaagggaaagcttccctttcactatctgcagattcactaaaaatcaactgacagcaggcagattgatggcagaaaaggcataataaaaattttactttaatatgtatagcacaaggggattataggagaacaattacccaataacccaatgaggtacagatgcttatatgcctttcttcacaggggaggggagatgaggaaaatgtagcacttgtggagtagtaaatgattttagggcaaaataaatggacctggggaacatagaatggtctgggagaaagtttgttgggcctgcagagcagataatgtctgccaaatgattctctttggaatactgaatgggactgaaacagaaaacagtggtttgtgacagaaattggtccaggtgtgttgccatacttaggtctttcttccttcagtatgagtcattaataaaaactcagggaaggaaccaatggtaattgtttttttctttcctttgggggggtccaaactttaggcagataagggaacttcagaaaatagcttcttccagactctctgctggtctccaaaggccttaaatttaaaatagcaagccagggtgtcatattttgaggtattagtttctgagtcctaatatccctatgtggccttgagctaattgtggagccctgctgtctgtgaaaaggcagggcacttctagctctaaacagctaatcctgttatattattttgactcttggtttcaaaataattttaaagttaaaaaagagttataaaatttatacagataattctcatctgccttcacctaattttctccaaagttaacatcttacatatctgtggtatagttaccacaactaagaaattaacattgtagtcctgtaatatcatgctttacatgagatttatttcaaggaatgaaatcacctgaataacttatagatttaaaaatatgtaaaaaggactttaacagaaaagctatttgttaagaggtgaatttatagatctttaaaattctcactgcagttaagttggaatgttatttttgagggttttttttctttaatattctatacccagattttcttggtcttacttgtcaataatggaaaacaaatggattcaaaagaccacaacttatttagacacagactgtcttttaaaatagacaagcagaaacttaaatatacatgttccttacctaatcaaacatgagaaaattacatctatttcaaaacgcttctccattgagtaacatttgttttcctcaaacctctgtcttggctgctagaggttttctgtttgttcttattttgttgttgtttgcttgtttgttaacgaaaaccagatttaaggcctctggcatttcttcctagaagatgtcagttaaaggagaggtagcttcctctttgctacagttttggttcattgcctttttttggtttgttttcagagttactatatttactgtatttgcagtctttggttaagatgcttgtaaataatccagagttgagctcaaattttcaaaaaaacaaaatgcttttctccagacaaataatgagtgttacaaaggtctatgccaaatatccatctcaagtaatgtttattgactttattcttgcaaggtaattctgaagtaaagatactttgttctggattccagactatacttgaaattataccaggcactgtaaccatcccttgaaataagaaaaattcatcttgaattgaaatcgtattttaataaattcatgatcttaaactatgaatatcttaaatgttcacttattcactgtttttttttccctcctgaagtctatataaagacaaatggaaaaatcactgatctcaggctgttcatgatctgaaacaggaaataggccattcagttttgcatatgtattttccataggaacagaggcttcctttgaatgccttccttgctctaaagattcctttcaactgtaaagtttccttgtaggattctgatcctacgagaataggaagtagacggtaaaatcttctttctcaggtacatgccacggcaaatgttaaaaaagagagaaagttatatagactacccaaagcttggagggaaccatgaaatatcaagtcaaaatgtctttataaaagaattcttcatgttcacagtcagctaatatgctgatgtgctcttacgttacataaaattatttaaataaagtaatttttaaaaacccacttggaatgcagagataaaatgaaaactcaaataattgatagttaaagggaatacaacagaaatgtcaccgcccaatacaataccgtgtgataattaatatggagatatgaaccaagccagagaataatggagaattacaaaatctacttagaagcgtttaggtaaagttgcccaaaggagatggcgttttgattgaaagaagagagaagagagaaaaggtaaaaaccaacaaataggtcttataattcaaaaggaatggttctctggggccatttagcatgggagcaaacagcccaacatatttctgtaactcctcaaaatgttactgggtatttacaaaaattgatttttgtaatgtaattttcctcataacaattgtattctttaaaaaattgtatgatggcaatttcagatatggttgcaggaaactttaaagattgttacaaattttaaaaatcagtgcactacttaatttagaactaaaaatttcactaatctcaaatctattgaaaagagcttgaaataaataaggtattactctgttactgtttatttttccccataatgctaccaggttttaatgacaaagcagaaagattctacgatacatctattactcccactattatgcacttgaacatcctgtagggtttctttttgttgttgttgttttgttttgttttaatagaaacatagtaaatctgaactcctttgggaatgtgtgagatttaaagtctgtgtgtatcattgggaaacaaggattagacaaggcttgcacaagttgacaaaaatgaatttatttctttaattttatgttaggatgtctataaccaactaaatatttataggctttctgtgatttataaatttaaactatcaaaacagtctattagagccttaggggtgaattaattagaggcttggtaattctccgcacaccactgacagttacagtaccaaaatattggataaatagtctgactttttttttttcctctctcttttattttattttattattattatacattaagttttagggtacatgtgcacaatgtgcaggtttgttacatatgtatacatgtgccatgttggtgtgctgcacccattaactggtcatttagcattaggtatatctcctaatgctatccctcccccctccccccaccccacagtagtccccggagtgtgatgttccccttcctgtgtccatgtgttctcattaaaaacatacaggttgaggccaggtgtggggtggctcatgcctatgatcccagcactttgggaggctgaggcaggaggatcacctgagctcaggagttccagatcagcctggccaccatggtgaaaccccatctctactaaaaatacaaaaattagctgggtgtggtggtgcatgccggtaatcccagctagttgggaggctgaggcaggagaatcacttgaactaggaggcggaggttgcagttgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtcttggcatcatagacaatgtaaaggattaagtgctgtgcttttggatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacaggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaaccctgagttgacacagcacacgtttcagagagcacggggtttggggtaaggtcatagattaacagaatctcaaggcagaagaatttttcttagcacataacaaaatggagtctcctatgtctacttctttctacacagacacagtaacaatttgatctctcttgcttttccccacatttcccccttttcttttcgacaaaaccgccatcatcatcatggcccgttctcgatggtcgctgtctcttcggagctgttgggtacacctgcagactaacaacagacaaaacaggcacacaaggattaatatgagatttataatcgtagtacttccaatggtcttaacccaagtgacagggttaagatttgcgaggccatcagcaactcctgcaattgcctcagttcctggcaccaaatttaaatgggcttttgatgcttcgaaaatttgttcttttaatttggaaatgtctaaagtgagattatcttctcttccctgtagatggcgtctaaccatgtcccagtgatgctcagactcattataaatttggggtgtaatacaaaaatctgacgtattccagtcacattgtaactggaaacgatgttctaagctcatgagtctgtctcccatccaaatgacagtttgtctaagatcattaatttgatttgccaatttttgatcaatactagattgtgaattccacaatcttgtagaattcttttgccaatcattaacaaagtttactgactgaacagaagagtgcaatgcaactcctgctacagcagccgtagctgtgactgcaattaatcccataatcactgcaattaaagtaaaaatgaatcttttggatctatttaaaacaccttttaatacttcagtcaaaatatggacggatggtgaggcctcccacggtcggtccatggacacagggatccacacgccctctcttgctctcaccagcagaatacggtgttgccaattaaaagttgaatcaatgcaagtaagcaatctacaattttcacaggttatagtctgggagtctggtttaataactatatttcctacaactagcatataagggggctttacgcaactttgtaaaggaactgttagactggaatttaggtcgacagtataaaatggcttacaatctcttgtttctaaagtttgatttccagaccaaattctaatgtggtgtgaggccacagtaagcctccataattctggatgttcaggaccagaaacaggacttactatttttggtcttggggtagagattcctttttctccccattcccaagggtagaaagactgcaattttttatgcttatgtttgtctaaactttctgttaagtcgctatcaacagctggactcacttgtgcacttggacacgactgagtttgtcctgagcaattgtggtagaattgacctcgaggtgcccaatctataatagttccaaattcattgttttataatatcaccgcactattggccacacattcttcccaaactaaaacttctgtattttttgattctttgggaatttccttggggcaaggtttccctttaggtctaaattttaatgatctttgataagaaaagtcttgtaaataatttacccgtggcctgagtgacatcccgcttaccatgtgataagtgaatctactgatgggactgacagtaggtacttctaccaaccaattttggactgcaggcattaaacatcctggtgctctccctaggcaaataggaggataacgatacccaatggaaatatttatcatcatcccttcttcctcaggtttggcagggcagcgatcatctatggggccaggtacccatacactatcattaacatatacttctataggattatccatccatgtgactggtgttaccatctccgtggaggcccttttctttgcatctccgatgggttcattgtagaacttcaaatgtctagtgggtaaccaaacaggaagctgattttctcctggtgaaacacaagcaaaacctctcccccacgttatcaccttccctatttcccatgtcttatttttattatctttccaccaaattagttttccttcatgtgggctgttctttttaccagtaagatgttgttctgcagaagtagtagtctgatttctataaatgtttaaaaaatttaaagtatagagtgctagattaagttgcatctgaggagtggtacactccttactgtctcccccttctttttgtttaactaattgagttttgagtgttctattagttctttcaactatggcctgtccttgggaattataaggaattcctgttgtatgtgaaattttccactgacttaagaatttttggaaagctttactacaatatcctggtccattgtcagttttgattttttctggaactcccattacagcaaaacaagacaataaatgttttttaacatgggaagtactttctcctgtttggcaagttgcccatatgaaatgtgaataagtatcaactgttacatgaacatatgataatcttccaaatgaaggtacatgcgtgacatccatttgccataatgcattaggacacagacctctgggattaactcctgcctcttgagtgggcaggtgtaagacttgacactgggtgcaatgttgtacaatatcttttgcctgtttccatgtgacatcaaatttgttttttaatcctgctgcatttacatgagtcaaagcatgaagttcttgtgcttttatgagtgcagatgataccagtaagtcagcttgttcatttgctttagtcaaaggccctggtaaattagtgtgtgctcgaatatgagtaatataaaatgggaaatttctttttcttacagtttgttgtaataaattgaatagctggtttaactgatcatccatgctatatttaattagagctgtctcaacatcccttgtagcctgtactacatatgcagaatctgatataatattgataggttggtcaaaatcttgtaacactgtaatgactgcaaccaactctgctctttgagccgattgatatggagttttgattactcgttctttcggccctgtgtaagctgcttttccattgctggaaccatcagtaaatactgttagagcattttctaaaggttcacgtctggtaattttaggtagaatccaagtagtcaattttaagaactggaagatctttgtttttgggtaatgattatcaataagtcccacaaaattagcaagaccaatctgccatgcaccagaattgataaaggcttgtctaacttgttccttggttaaagggacaactattttgtctgggtcatttccacataattttgttattcgtaatcttgtctgaccgattaatgtagctatttgatccaagtacaatgtaaaagtcttaactgtactgtgaggaaggaatgaccactccacaagatcagtattttgaataatgatgcctgttggagaatgtgcagtggcaaaaataaaaagttggagtggggctaagggatctattctatttatttgcgctgactgaattttttcttccactaatttaatttcttttgttgcctctggggttaatattctttgactatttaagtctgagtctcctcttaagatagagaacaaatttgacatggcataagtaggaatgcctagagttggccgaatccaattaatatctcctagtaatttttgaaaatcatttagtgtttttaatgtgtcttttcttatttctattttttgtggcttaatttttctattttctatctgcatccctaaataatgaaaaggagtagaggtttggatcttatcagatgctattgccagtccagcattggcaacctctgcttgcagaaatgtataacagtcaattaatttatctttcgtttctgcagcacataaaatatcatcaatataatgaataatataacagtctgaaaacttttctctcactggttgaagagctcgacctacaaaagtctgacaaatagttggactattaagcattccctgaggtaacactttccactgaaacctggtggctggttctttattatttatggctggtatagtaaaggcaaatttttcacaatcctgctctgccagagggatggtaaaaaagcaatcctttagatcaattataattaaaggccaatcttttgggatcatggccggagagggcaacccgggttggagaggccccatgggttgaattacggcgtttacagcccttaagtcagttaacatacgccatttgcctgatttcttctgaattacaaacacaggagaattccaaggtgagaacgaaggctcaatgtgacccttttctaactgttcatttgctaataaatgtaaagcctccagtttttgttttggtagcggccactgatttacccacaccggtttttctgttttccaagttagtggtatgggtttaggaggctctacagtgaccgcccctaaaaaggataccctattccttctctttcttgatttattttagcctcaactggaactttaatgccatcttcatttttccctagtccctttcctggtatatatcccatcttggtcatgattttttgactcgtggggctatataatggagcgggcatggtgatttccgcaccccattgttgtaataaatctcgaccccacagattaagaggaattgaagtaatcattggctgaacagtactttcttgattatctggccctaagcaatgtaaaatctccatactttgatacacttctgaggctgtgcctatgccgacaagtcctgtaacagccttttgtttaggccaattttttggccactgatttaaagcaatgatagagacatctgctccagtgtctaccaacccttcaaactgttttccttgaataatggccttacacacaggtctgttctctgagacctgacttgcccaatatgcagcctttcctgttggatcagtgcttacaagccctcctattctttttatttcactatttccacccttaatatatggcaggagtaataattgagcaatcctgtctcttggactggcactccaaggaattgaagagctaataaccaattgaatttcgcctttatagtctgaatcaaccacactagtatgaatttgaactccttttagatttagacttgatcttcccaagattagtcctacagtcccctcaggcagtgggccatatacccctgtagggattttttgtgggggctcccctggaagcagagagactgcttgtatagtacataaatctactgctgcactgccgcttgtggtgagggacaattgttgtattgtggtaactggcttattccctgaaacacttgggacagtaggggttgttgtccctgaaaaccctgaggaacaaatggctgaattgggaatgccccagtttgttgtggggcctgaggctggcccctttgctcgtttcccgacaatggttgcccatttttatcaaatttagaacgacattgactagcccaatgttttccttttttacatcttggacataagtcaggtggctctctacctgttgtagttgcttgaatagttatattctgtttgtttaagactgggcaattcttttttaagtgaccaatttgaccacaattataacattttcctccaaatgttctaacttgtcctcctaaaacaactcctgttattgcttgagccataagcatagctttatgcatagctcctccgattccatcacaggcttttacatattctgagattacatctgatcctgcaggaacctttccttttaatggcttaatggctgattgacactcaggattggcgttttcatatgccatcaactccactatgaccttaccggctttttcatcggcaattgacttttgagcaacatcttggagccttgccacaaaatcagggtagggctcttttgaaccttgtcttactgtattaaatgaggggcaggtacttcctgggtcttggattttttcccaggctctaaggcagatagctctaacttgctcaatggcctcattttgcattaatgcttgttgactaatagtactccaattttgacctattcctaatagttgatctgcatctatgttaactggaggattggcagccctatttcttcggacctgttcttgtaccccatcaatccaccaagtcttaaattgtaaaaattgagagggtgagagagacgattttgccagaatctcccaatcataaggaatgagtctatgtccataagcaatggaatctaataatgtcctcatataaggggagttgggtccatactgttttactccctctttcatatcttttagcatttttatcgaaaaagacttgtatctggcctcaactgtgggaggctctccctcttgggctccttctccaggtggcatcggttctaacgttactgggaattgccatgcctcagtatctccttcctttcttgatttatcaataatttcatgtaattcactaccctgtctactaggtggtgccataggattaagtctcctagtgggcggctgatggtatggcgccctgccctgtggtgctgggggcattcctggatatccatactgactttctgggggtggccgatactgaagttcagccggcggccagtattgataggctactggcggttgggtcttattttctttaacctgcttttgaggttgtaatcttacgggcacctgacctgctggaagaggacttgtgcctcgtggtttagactctgatggccccattaattctggaccttttccttctaattttaacgtttcaggatatatcacctcctgtaattgattatagtcaacattttgcgttgactgagccattaccggctctgctacatattcgcaatgtaaactttcggtttctttctgggattttttccttgtgttttcattacaatctattaaacagcttccaggggcatcagaaactgaaatgctatcttcttctgtttgaaatggttctaaagctgctttaataatggcccaatcattccatactgtaagtggaatgatattacccttcctacctgcttgttttagttccttaccaattcttttccaatcttttagatctaaagttccttgttctggaaaccatgggcaaaattgttctattatttgaaatagcttgattagattttttgtagatactttaactccccctctttttaaaagaattttaataaagctgagataagaggcatatttacttttaattttacttttagtttgccccattatcaccctagcttcttccgagcgcgcaagcttaccgtaaggctgactgtagatgtactcgggatctctcgtcgacttgtcctcaatgaccacgctcgagcgtaccttcaccctagagaaaagcctccacgttgggcaccagatgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatctgtgggtgtttctcaaagagggggatgtgtcagggtcacaagacaattgtagggagagggtcagcagacaaacacgtgaacaaaggtcttggcatcatagacaatgtaaaggattaagtgctgtgcttttggatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacaggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagcacatcctgcaccgcccttaatccattcaaccctgagttgacacagcacacgtttcagagagcacggggttgggggtaaggtcatagattaacagaatctcaaggcagaagaatttttcttagcacataacaaaatggagtctcctatgtctacttctttctacacagacacagtaacaatttgatctctcttgcttttccccacagcagtgagttgagatcatgccactgcaccccagcctgggtgacagagtgactttgtctcaaaaactaataataaataaaaattaaaattaaaaaaccatgcaggttgggtgtcccaaatccaaaaatccaaaatccaaaatgctctaaaattgaaaactttttgaggactgacataaagctcaaaggaaatactcattggagcatttcaaatttcagattttcagatttggggtgctcaacctgtaatgcaggtatttcaaaatctggaaaaatccataattcaaaacacttctggtcccttatttcagataaaggatcctcattctgtataaacatatatattgaaagtgagaaagacacatacaaagagacagagagacagacagacacaaggaggagtgtatattgagcttcttagctgtaggtacttggtatgtggggcagtatgactgataccattgtggaagaaatccgtaaattttctcccttttgaacagtttgcaaacatgttctgtaattgtcttcctctctacttctctccctttccccacacaccccagcaatccatgtacttaaagtttttagctttgttttgcatttataggattaataattatttggtcataagcacaaatactgaagtgattacaggagaagtagaaaactatagcggaccaaataacagcatagttattcaagggccttacaaagtagaattgtgaacagcatccatgttggtcagtagtctgtactctgaaggcatcctgccctgggtttgaatttggcctaaatgcctatccgctttgtgaatttgggcaagtctcttaagctctcctagtcctaatgcctagaacacaggacgagttctgaacataacctcaacaaatattagttttttggaggaaaaggcaaacagctgtctttcatcagggctcaagaactcagacaggaattctgagagcttaaaatgtcatcaaccagtacaaagtttgtatcaaatcatggtaaccaaaaattctctttcaattaagaacaaaataactactgtgcttacatttactattaacaacatgcacataggaaaggatatttcaactaacagagttcacgtaaccttagaataacacacagttccataaatcagatccattgaactatgtgaacatattaacgtgtcattatgttgcctctattttttcattttgcccaaaacccaagtgacttcatcacaactgtcctcactgcatgttgtgtagtacctgcccagaaaacaggagggtccaagagccacagactaaggcatgatatgatcctcttgattttaaggtcatcctgtttgaattcctcaaactgacatgcagttgtctctctttcaagactagttaacccaaatatttatgtagcttttctccttttctttcctttcctcttgtatcccaacattcttccttccccttttccctattagtatcgtactatagtttgaatttaactacatatttcatttttctcccttatccccagtatttctccaggatgccttttcgttctggagttctcttagagtgtagaaggcaaaaaaatggagcaaaataacagtgatgcttcaatatttgagccatttccatcttctcccttgatatatttatctaaaactcttttacaaatgtgacagaaattatattttgaacaaattaaacctatgtgttgtatattcatcttctctatacattatagctcttccattagagaccagggaaggatacacagcaaataacatcaaaggggaaaatgaggcaaggatatagggaagttcattcagaaagcaggaagaagttgaaagcccatctcttctgttatctggtggagtgtaggaagaagatgggacatataggaaaagcaaggggtgaaatgtatgccctgatgatgtctctcctctgagtcatggaggagggaagccagttagatagggcttaaggaaagtcgaaagcaaagggtcattgcatattttcaattgagactctaagaggaggccaattgcaaggtggtcccataccagctggattgttaagtggctggagcggaaaaaagggcctgggtcagcactcttgaatctccttcaactcctagaggaagggtgaatggtttgtcaaatggcccacatggggtcctgtcaaggaatgctaatggacaactggtggtgaaggcctctagagagacatcctgcaatacggccgaaagttcaaagtagatagtccagcttgtgggtggagtgggaggcatacccagacctcatggtctacccacaccattcgcagctgatcgtcagtgggcactgagtgggtccagagatcccaccaccaaatccaccgcagacttcagcacagcctgttagccagacactagatgctgattaaacgtacatttcctggaatctgaattttccttattcttgtcatcaggaggtcacataagccccctcccctctatcttgataatgatatccttaagaaggaaaggaaatttgaaagactggttatttatcttaaagaataaatgtaaacttttggatcacagagaggttgacaaaataaactcaatttaatttttccccacaatccataaggataagcagtttgaaagaaaaagtaattcaggtaagcacaataaggaaatgctgtttgctttgcatggataaagatgatttgtcaaatgaccagccttcaagacagggtattatgccagtcataaagtatcttatgtgacttcattgagctttaaaggccataattcttctcctcagtatcatgtaggaagcacaaatatgatcaaaggaaaaatgaaacactttcagaatccattgttaggcacctgctattcatgatttccatttctctgtaggccttgaaccaggattgattgtaactgtgatccataactgatgctctaaacatcctccccaaaagcagtcctagattttttttaatcttttaaatttaagtaggtattgggggaaatgtcttgagtaccaaaacgtttcacaagccactctcaaaatcatgactagacattactagaccatctatgaaagctggagctattagcgatgtgcagtgattgtccccatcacgaccagcccgttttcacctgaatttgagaggggcaatgtgactacatcattctcatcattcccagacaagtggattttacttaaaaattaaaattatatcatctagattaattttaatgtaaaggattaaaatatgaaaaaacccaaaaagataaaaatcataatgagagggtataaaattgtgcttttatccatgtggtcaggacggacatgacattttaaaaataaatgataatctctcagctttttagagcagaatgggcaagcgtgtttatttcccgaaattcctaagttgtggccattttcttcctcaaatagagtaatgtgattttattattgtttttaacttgattaaaatgtcagccactgtcatttattatggaaagtgtgtggggtatattctgttattcttcaccaatacgcaattgctttcgactcttcctttttttcccctcagtgggatgcccctgctgggtgtatagacagaaaatcttgcttaattacccctttcatgatcctggcttgaagccagccttgttttattccacttataaccttttcaaaacaaagagtaatgggagtttagaggaacaagcttacaacagtttttacctgaaataagttgagaaccagaaagtacattttttaaaaatatcagccaaaggggttcttattttttcctcaatccagaactttccatggtttattagactataatatgaatgagagtaagacgatcagatctcagggaaaactagataagcctgtctaatttcctggccatgggctatgtgccatgttgggctagatgtccttccttgtttgctgtccttcagtggctgtcactaacttgaaggtaaaatttcaaagcaatagcattcatatacaatcttagccattggtcgagtcatctcccattaccctttccccctcctttcaccttttcttagttgtatttcttcctctgccctttccctattttccattccttccactaagcatgtaattcctgctgtcatattttaatttccaatgttctttacactatggtggtttccttttatagcatcctgtattaatttcatagagatactgtcttcttttttctttttgagtctattaataatagtttctctcaagtttcttctgttttccacattaaaaaaaaaagaaagaaagaaagaaaaattcaggtctctggctttccaattggagctttatcaaatggttggtgattcatggatatctattgattcttttttttttttttttttgagacagagtctcgctctgtcacccaggctggagtgcagtggctcaattttggctcactgcaacctctgcctcctgggttcaagtgattctcccgcctcagcctcctgagtagctgtgattacaagctcacaccactacacctggctaatttttgtattttttaggagagaaggggtttcaccatgttggtcaggctggtctcgaactctggacctcaggtgatccacccacctcggcctcccaaagtgctgggattacaggcatgagccactgtgcctggccctattcatttttaagaatgaagcagtaagagtctgctggaaagttttgtgtacatagatgggacttattgggtggcaggcttctaggtagaagcatgagctgggatttttaggtggatgctttgtgtcagtgcattttgcattgtcataaaggaatacctgagattgagtaatttataaagaaaagagggtcatttggctcacagttccacatgctgtgtaagaagcatggcactggcatctgctaggcttcttgtgaagcctcaggaagcttttacctgtggcagaagacaagaggagccagcatgtcacatggcaagagaaagggaataagaaagagacaccgggctctttaaaacaaccagctcccatgtgaaataatagagtgagaactccactgtgaaggcacagtagagtttatttattagggacctgcccccatgacccaaacacctcctctaggccctgcctccatcactgggagccacattttaatataaatttgaaaaggataaatatccaaagtatatcagaccccaaatgtcagaatctgtaggtattttctcttgggctggtcattttccccagagagaaatcctaatcccttgcttgggatacatctggttgtcaatattgttcatattggagtgttggaggtttcactcttaaatatgtaagttttcatataattccatttttagtccagcactgttaccctcagctgtcctggtatcacagattccagagttaacctcaagtcttaaacagtaagggtggtctggttgccaggatgtacatagtgaagaaacagtctctaggggtcttatggtttctcacagagacctaaacaaatcttcctgagtgcagccccaccagatgctcccagccacagaggtgcctggtagctctgattcctgggcctggccatgaatttacagcttgaatcaacccacagctctgtcttcaccaaacccacaggctcttagcttttagcttcccgtcatctgccaaggaaattactatttgttgcttgcttttcaacttccaaagcattgttgacatgtttcttctgttcttacttcttctctctcccttcgtcccttcatccttatgggtttgggtcattttagggtccatttatagccattgtatgagtgtttcaggaaagagcagaggtagacaaaggtgttcagttcagcgtttaatcagaagtcctctgtcccctgtccgtaggctttagatatcctgcccttctcttgtttgctgtagagtgccttagagcctttatgttgccgttctcttttcttgaagcactcgtctctacatttttctagataattctatttatttttcaagtctcagctttaatgtcttttcctaacctaaggacatctttcttggtacaccctaggctcactgtacttcccctattacacacatacgcagtgccctacacgtcttcatttttggattcattgactgaaatgtcttccacctttgccattgtctgcaaggggtttcaagttagatgaatcattacaaatccattcccctcaaaagtgtgtgttcagccagcataaagataagtaactgtctgcaacacattgtttatgaaggagggctgtcaaagctttcctggggtctgtagttatgcctaagcacatatttatctcatgcctttcttttttctattcataatatatcatttccgaaagagaataatccattcctctttcatttactgaaagcagttttaaaacttcacattccttttttgttcatgggctgtgcaatagtcacgcttcagcagaactgtgcttaatttgaagcccctggcctacggttcctattcatcttctcaagcatggttgtcgtaattcacagaggaaggccaagtcctcttttacccagttatacctttcattgccgcttcctattcacaacggaagatgagtttccagttctttgagcttttttcacaaatataacctgactcgttaatgataattttccttgcctggcatctgggctcaaacacactcactccagaataacaaagcacagaggaatttgaatcccttgacaatccaagcaccatatccctaaccttgaatagaaaatagatgctaataaattcagggtcttaaaaatgtgaattatagtcacttcacacttcgtggcagcttcatgctgaagaaatagcttaaaacttaattacaatgcttgtcccttccttaagtgcagatgacattcttcagatagatttttgccatgacatgtgaggaacagagtttagaagctaataagttattcatgatggagaatattgactgtgtactgattaaagtgttgacaccttcctaacataatgcatctgtctattagtgtatggttctccctctggccctcatagaatgctctttgggaaatgatgaaaatgccattcagcctttgaatgcagatgtatgtattaatagcaaatgtgcctgatgagtgggattaaaatggagagcagaaggcgttaggcttcttctgattgcctacccctgcaaatgactaggctgctctttgatagccatttgtgagacacacaaacataatggattggacatggcccacttttggcatttgaaaagctatgacaacacattcaatactttcatggctaattgtaaagcaagaagtcaactggaaaaggatgatgtatgaaggattctcttccccgttacatataatcccatagcgtgagccatgcagcaactaagttaagaacaggtaaaggcataatcccccgtctttgtgcaaggtgtgatactgttacaaaaagagaattttcttctttattcttatgccttaggatggctcaggagtgagaggggcagagacaaaagtgaaacaacttgatataagaaagcagtttctaatggactgaagtggtaaacgatctcccatagtcacggacatcccatcactgagagactcaaggcaaggggagactatcataggaagactatcatagagatgtgtcaagcatcagaaggagagaggattttaactaaataatactcaggtctgctctcatatgaagattctaagactcaggcttcaagtgctgctcaaaaatacagttagaccaggaacctcgcattaagttaaaattccttgcaaaacactattccttgagtagttgaaggacagaatctgtgaccagcatcgactcctttttgtgccttatactatgggtgtttagaaaacagttcagatttttatagtggtttataaatttcaagagggcgttttcagaagtactcctctaagaatttcctaaagcagaatgggacgcagtgacttcattcccattgtattgatgagaaaactgagaggttaatgtgaaatgcctcttgtttgccataatgaaaagtatatcctttctcacagctccataagactttaaagtgttggtgggcgactcagaatctccgtgatggcagcacttggtaaagatgagcagaactgtggagtctgactgctggacaccagatcctgcctttgtcacctcccagagtgtgactctggcaaaatttaaaatcctctttctgtctcagttccctcatttgtgaaatgggacaagaacagcaccaacctcagaacaaatttttgagaattaaatgacataatacatatgaactacttcaaacattacctagaatgtggagcttaataaatgttaatttcaggggcttcatttttgaagcaacagattgttacttattcttgagaaaggccaaggaactggtcccagtgaccaataatgtgcctgtatcttcttccttatagataatggtcagcaacaggttaatagcctattttgtaccagtccagataatcaggacagcaataagacaaggatggaccaattaatttgccaggctggtcccaaaattaaaactgaactttaaccctgcttgtgaaatgttctcatagcaaaggtatttgcctttatatgaaggcatgagagagccaaactgttgctaaggagagacaaactcagaaacttaagcactacatagacaggatgaagtggtaagcactgtggctatgaataaaaaggtgagttttgtaagcattcctactgcaaagagtttttgaactttttctgaatttaattgcagtatggtgagagacagggtggcagcattgtctaagaatgaaaaagaatagaatttaaatattaatgttcaaaaatctaactctaatactatagtgtgatagtgaccaaaatactttacttcctgactccttcagccatttgtaagaaggatatgactgattaaatcaagctccttagagaatcagaccaagcagaaaatctcagaaacaagacgccttgtctggctacgttttattcctgttgccagctgctgccaggaatcaatagctctctcttaaccatagcatggaaatgaaattacacattaaactctaatgagatttatttaatttaatttttcaaatggaatattttgtattatccaagagagtgtccatttattcttcaatacgttcatacagtttttgatcctccattaagttgtgcccccttatgagttatattgtgttctttaccctgaaagccaattgagtacctatttttcatgtggcttgggtagacttttgtctcataaccccaggttgttgccacagaactcctggttcctgcctgcaacctgttgctggcccagactaacctataagataaagtgactgctgtgttttcttccaggaatattaattatttttggtaataacaggtagacaccctctgtggccattaaaagcaaatcccagcagtatttttcaaagggctggtgtcacttgaacagacactgcgaatgagttctgctggataaatagcacgtagtcaaaatgctggtttcaggggctttctggggcggctcttgaaacagggttgagggctttagcttgggacctcaagacaaggtaagcaatgctggccttgcggttcacgaacaactcccacatcccacccaaaaaccttgatgagccctggggatacagcctaggaagaaggaaaagggacagcagcctcagaatgtcatttcacaaggtgaacccattcagaaggctttgagatgacatctgatgccaaaatctgtacatttcagctgaatgggtgaactctagctgaacttgccatgctaaacacataaataccacccaactgaatgcattccttacacagatatttgaatgcttgctatgtgtctgcctatatgtgctagggaatcaatgatgagcaagacagatgtggtccctgccctcatggagtctgtgttctagccagggagaccttaaatacctaggcaaggtgatcagcatttattgagcacattcctgggcctaccatcagtctatttcctttgtaaatattatctatttaaacttctcattaggagaacctcctttgggagaaggctctgtaatcatctccattttccagatgaggagtcaaagacttatagagcttcaggggcatgcaggaagatgttgaaagagccatcccattactgggtatatacccaaaggattataaatcatgctgctataaagacacatgcacacgtatgtttattgcggcactattcacaatagcaaagacttagaaccaacccaaaggtccatcaatgatagactggatgaagaaaatgtggcacatatacactatggaatactatgcagccataagaaagaatgggttcatgtcctttgcagggacatggatgcagctggaaaccatcattctgagaaaactatcgcaaggacagaaaaccaaactatcgcaaggacagaaaaccaaacaccacatgttctcactcataggtgggaattgaacaatgagaacacttggacacagggtggggaacatcacataccagggcctgttgtagggttgggggagggggagggatagcattaggaggactacctaatgtaaatgacgagttaatgggtgcagcacaccaacatggcacatgtacacatatgtaacaaacctgcacattgtgcacatgtaccctagaacttaaagtatatagataaaaaaaaaagagtctggtggagaaaattttatatttgcctgacattagcccatattcttcttgctaaaccctaccactatgcaaaaggagtctgctctcagctaggggacagtaggaatctcagtgtcacattgcatttcttattatttctattgcattcatttaggaaggttttcagacttcctgattaactagaaatagccagaaagagtgaaacacctatctccatggccttttgcatcatgtaattattatttatttccttgctttattgttcatcttatttattgggttgtaaatgctaagccagtgattcccaatgtttgtttcatttggggaccagctggggagtttaaaaataatcctgattcctggtccacatcccagaataattaagtcagaatctttaggagtgtgacctagacatcagtagtatttagaacaggcctgtggtgccagatgataccaggctgtggctgaggttgagaactgggttctaacagcacagatcctgtgtcaagtgctctcgtcaccaaacacactaatattgtaagctgtgaaacagtgcccagtctataattgtagtaaagtttgttgaataaatgggtaggtagagagacacaggggtgggtgagtgagtgaacaaagaaaccaatgattgcagcagttattggaggtaaagttttagaataactattagataattgtttacagttgaccttataacagttcagattctgtatactactgcaccaaaaaaatcatggaaggttttagataaatacataagtgtatgaaaagtacacagcaaactgcagggtgctcacatcatccagaagtgaaattctcttcaccttctttaatatgcattaatctctgatcttggcacactcccatctcgacagtgcaggcagccattacatcaaaggtgatggttcattattatttcttcagtgaatcattgtttgtctgaaggaagcaaagataacaaagaggaaattatagtttgtgtggaatgatatgattgcttgtaaaccaagccataaaaaggaagtatacgtgagcaattgagaattccctctctgtcctctaactgcagaaactgagcaaagtgagcagtgtatgccctattaacattttaattagggtgggagacagacaccgaagcattttccacacctgagaaacccacaattttcttgttatagtgttgattacacccctggataactctgtggaataccaatgccatgttgggcaaatcaatgttttttttctagttctgattcacataaaagttcagatgagtctgtgaatatgggagggagcagcagaaagaccagtggagaatgcagcatttgtatggatttctgctgatgtccctagtactgctttgtccatatattacttggatgtcagctgagattatcctctcctgtaatatttacctaaaagtgattgatgcaaaatgcttttgacagattgtggcaaatctaacgtctttctaaggacctccttctagtttcatgatcacctctgactttgaactcctgttctgtcaatgtattcagtttaagaccaagcaccaccactagaccatatattacctgtgtttaaattagaaaaggataccgcctctgaggtcagtttacttccatctgtcagaaaattgtcataacatggtgattttggtagaacaagacactgccatataatggaaaattctgagaaatgcacagatctgccatacctagaatttgaattgcctgtctacacatacatacatgcacatgccacccttgggcaatgcacagctgtatggagccctggaagagcatctccccatcttgctctaggggccatttcataacacattgggcaggatttggaactcagcatttttcatttaatttccaccaaaaagactacttacatatggctctgatgtgcacagattttactaaaattttaaaaaagcaaaacaagctaaaattttacaacaaatattctgttccaaaaaatcctgcggctacgttacttagaactctatcttctctagtggactttccttctttcttgcttttcttctccacttttcttctccgctttttactcctaaccccctagatttctagattctttctcatatgtatcactttagttatcttcttagttactcaagtgactatagactaatgcctcaggattttaccttttcttccagctgcctatcaaagtattttctcaaacaaagagaattccttccctaagagaaattctggggcaagcaatcagaattttactttgaattttattgcaaatattcaaagtgtaattaggattagttcagtatagcagcttgtttctatttacttaaaattctgtaagctgcaaataggaaggaaactttaagggaaaataattattaataataggagttgaagatgcaaatggcctttggatattagctggttcaattctgtcatactacaaatggggaaaccgaggcctagagaggtggagtgacctgcctcaagtcacatagctaagtagggtgttcagcattggaaccaaagtttcctgacccccgggactgggtactttctggtatttgacttcctcaaacaccatttaatctctgctttgtgttctgatcacatgccagcctgatctcatgattactagaatcttgacattagagtcagacagtccttaccctaccacttattaccagggacttaacctctctgagcttaggtcttcccatttgcaaaatggggatgctaatatcattacgtaagaaaatccaggctgaaatgcactcactgggttttggaaggcttgtcagaatttttagagtcctgtatttcatccactcaactaataagcacatcttacacacgtttagatattagaaatgcagagacgaacaagctatggtcccacctcagtgaacacatcacctaatacatgtgaaagtcagtcttataataggcctatgtgaaaggggaaaactgagaagaaaagatgtgtgtgctgtgtctcaaggcagagtcaaaattcaccaagaaaatgacaaggtagaagcacttcagcagggagaggtaacattatatggtattgcatggagacatgaaagcacatgcataatgctgagacaggatagtttccttgacccccttcatgggcaggaactggagtgactcgtttcactcagcctgccactggccactcctcatgggagggagtgtgccagcgagtgagtgcaggaaccagagtgaaggaacactggaaccagccggtcgctcctctctggcagaagcaggctctctgtgggccctgcagcagtgtccaagcatggtatagccaaaggtcattcaactctgccatctgcggagggccaagtgccaatcagatcagtaggggatcagggtggcagccactgtcctctcggcacccaggttcttgtccggcgttcaggaagaatcaggtcacacgaactgtttgaaaggtattgaatgccgaagactttactgagcggtagtggctctcagcagaaaggctggaaaggggatgggaaggtgatctctcccagaagcccagccatctccatccaggcccctctctgaagccacattgtctgaagttagccacaactgtccttagtctccaaggctcagttgcttctctgctcactgctcagttgcttgtatcctctccacgcagccactggtgttgctctgccagctgaagtcttttatgggcacaggataggggtgggccaggccaaaagcagtatttggatgaaaaatggggtcagctgtttttacttagtgctgcggttccaggcttaagggtggagtttagctgggagaatagcccttctgtatcaatatgttggaagtatgatgaaaatgtcaacagggtatttggggcagagagtgatagatgattatgtttgacgctggagaggaacattaggtctggatgataaagagtctagaatgtcatgccaataagtttggatttcaacctatagatgatgggggagaacaaacacaattgcaaattaaaagaaactctaccatagtcatcattagaatggtttttaaaggtttcattattcatattcttgatttattctcaatttgaggttactttactgatgaaaaagttctaagttgtccatctaaaaatggtttatgtcaaatgacgttgccaaagcaaatgctattatgaaagtgaaaatataatctcagcaggcgtttatttaattgagggccagcataatgaaggagtttactgtacctaaaataacatgttctcagccactggatttaatgaaaacctgcttagaatctatataaaaagggtaaaaattgagttgcattttctctctggtatatttctcaggaactgacttggtaaggatcaaacatggtacatgttactgacttattcaaggatttgtaacttaaaaagagagaaaagataacgtagaatgtcactgtaaataaaaatacatagctgtggccaattatagctgtttccacaactataatagcataaaatacacaagtagtaaatgtataggtttattctcgttgagaaataaaatgctgttttcacataggatgttatgggcatctgaatatttaaaaataagattctggaaggcatgagcagaagtgtacaagttaaataggttctaatgtggacaagtagcaagagtaaaattatgtggaaaaaaacttttaggctaagagaagtaataaaacacaaatctgttgactttcacttgacccctgttctacaaaatcaaactgtataaatgcaaaagtctgttcagcttctgccgaaaaggcagtatacttcagacttgccttagggttaacacagtgaccaagacaaaaagaatgtagtatggacaaggaacattaaagttctaagtagaaagctgattggaaatgtaggaagaaaccagcacgtctaactgtgaagagagatggaggatatcatttgatcagcaggggctgggttcttcaggcctttgtggtattaggggtcaaggaccaggggaggcttagtttacatttgagaacacttaataatgactttggaagcaacattagtaccgtaccgaaggtctccaaagtattgacatagaatgtacacatgcacacagtagaataatgggcattaagcaaagctgatgccagcatttcccattcccgtgcatcctcttctttgcacacattcacacgggaagtttaacttacaatccccaagaaagcaaaggatattaaaacagttgacacattacagtgaaacaggtaagttatggaagggaaaggcatgatttcactaatgtttctctgacagaatggagtggggtgatctgagtgagtgatagccaagccttaaaggaaacagatgtccgagatatatagatgtttagttccatcaaatgaaccacattagattgcaggaaacacctgagtgtaggattgttcatgctgtaagattttattgagttgataaactacataagctttgaaacagacacaagcccatttacttctgcttttgttgcacattcacttttaggtgtatttccttcatctttgtatccataattagccaaaagcatcatgcggacagggtaacttttctttcctctctattttatccccagtatcaaacacagtgccgaatgcatggaagctagtaaatatttgttgaaggagagataaataagattaaatccaaatcagccgacatggttaatcctaagagaagggatgagcaattctgtagacaacattatattttgctgagttatagaaattcttctatttctctggcctgacacaggtccaaatgtctttatcagacaaaaacaaaaaaccttcctggtaagttaattaagaagaatgacaaagccagcagttacaaagcatctaaacccctattcaataccttgaactttgcatttgcatagacctgagtgaaatccctggctttgtcactacacagtcacgtgatcttgagcaactctccttaactcttggatgctcagttgttccatctgaaaagacaaatcataattgattcatctcataaggcctctatgatatttggtagacaaagtgccagcacacagagacatctaatggaatgacatagctattctaattcaagggaaactttcaggagtttaagattaatttagtgagactccacaaaaagttgagaccaaactacaaaaatgacagcccaacaaattttaactcatatgttcactagttgattgtctcgtgtacaaaactgtagattcataagccagggacgaggtttgtcttgtttattcccatgtggtactaagtacagggccctgcacatagtaggtcattaacaaacatttgaataatgaatgaatgaataagtaaatttccacataagatgttatgaattaccaaactagttagtgctctgtggtctacactagagttgatgtcactgagagttaggaaactgtagaaaggtggatggcattctgggtggtggaggtggggaagatgatgaagtgaggatgctatgacaagaaagaaagtgtaacactgctgtagtcagcagcatgagctcctcccaggaggtcatggtcatggatgcttttgatgagggttgaatagtctttcacaccttgacctctgttttgctcctctgcgctatagattccagctatggtgaattatttccagaatctcaaatgctttctcttcctggatggcctttgaacagtcctctgtttggaacacttccgtatcccttttatctataactgcttcttactctttgggtctcagtttagatatcatctccttttgtaaggcttctgtgaacccccaaactgatttcaggctttaatacaatcacagcaattattcatctgtattgtatttccatgctgagttgtttctttcccccagcaggctgggaaaagaccaggacagtctacatttaccagcctctaatacatcacagtcagtatccactgaatgaataacaccattctgagatgtcaagcctcaaagaattaggaatgcttctaaagaaataggaaggttatgggggatggttggggcttaaaactggataatttccggttttagttttctttgaagtagcagaaaacccagtgagtagaaatatctagtaatcaataaagcaggagtactagggagaaaagacagggctgcagtggatatcatctgcagaagagaaagaaaaacaaagggtgaaaaagatatactcgcatttagggaatagaaggaagaagcagagctgacaaagaagtcagatatagaagcttaatgggaaagaaacgtttctcaaaggggtagttgtcattcaccttgaaagcagaagattaaaaaccccttaaaggaaaggggcagatgctgaaaggaaatgggtggtagagtggagtcagctgctccagaatccaggggagatgcgtcgcagggtaagaactcaagtgggctactcggccaagggcagctcttatccaaagaagtcaggcttaggcttgtgttaagacaatggaaagggagagatggaagatggtagaaaaaaaagctcatggaggctgatatgagctagaaagttgtcggtgttgctctattttgtcctggatccttttagtttcttatgcttctttcctgcagggaaatggagttaggcatatgctgtctagaatgctttagaagtttcccaaacattagacgaagcaagctgcagagtgccatagagtagaaagggccatcagcaatcctgatgagcatctttttgccttagtttgtagctcctagggatgtagggtatttcactatccacagaacctccagcttgcttatgtgctgccttggaacccttcctaagcttacctcatgcatgcatgccttgtcaagaagcttacagtacagttggggagataatggggatattgtcatttactttagtgtcttggcagtaaccagtatctacagtacctacttaacaaatgtttagtgaagtgaagtcaagctgggctgatgttcttttatgccatgaggcctgacatacacattctttcttctaagtgaataaaaaacactttagtgggagctaaatgatgaaaacacatagacacaaagaagggaacaacagacactggggctttcctgagggtggagggtgggaggagggagaggggcagaaaaagtaaccactgggtactagacttatcgtgagtttacttaaataacaaacttgcacatatacctctgaacctaaaataaaagtttttaaaaaacacttttgaaagaattttactcttccatgaattactaagaatagcagctactatgtattgaacaatgtgtaaaacactttacatctatttaatcttcaaaacagttctatgaggtaggttctgtttttatccccatttcattgatgaggaaacgaaggcctagaggggttatagaatttattaatccaaggtcatattgcatgtaaatggctcagctgccattcgaattcaggtttgcataaatctaaagacccctaggttagcctgctcctcacatggtcatttcgtctctgggcctctccataaggcatgtacccagaaaatgtcaggactatggtaatctgcaaagccactgttctcctacctttttcctcctttgccctccagccctggtagaagccaaggttgctttgtgattagcacaaacactgtctcatttagcagtagaaccctgatggatagtctctctaggcaggctagtatcttgcacaccatgggtcccagctgtcttcatccttgaacagaatccctgctgaacacagaacagccatagtacttgatacaaagcttactcagatgctgacaggtttgtaagtgtctaggggacaaagcagcagctgattattaaatttcctttagatccatcaaatgatttaagcaaggtgcttcgaggtaaccaatttgagtaactcctttgagtaaccggggacagctctgcttgaatctctgatcagctttgttttagaaattctataggcaaagccaaagctacaagagaatttgatctttaaggacttcacagggccagtccttaaaactgaccatttcttttcccgttgtcagccactgtcagaatttaacaaccgtggctgtgatttattaacgtgtctgattccctctgggggcagtcccatttttcaaggatatccaatgctccaagcagctctttgcacagtgaccatccatcagaggcacctgcttcagtaatcagcagctccagatatgctcatgccgcaccagacaatgctacaatctcctgggaactggcatgcagagaaataatggatttatagaaatacaccactgtgacaaagtgggaagacagattaagcagaaaaggcagggcaggctagaggctgaggaacatagggacagaattacaggaaaccaagccacacaacagtagctcttaacaggactgtagaatcttaatgcattcttcccacccagcacaaatgtggggggctcagattgggatggaggcggtctaaaaatcagcagaattaaaaagacacattcaagtgaaacaggctttccttgcttcccatcttttcattccatgttattttcttttcctctctgaaaaccacttggcaaggatcatgagacagaacaaaaagaaaaggggaggtgagctatttactgaaggcataaaattcaacttgtgttggcattatgtcactgaactgaatagctatcggagactctctttcctcaactttgaatgggcccaaaatgttactgttatcaaagccgcacattgaagaagacagcagataatgtacttggtaaaacaggcagcctccgccaggaaaatgtgtaacgcttccattcactgaccctcctttccctccgcatcaacttgtgtcataaattgctatttgctgacaagctgtgctgatatgaacccaatgctggttgcagcacaagaaaaacatgccatttacttagtgccagggaacaacagccttgcttctcccaagctgatcaccatgttgctggctggtagagggagaatggatggtaaccatcgttcgttaccagcctaattcccaggtatgcactaccgtagcattagtgaccagaggaaagacattcagctattctaggaagcatgagaaatttttctgacacctaccccagcccttcccaatgtccccaacagatgtactcacaccactatctcactgcacagccaggtgtactacagaacacttcagctttgagttgtcttgataattgtttttaacttctaatttcaggggtacatgtgcaggtttgttattaggtaaactcgtgtcgcgggggtttgttgtactgattatttgatcacccaggtaataagcctaatatcctttagttatttttcctgatcctctccctcctcccaataattattctaaaccagttgctatttttggcatagtggctgacacctataaatatttggaatttaaatattcgttgaatgaaagagtgaccaaatggattttatctgaatgcatttatccactaggttattcacagcaagtactgtttataatgatgggctttcatagatattagctcatttgatcttcataataaccaagcagcagctactccacctgccctcttacttaagggtctttgatagtaaacaacagaaactcattctgattaattacctaaaaggggatttttttaaaggatgtcagaaactccccaaattaacaggaggctggaaagggtcctagagacaggagagaagtaagatggcttcagaaggctcgcaggtagaaatcctgggaaccagcagagtctgatcacagtgaagaaactctggtttctgcctctttgtcatggtagagtcatatcccaggcagggctgccaggctatttcagattgggttccttccccaccccttgactcgatggctctgttggatggtattcagtgaggagaaaatccccaaaggaaatctgcaaagaaggggatagatgctggacagccaaaaacctaccagggctatcatatctcttgtgcaaataggaacattgaggctcagagcttagctgatttcttcagtgttatgcacatggtgcttcaaaaactgattcaaacctgggttttctcacaaattccgtattctttccttttgtatgccacagtcatataatgtgtccatttacacctgaaaacaagttactacacacagtgtactatcctagattggatcctgcattttaaaaagacaaaaagacatagaagactggtaaaatccaaataaagtctgtagtttagttaatagtatgggattgtaccagtgttaatttcttagttttgacaaacgtaccttggttatataagatggtgatattaaaggaggctgggcaaagggtatagaggaactccctgcactatttttacaacttttctcgaaatccaaaattaatccaagtataaaatgttgtttaaaaaacagattgatagctctccttgggcttctttgggacaaagtgacacacatttttggatagccttctgatgcaaggcacatggaattcccgaagatctcaaaatgtcagcctttatacaaaaggaagccatagtctagaaagggcagtaccataccaaaaaggaatatgagggataggcatcatatcccgaaatcttggatgaggcaaaggagatcaagggggaaagtggtacttgagtttatcatttaaaaaatgacgaaatttggatctccaaggaaagggaagtaggaagcataatccctggatcacagaagaatgagaatgaaattaccagtggtgtaggcacatgaaagaccccaccatccaaattgagaatttgggatttcgtgtttgttggcaattggttgaggtcatcagggctgttctgacttgacaggtaggaggctctgaacaggaaagcaaaagacagaaaggatggtaagaagattattcaagattaaagataagagagaattcaaatcagttctgtgtcttaagccctggaaatagtcattatgtgttcatccaaatatccagaactatttgataaagacacgaaacacttgctgttatttatagcagcctagagaagcaaactaaatgtagaatacagcttatgtcttgtagtgtctgtgatatcttggtaaataattctcaaaatattaccccttttagtgtatgaaatggctattttcaaaacataatttttatgttcaaaatatgccgttgctatttaaacacatatttaaaagtgactgtcttccagacactgtcctaaatgctttacaaatattaattcacttaatcttcatattgtacacccttagaaggtaagtactatactagccctgttctacagatgagagagcagaggaaccagggaggaaggaaacttgcctagaattatggagttaggaaagaatagagctgagattcaaacccaggcagcctactgagcccatgctcttgatcaaggtgtattattattgttattatttaaaatttgtggttaaaacagatgatgttaaaacaacagtgggactccaagctaatgagtcttgaaactggaagtttttctggaaaatttggggaaaagtgagcactcaagggaatagaaagaggtggtataagctaagctttggtttgtatgctggtgagttgtttttgagtagagatgtacagcaagaagtcagacttacagaaactctgcccaggagttacagatagcacaaactctcacatctaagcagaagctcatctgcttagatgtgagagttgatgccataataataaaagttattgtcaggaaaacaattataaatagaagacatagccaggtcattagtaaatgtctacttttaagaggaagaaaaggagtatacaataaacagagttagaaggcaatttcagaagcacagaaaggagaaaatcattggtttaatgtagcagagatgccaaggaaaatgaaatccaagaatagtatattggatttagtaacatgaaagtcagttgtatgggaaaaaataggatgactgttaaagtcagatggttaaggagatggcaaggatactgtagtctttgaaagtcaaaatgagatccagagccgggtgcaatggcttactcctgtaatcccagcactatgggagtccaaggtgggtggattgcttgaggtcaggagttcaagaccaacctggccaacatggtgaaaccctgtctctactaaaaatacaaaaattagccaagagtggtggtgggtgcctgtaattccagctacttgggaggctggggcaggacaatcgcttgaacctaggaagtggaggttgcagtgagccgagattgtgccactgcactccagtctgggcaacagagcgagactctgtctcaaaaaaaaaaaaaaaaaaaagagagagacccaaacttccattatagacaaactagaactgcattgtctactaggtacatgtggctatttaaattaattacaattaataaaaattcagttcctcaggcatgctggccatagtgcgagactcaatagctatgtggctgctatactggaccacacaaatgtagagcacttgcattgcaaaaagctcccttgtgcagaggtgaactaaaataagggtcaataaattttttctgtaatagtaatattttaggttcagtggaccatacagtttgtgacataattactcaaccctgccattgtagttcaaaagcagccacagaaaatacctaaaaaagtggatgtggctgtgttccaataaaactgtatttatggacagtgataatcagaatttcaaaattttcatgtcatgaagtattcttttaattttaaccattaaaaaatgtaaagcccatgcttagtttgcatgccatgcaaaaacagatgacagatcagatttggccgatgggccatagtttaccaacccctagattggaatattatggaccccagcaaccgaattagcatgtgctgaatatctgcatatgctagatttgctgaacatgaataaaagtataaaatgtatgtatattagcaccaagtttcatctgttcttcattatccaaatcaataatgcaaatcagagaaaaatacacatcaaaattatatgaactgttagaatgtaaaaggagaagctcttaatatatcatgatgaaaaggaaattttgatgtgtggaactgatattaatatgctagactttcaacttgtgactaggtaactttcattttcacataaaaatcaaattagaagttcacagtaaaaaacaaattcccacataaatcccaatttcctgaaataacagtatttacaatcctaagcattaatcatctcaagactctacaaagtacttaaagaaaatgcagttaagtacaataatgaccttcctcatttataagacaatgagaatgaagagttttcttctcatctaacaattcctatcaattgacagtagttgcctgaagtcctgagatgaggagtatcgtgattgactattaatgtctgccatgggtgacagcgtggggagatatggcacaagtgctagatatctgccattcctgcatcagcagcatgatggagtggggagaaacaaattagattttgcgccagctgaagatctaactctgctatacatgaggctgtttatttttaaccttttattatagaaaattttaaacatatacaaaagagacaatggtataatgaacctctatgtacctatcacccagcttcaacaattatcaactcacagccaattgttatttcatttttccatctctatattgtttagaagcaaatcacagacatcatagcattcacaaactgtttttctgaccagtggctaactgcctaacgtgccttggttgttataaaataaatgcttttaaattgctaagtgttttttagtgtgtaatattaagaggaaatcagactgagataggttatattttagaaagggtctaaaaattaatgatttgttttagaaatcaactgcattgtaacctaattagcctgcaatttgtatgtacaagtttgtagacaaaatttagtgtatgtacttggaagtatgcaaaatcctcaggctcagcttgcaattattatgcactaaccgtgtgccagacactatacacagcacagtcacctccttttatcctcctcagagccctgtaagacactgctatcacaagacaaactgaggcacatgtactaagcagtgaatctgaggtcactcagcccgaaagaggaaaaatcacagaataatgtactgttttaataaaacatggcttccaatacacctaaacttccttagccatattcaaccagaacttataactttctgatgttccatttggtagattttactttttctactcaagctgtgtttgaaactagagtccaatagctacacaaagttcagatatgtctgacaaaaaccttgaagagagacatggagggaaacaagtaagtttagagctaatatttgtttttcattaatcatttgcttttctcactgaccctgtcagagagatagggcacatgctctgactgcctatagagaaggagaccagtgcctccttcatccccagacttcagaaaagaactacatgaactgacctctataccttctttatgctctttcacaatcgtttaatttttatcttgagaaatagttgagaaggtgaaaatgaatatgagaaaatactctttaggaatattagggtgcagatacccattttatgttaaatatttaaaatgttggggacatcaatacatctgttcaacatagtgtagtgatgaaaaggaaattgtttagaggcagaaggaactgacctctaattgtctggttgctcctgagctagtcacttttctatggtcttgttttctcagtaaaatcagaagggtagattgtatcacaaattgcagttgacagtctgtaggtgtttaacatatggattgtagtttggttttggttttctaattggaattagctgccaatacttagaaattgaaggattttctatctttcctggaccctccttttacatggtaagaatcggggatcttctaatagagcttctaccctcagagaggatgggtagcctattattctccccattcttcattacttcttattgtttccctgacacaggctgacagtcaggtgccctttatcattgtacttgcaatgacttgtgatgtatttcactcttacattccctgcctgggccctggagacatctgcaattgcaacctggattttttgaactctaagaggttctatggttgtctggtaaaatataacatctccagtagctaaggctgcaatacattgtctaattaaagttttccagcagtgggagctttggcgtctaaactgcagaactcaccttctcacccaggtcactgtaatttccagaggaagtgctgactcctggatctgggagttgaggtgagcttgttggattctgtttaagtacatctcctctgccttctctttgccttggtattcagcattcactgacagttcctttaaacttcttgggcattgacattcaaatctgaacaatagccaactcgattattctggccacttgctttatcattgtctgtctgtatagtgctttacaatttttaatttttttttctaaatattgtttgcttttcacactaaccctgtcagagaaatagagcagaaattgcacccactgtatacaagtaaggggaaacaagatattattaacagaagtttttattcttcagcctttcctcttaaaaccagaccctggtactttgtttttaaagctatttcctaaatacaaaaataaaaatgtgtttatttaattaaaacatcattctccaagacctaaagacttttagactacattattctcctccccactgcgacataattgaagattgatatgatacatttttttaattaggcccgtctggttttcccactgagaaaaaaggaatgtgtcatctttatgccagctgacttaaataaaaatccacttggatttagccttttcatgctggtgctacaccaaaacaaccagaatgtgaaatgtgaaatatttacctttatctcatcctagagagaaactgtgaattattatagtgaaatatattctttcttggagcactgagtaaatgaatattactgcagaatttttgtgtttccttccttcttaactgcaaaccaatcaaaatgagttcagagaaatctttaggaggaaaacagaggggagagtgccatgttcttaatttcaaaggtactgtgtttgtgtgtgtgtgtgtgtgtgtgtgtttgtgtgtgtgtgtgtgtgtgttggttaattttatgtgttaacttggctaagccacagtaccccaataatttgtcaaacatgggtctagatgtgtgtgtgaaggtattttttagatgagactaacattttaaatggtagactttgagtaaagcagattaggcaccataatgtgagtgggcatcatccaatcaattgaaggccttaatagaaaaagactgaagagcaaattctgccaaaaactgccttccaaattgcatggcaactcttctccagtcctgctgagtttggacttgccagcctccataattgcataagccaactccttaaaataaatcaacctctctcgatagatagatagatagatagatagatggatagatagatagatagatagatagatagatagatagatagatagatagatagatagatatcctactggttctgtttccctgaagaacactgattattaaagcgtatgcatgtggtgtgggtgtgttatatcctataacaattaaggctctacaccagaaattgacaaattgcaaatttctgtaaacagcaagaaagtaagtatcttaggctttgaaggacatataatttttgcatctactcagttctgtcatctttgttgctccaaagcagtcatagacagtggctgtaacaaacagcatagctgtgttccaataaaactttatttataaacataggggctaagaagaatcccatgtcttcctgacttggaggaagatgtctggtttgtgttcatcagacttgtccattctcttgagatgagccactggttttaagtatcagtacctgttttgtcaacatgaaacacttgtgctttctttttctcaaccatgaggcctctcaaggcctaccagccaattcttagccatttacaacctgttctgggtacttgggaaattctaggatgcccctcaccttgagactctggaactgttcatgtggggtcaggagattcgggaattatctccctagttatgccactcagtcgttgctactcagacaccaagaaagacctgagatttgtcattgagacttagtttccaactgtgaagctaagcagtgattcattgttttctaggaacttttcccatgaattaggagaagttccagttgatgctgcacttctccatccagcatcccagagtcctgggccataggcaggatctacattttgaatatgttcttcctcttattcttctcctaagaactgttttggctataggaaaactgttcttacataaatatgtatgcttggagtttcaaaactcttttgctctgactataccatgtttgagggcttaacagaaaacaaaatcttctctcaatgcttgcaatttaaatatttttgctttttttgagggtaagtctcactctgttgcccaggctggagtgcagtggcacaatcttggctcacagcagaggttgcctcccagcttcaagcgattctcctgcctcagcctcctgagtagctgggattacaggcatgtaagaccacacctggctaatttttgtattttcagtagagatggggttttgccatgttgaccaagctggtctggaactcctggcctcaagtgatcttcctgccttggcctcccaaagtgctgggattacaggtgtgagccacagcaaccagcccaacttctgctttcaaaagcatattttagagttaaaattgaagaatctgatctattattctaagatctcttagaaccctcttctctccccatcatccttacacacaacacacacacacacacacacacacacacacacacacacacacacacacttcaccatagaaagacatcctggtttccagacgcttgagtgtctggctattctctggacctattaaacagcacttaacactgacatcttttttttttaacatctgaaggtcacttgcatgtgtaaaacatattgccttagggggtagcagctaaagattgtggggtttcctttaggggtgatgaaaatgttctaaaagtgattatcgtaatgtttgtacaacttcataaatataatgagtcactgaattgcacactttacatgggcaaattatatgctatataaattatatctcaatatagttgcttcagaaacagtatttagcatttggttgttgttgctttaatggcgcagctcccttggacccctgactgtgtgtctgaggagatggacaagaactacttagagacattctgctccccacatgtgtacttttttgttcttctcacatatttcctatacttcaaaaccctccctagttcactccttgcccctctcccccaaatctcatacatttgtgcttaatctagagaatcctgactcctcctttgggaaacagtttaaacatgagctatttctgtgaagttctccttcagcagccaaatgtgagttaaggagccctgccatgtgctcatatactaccttggagtttctctatctctgcctgtttcacactctatcataattgcctccttactggtctgtgagctttgtgaaagcaggaatcacattcattatgtccactagtatatacccagttcctggaagatagtattggatggacggacggatggatggatggatggatggatggatggatggatggatggatgagtgggtgggtggaagggtgggcagacagactgacggatacatgcatgacccactctctaatatatagtttaggattttatttccatgggataaaaactgatggaagcaacaaagaagatgtttctctctctcaagtcaggagaaagaggggaggaagtcacaactcagattagtcattttgtgttttcagaatcttaatttttttgagtagtgtgtaatgaaggttttctctgggcatagtggctcatccacatttgctattataattgacctagctctgctgtcctgctgctttccctgcttgtttataaattggagaacaactttcaacttggtgggagagctgtagtctaataggaacagtaaaatggcagtatgtgtaggacaatttagaaacctcatttcagctcagatggaatgacccacactttctaggcatgaaatcactcataagaacagaaccaaacagaataagaacttatttacaggaccagcagtctctaagcaggctaggggcagatatgacatgttgaaaaagtaaagatttctctggcaactgcctcttctctttctgttttctccctcatggttctcacaatgatctcaccttgctactaactcagtatctcaagcccagctttaaaatattccaaccctttagcaaagtgtagcaatcagctggaaggaacctcggaggccacatggcccaacctgctgctaatgcagaacaggagtcccttccacgggtattctgaacagatggtattcggcttgtgctctgtgcatctctagcaatgattatgccttactgcaggagacaactgatttccctgttggaggatgacttggaaagtttgcttcagagaagcagagtcttaaagtgcacagctctggagacataccagccctggagtcctggttctgctcctaacccattgtgtgtccttgggcaaggtacttagcctaggtaagcctcatttctctgtctgtacaagagaagtcagtaatatccggcttattatattttgaaaactaaattaaaatacacacacacacacacacacacacacacacacacacacacagcatttagtatgttgcctggaacataggaaatatccaaaaagtagtagcttaaaaattaaacaaaccaaagagttctaaaaacattgctaagattgacatgacatttgcagacagaggttaagaacagaataagctccagctaccatgactgttaaagtcatcccagtatcttattctgctctgtgtggcatcccgtgactctacctggatttgaaattaaacattctgaacactttcttagtgaaagagagttaaggatcaagacttactcagcagagacacttttgtatgagaaattgcttgatggctgtctagacacagacaggatttttcttttttaatgggaatcaggtatagagtggggtatctatttttttaagggaaaagtggagtagaagaaggtaaaaactcctgaggtcctgtctgtgcctctgagtcatcttgctttggcaagcctgtggttagtaccaccactgctagtgaatactacttaacaacacaaaatcaaacaaattagtttagaaggaaaggctgttcctttactatcagtacctgcatgcggagtttgatgactacaattgtgatttcagttcatttttttttttctatttctaaagcttgaaattacctagccagtcaaggtgataattggaatctctgcccaatctctaaaagaaattgacttgttcttctcaaacaaaggactattgtttttgatttttctaaatttccttgaattataatcaagaggtatatttacaagtaagaagaccatgcatgacttaggacctagctgtcagttcaggaaaccaaaaaagaaataaggtttataatgacgacaagatccacaatcactcacttgtacttcctgaaaggtgagacagcaccagaccctgttctttagagtagctctgagatatagaggagagagctcttgagaaatattcaagtgtactttgatgggtgcaggggacaaacccttttcaatgtttactgtagtggcattgatcaagatcccaggcactccctacaaaagtggcatttaagagaagtagtagctaagtgaacagtgggggaaagtgtttagtgggagcagaggaggatcagagacaaaagaaggcatgaagaaagaagtccaatctggttggaatgtggagggtggtcttgactattgcctgtccctactccatcattcccgcccaactaaactccatcctcagtcaatctaattctttgtctaccctctgtcttcactggggcagtagacaatggccaaagaacaacatacactcatactaactagtctctctttaacgtcatgattcctaacctcaagtgggttgacagtacagtccagagatcctccaacatgtcttcggtctgttctctgttgtaccctccaagaaagctactgcatacctctcctttctcttcaaaccttcaatattttcttgctatacctccttctcttcttggtagctttgtttcctttttcatggggaaaatataggtgtggtcaaaagatagcttccatacattccaaccacaacatctacctgtgtgactaccatctactttcctccagttaccaggataaactggccatgttcctctctaaaacatcttctcaactcctgcaatgaatctcattcctttgcacctattcaaggatgttatttcaacaggcacctactgtcccctcacctgtatctttgacttttcccccagatcattaccatcagttgtaaaatatattctcatcccctataaaaaaaataatgctgggcatggtggctcacacctgtaatcccagaactttgggatactgaggcaagaagattgcttgaggctaggacttagagaccagcttgaacaacctagggagactccatctctacaaaaaatagaaaattagccaggtgtagtggcacacccctgtggtcccagcttctcaagaggctgaggcagaaagatcgcttgagcttaggaggtcgagcctgcagtgagccatggttgtgccactgcactccagcctgggcaatggagtgagaccttgtctcaaaaaaaaaaaaaaaaagagagagagagaaagaagaaaccttccttaacttgcatatctccccttgcaatcacctcatttatctgtacagattaattatctcatctgctttcatggttttaaataccatccctctgctgatgactcttcattacttacctgtagcccaggacttctcctgtggactgcagatttgtatgtgtggagtccatgggaattggatttccaacaggtaaatcaaatgctaacttagaacttctgttttttctaccaagcctgatttgctactgtctttgctgtctcagtaaatggcaattatgttcttccagttgctcagacatgcataaataaataaataaataatattcttttcatgctttacatttttttggtcagaaaatcctgttatttccatcttgaaaataatatccagcatctgaccacctctcatcattgtcactactactctactgttcaagctgtcattatctcttgcctggattattgtattgtaaatcatcttccttcttccacaattgactgtttatgctttttgtgtttcagtcaaagtcagatcttatcagttccttgctcaaaagtatctaattggggatgggggacactggtgatagagaagggaagagaggcaggggagggaagaccagaggcaaagagactaagtgtttttaaagaattagaccatcattctcagtaaaacagaaagcctctgaagagatttaacaagagactcacctagattttcattttacaagggtgttttgataatatgcgcagacctcaaaaaacagtgtgaggatttttagtaccctttaagatttgagaacttgaagattcccaataaccaatattataatgtatgtttacaaaaaaaagctaaaagtgatagcatctgcatgaattgactatggtttttcttgaggacattaaatagattcaatcctcaattcttaatgcttttatgagaagatataacacacaaaaaatcagataggtagactcagaaaatccatagaaccaactcagtcttatattgtcagattatattagggttgcttctgtgatttgaatctcacagacttaaatgatgttgctcccctgtttgccttgtatgtaagaatgaggcttatgcaggtaaagttcttatcaatcagttgaaattgcctcatccttctctgggtctatatgcatttatgctggtattacaggatgcaattgataataaaatgttgacttagtactttaactattgtttacaacagtgtttaagggctgggtgactaaaatttgcttcattcatgccactgtgccctctgcttggggttaattttctactcctaaacatggaggcctacatttctagtcttccttaacaagtccttattgctcagtttaatattcttctctttatgaactcttttacccttttattataaattctacctgggcatcaagttaatggtacagccaaaatgtggatacttttcctcccaagccatcctcaaacatactcagggcggggaagcgtactgaaactcatcctaataaaaccaaaaccaaaagaatctaactttctttggaaaatgaatctcaataaaaagcagtatgatttttgctttttattcatcaggaagctgccaagtcaaatggctttatacagcttctttttcttatgtggcaatagttatatttgaggggaaattaaatatccaagttttaataaaatgagactttaatattttaatttatattttttgttacccttcttactatgagtgggagacaattctcatgggcctcttgtatttctgcatgtcttttgagtgaggcattagctgtcctttgttttaaactatcttctcaatgatgttgaaatggtgaacagctttaaaatatatagtgtttccctccagagcaaagtgcagccatgcttattgcccagtgtaatgaaaattactatctccctccagagcaaaagccagtaaagttactgcccattaaaaaagatttggtctccctaagctctgggttctgctcctataatataagccactgcatttttaggcatccatctgggcacatttgtgtttacccccacccatgggattggggcaagggaaattgactctgacatgatgttgcttgcaatgcttgctatgccgccagtaataaagtcccttgtttctgacctggaagtctcatgtctcctgctagcatccatgaaactgtgtcaggctaccttgttagcttgcaaggaggatgaaatcttagattcttcacagttattgctaactatgaaaaacatacttttaaataccgttaaaacaagagaaaataaaacagatttagaatctatagtgggtgcttctggaacatgaaacatatgcctcagagtttgcccatacttttcttttatttatttctttttttttttttcttttttacttaagctatccctctgcctggaatttccttcctaccacacgtttatctaagtcattcaacactggcatttggaaagctttttgaatagcattacttttaacatgcatttaaaagatcaatggctcatgatgtgaaaactgattgaaataaagggatttatccttagttacaattttataccatgctaggcaacgcttttactaagaaatgaatcatttattcttttacttgaacatttattatgtacctagcttgtgccaggtagtgtgttgaaccttgaggatacagagataagaaattctccatttgatgaagcccaggagcaaatgaatataaaataacaatataattatgtgaaaagttctgtgacaatatagatcttataattttctcccaccatgtattaatgccttccagagagcaagaggtggagccccacaaaccatggctttgagctgcttttgtggctcagtgtgtaatgttgtggtaccctatgacttttaacctgccataccttcttgtttcattgtcatataccactgagggaggaatgaaccaccatatagacacttatcagtgagaactctggttgcaagtgaaggaacactgaaatcaagtggactcttaaaagggtggtggaaggtaacatttggctcacatcactgaaatatgatgtgagaagcaaatattttgatattgaatgtccagacacttttggatccaggcatttaaatgatgtcattgaaattccactttactctttcctttcccaagttccgttttccctcctgtggcttccattctcaggaaggctcttgcatagttctgtccagatatccgccaggcttctatcctatcatttcattcatctctgaaagaaagagaaataatctcaacaattccaataaaaattctggtcataagtcccagtcacgtgacttggatcacatgcttattcctaaataaaaatgcctagctaagggagtctagtgcttagatttgccaaggaaaggtcatatgactcttcctggagtttgagggaaaagtggatccactccaaccatgtaagctgaacatgtggaagaggtggagccccacagaaattcagtttgctatagctagatgaatgggaaatgaatactgggcaggtaaaaacaacagatgcctatttgcctaaagatactttttattcaaaatgttcaaatatagaaattatatataaaaatatcttgaaatcacaaaatagaaaagtggtttattcgaatattttagtaaagcaggtatcaagcaatgacaagatacaaaatggtatcttcgttttatattgctttaaattttggtctaaactgtataatattaaaatacagtgaaatattagctgcacattttccctcattttattattttttaaattcagctaataatacctataggatgcctatgtggttatgctcaaaatactgccattcacctggtggtagcttgcctagattaaaaaaaaaaaagaaagactttctaaagtactaaccaacctcaaaaccctacccaactatttttttccctattaacatcaacccaaataaccaaatctgatgtgaaagtttgagatagtatggaagaagagaaatgacatcttagctcttccttgaaggtctgtaatttacaacaattcatgcataataatgattcagcaaattttattaaaaacttctctatataatatactgttataggtatccttaatataaagtaggtactttctcagatattaaagttctaatttataaatcgagacatctttttattacaattttataagtaaattgctaaagaaattcacttgtgataatagaaataaggatatctttggcaaattgtactgttgcaaaatatatttgctacattttctgggaggaaatttatactgtcctgtccatgtcagggaatcacgtgatttgctttgactgatcaagtatgagctaaagtggcacatgcaacttctaaccagaaactttaacagccgttggttggttttgccattttctctcttctcctctgctggaatatcagcaattgtcttcatatgtcattgaaatactgggtccttgttattatgacataacaacctaaactgactgatacaaatccaaagattttagaagatactatatcatcttaaatgtgattacccttttgatctgcaaatggagagcccttttgccactctcacctgaaggtcagagagatatagtctgtactgattaagaagaactcaatatcttggatattggtgataagctgtgtgtgattagcttgcactgattctgcctagacattgcatatatcttaaagaagatgagtttctttgtcaggactctgagatcaaaggaattgaatagtcccttactaatttacttcagagaacgctaatatttgactttgtgtcttggccagtcctttagtagtgatgtgacttacatcttgtccttcgctactattttgtagtttcgtgttttcattcatggtgagttcaaatatgtttactaaaatacttcaatcaaccacctggtataatcatattcaattttgtaagaaattctaaggtaaaagtcacttgaaagataaatttaaacccttactattttcttgctcatctctatgaacgatagagaagtttagcatattatctaccttctggatatataatttcaaattatgtgtatcaatagcaggtacaaattccaacccataaggattattatttttaaggacttaaaaaaaattcatgtagatcacccattcttctagatagcataaacttattatcagttaattcaagacatcactgtcttgtcatctcactctgattgtttatctcaattacagtgggattactaatgtcatgaaaggcttttggacagtaaaagttgggtccttgtcattctccacatacactgttatctgccacaatgcttgtatttcccctgatttttgatcattggtctttgatcatgatcagtgtgtagctgtatctccttaaccccgccttaagaccccacactacatccattttcaatgtcacatttctgccacccttaggtggtgggaaacattttgctccttcctgtgtcatactcagaggcacactgaaacgtactccatcagttctctcttccagggagccatttcttcttgaaatcttgacactttgctggcctttcctgggaagagggtagagaatatatgttccctcagcaatcagagtccccagaattacctggaggaatcaatagtctgctcctccctgcactgggaattttcagggaaattggaaatagggactaaggcccattctcaggaactccttattctctaaactttcctctgctgttctaaggtatcctttatctgcagattgttgattcagtctggtatgttactctgactcttccactgatctttcagaacccattgtttataccctaatccagcctttttgagatgcaaaagccaagaacttgaagtcttactgacttcatccttctgtcatttcttacttaaagtaatttgcatagaatatagtatttgttacctgaacaggggaaagaacagaataacagaaagtgacatgtattccaaaaaacacaaccacttttatatcaaaatattattctatcacagatgcatacataaaaatgcatagtcatagattaaacaaaactcacaaactttgggctcttggcatagcatgttttcataaaaggccagacatttttatatataaattaatatttgttttcattggcctttccatctattcctgtctgtataccagggtggcattttagtacatattagaaatctatgccaaccagcatgtcatggaacacattaactggattcatgcctattctattcaataaagttatctctttagactgacatcttcttcatctattataattattactctcagtaaagagtgctagaatgtgcttcaattttacacattttaatgcactatcagatcttactaccagacccagtcttttctcttttaataagggaagttttatggtgattctagacagtaactaacatgaaagagccaaaatgaacaaaatcaaatgaaggatacaagaaaatagaaataaatttgaaataatgtgttccttgtttatgaaaactagtctgtatatttttaataaacaatgaattattcctttccttttaggggtaattttgagaaaaatgttggagtagatcactggacaagccattaataatgtaaattgaatcaataatgatagacactcattacagggaaactgaaaaataacttttaaacgccatttttcttttttcccaaatgagaattctgtgtacctgagaaagcacttgattaagggtttaaaagaggtactaagtttggctctgctagtaataagtaattcactttatttctgtgagctgtattttcttcaacaataacagaagagattggactatgtcagtgtttcccaaagtgtggagagcataccactggtgtcactcaggataattttaggttgtatatcaaataacagagtgagagagccattcttttttgaattctaccatcctgatcctgattaagccaaagattaagtcttgtggtgctagttttggggttacttggtgttacttgttctgctttttgaggataagaacggactttgaaatcagagccttttggtatgtaatagcttctagataaagcattgtgtgtttattgtattaattttttggttatcttctttgggacaagggatgttgatttcccatgtatgataatagaacaaagttgccttttagttttaagaaaagcattctattaaaaaaaaaaaaaaaaggaaatgaaaatgcaggtagaatgtccatgactaaatttttgatactgctggagaggtgatctataaggacatttcatagagttcaatatcattttgttttattttggttttggtcaaggtgaaagacagcatggtataagttaaattgtcctccctttgacttattaagcagagtgcatagtggtaaaatgaagttcagaatgtaaattcagaatataaataatacacatcttctggagcatcagtcttacttgaagacttcaacagctgaattcacagacacataacgaacatacaaacagatgtattgaggaatagatgctaaatttgtttgaatttgcaggataaagcactactcttcaaatacattgtaaattctgcttattgcagaattgagcaaagagaaagtgcactattttgaaggagggaatgtaaatacgtgtgtgtgcgtgtgtgagagagggacctcacagaaatgaagtgaaaaccccaaagagacagtcagatccagaggtttatataccatttttaaaaacagcaataaattcttagagaagtgacaagacaaaggaagacaaaggaaagggttttgagcctctagggcagtgaattctaggaaagtaaacatatggggaacctaatggaaggcaggggttattttagcagggcttgttacatatattcctctcctctcggtaccatctatcagctaataagagcctagagtcttgctgagagcaggtagggggaacacattcacaaagggaaatttatacccctcttttagacaaaaaaggtgaagatagagagctgctttctgtgtctgatgtttctcagttgccttcaactcaaaataatccttatggcagagtgacgttttggatggcatactctgatccccttcaaggacaatatgcagaggtcatgaagaccatctggtgccaaaaatagagaccctgaaattacagagtatttccactgtgagcacagaagtgatccagtcatgaatatatcttggagtttgactaaaaggagcagggtctgaatgaggtcaaattgctcccactcccttccttgttcacctcctctccatactaacactgttgtaatgagagtaactacatgcaagtgaagtacttgcacagagtcacaatggcttgaggcctagccagctccaccttgggagaaaatctgggaagaaaatcaggaaaaaagggtttgtgctgaagacaaaaactgaagagaataagggctggagggaagaattcagagtgatatgaaaaggattaaaataatcctatatacttgagagtgtctggggaactgcttttatatccctgcaagccaccacttgtataaacaatgaattatactcttgcacacttgctttttctcctttctttgacccattagtaatattgccaggaaagaaacgtgggtttgaaaagagcagaaattcattctccaggtgatctgtattgtgtgcttagaatggggcagttgaaacttcttggtacttatgttcctgccgccccctcccccccgacgccgccaccctcccgccccctactctggggaaatgggaagggaatcaacaagaaaagcatactgcatctctaaactccaacttcacagtcttctagccataaaggacttttgatagaagagtttgaaaagcaccgagaaagagaccaggcttagaaagtcttgaagcccttgtttagcattgcagctgtgggatcttgggagagttttcttgcgtcctgagcctcctttccttattagtcttatccaccaaaggttgcaggaggtattccatgcctgatagaatagtggtagacaaaaaggaaactaggagctttttaaaaattcagaaaatgcatatatttatacataaaccaaggcttgatggagaagaggtgctcagtaaatacttagtgaatgattggatgccagtgccaattctgacactctcagaaaaaccagccaaaatgtgcctctttgagaaaacaatatttttataccctgtggcagtattacttggttacaccaggtactttgaaaaatacttccatttttcaaatccagagcaacattctgaggtgtgctatgaaaaagccaaactctgcaaaatattcgaagagatttatgttgagccaaatgtgaggactatgacccataacgcagccccaggcggtcctgagaacacgtgcccaaggtggttgggttatggcttggttttacacattttagggagacatgagacattaatacatgtaagatgtgcaattggtttgatctggaaaggcaggacaactcaaagcaggtaaaggtggattcaaagatattctgattggcagttggttaaaagagttaagttattatctaaagatctggagtcaatagagtgtctcggtttagataagggattgtgaagaccaaagttcttacaatgtagatgaagtctcataggtggtcatctttagaggcaatagatggcaaatgttttctatgcagaccttcaaaaggtgctggactctcagctaatctcttcaggatcaaaaaagacctggaaagggaagaagattctctacagaatgtaaatttactccataagagatagccttgtcaaagagatatattttggtgtaaaatacttttctttctttcaggacctgctatttgtcatgtgatactatactagagtcaggttagaatttggtatcttattgccacaaagggtctgtttggtcagtcttaagatctctgttttaatgttaatactggtcagttgtccctgaattaccaagggagaagcatataatgaggcaagtttgatgcccccttcccatcatggcctgaaccagtgtttcagggttttttggaatccccttggtcaagagggggggtccattcagttctttggggggcttagaattttatttttggtttgcaggtgctttacagtgttttccccatagaggcagagttctagaatttcctactttagtaacatttagtaaacattgtgtgtccacatggccaccattgatgtagcttcgatggcttactactaagttcctgcaaatgtatctctcaatatattccttagagagcaagcacagataagaaggaaagtgaagatgggtaaaaactaactttttgatgcaagcatccctggcacccttcagtatcaacgtaagtactttttaatcaattgtattttgccagaggatgggcctctgttaggagcagtaattgctgcacttcacttcttgccgtgacttcagggaaaggttgaccccaggcactgacctgagtttacttggcaagagatccctgagggctttcatctagtacaatttttgaaatcagcttttatattttgttgactttctgaaattctccaaagcaaaataaatctctctgtagaggtgttataggaaaagggtcctgatccagaccccaagagagggttcttggatctcatgcaagaaagaactcagggcaagtccataggctaaagtgaaagcaagtttattaagaaagtagagagacaaaagaatggctactccatagacggagcagccctgaggactgctggtttttatggttatttcttgatcatatgcttaacaaggggtggattattcatgcctcccctttttagaccacataggctaacttcctgatgttgccatggcatttgtaaactatcatagtttggtgggagtgtagcagtgatgccaaccagaggtcactttccttgccatcttggttttggtgggttttggctggcttctttactgcaacctgttttattagcaagggctttgtgacctctatcttgtgctgacctcccatctcatcctgtgacttagaatgccttacccatctgggaacaggtctcagccttattttatccagcccctattcagaatgaagttgctctggtttaaatgcctcagacagagtcatgacagccttatgtatttctctggccagtggttccaggatggggtaaggtatgccgcaagcttggcagatctttggaaaacttgttcaaatgagctgttggtatagagagtgttgtggcagtcacaaaacactgtcttcatcttatgaagtcatattcaaaaaattaaagtttattttcccaaacaaggtaatgtttccatttaactataccaatcgacttctgtattaggtaggaaccgttgtttgcaaatattagagactagacagatgtgtgttaagaaaaggtagagataaatgtatcagcttgccaggtttctcacagaatccaaggaccaacatccagtttctcaggaaacactagaggcaaggtctgggcttgactccatctcctctttttgctccccagttcacgcagcggagcaaacccaggtctttgtggtacacaccaagcccttgtgctccaccctcggacttgtgtgccattccacaggcccctcttccttcagagcagcattccccaaccccttttccaggacagcctggcttcccacccactgtctatcaatcaatcacctcacttttcctttcattgcacttaaaccagtgggaaactgatgagtttacttgttatctatcccccatacttgaatgtaagcttcatgagaagcttattcatgtctctcttgccatcatctagagagacaaatgcttcccacatggtagggtctgaataaatattgactgaattaatatataaatacaggttcagctgtgagggacccaacaatcaactttcctctcaggtagaaatcccctatgattaggggtagccgggcaggtacaggagactattatgagtgaggagatactccccaaaatgtccactacgacttggctaggtaggacagacaagaatttccttccctacccatcagtgaatgtttgataatttgagtttataaaataaactggcaatagaccagttaacaggaaagaaggtatacatatttattaacacatgtatggacatgggagttagttatacacgaagagtgagactcagaagaggggctaagatgactgaagtttttatattatcctggggggacaggaagaatatggactttgaacatgtcggggggggcgttataggagggagagaggaggaaaggcctgggagtgaaggggtcctgttaggcagatgaaacctctcaggtagcagctctcagaaggaacagacaggagcttgtggtaaacgcttctctgtcagaaccttatattgtcagacttcagcctccttttcctgtgagttaatctttcctagatccagataagaggtcctcagagaaagtctgtttgcatctgttgtttacttcattttactaatgtggatttcctctccagatgcaaatctcccgaacaaaagggcagcttttcaaggctagttttgtgatctgcagcccctcagaacaggcatctcaaaatatgccaaaggagttgagatattctggtttctttcagctaggttagccaacttctagtattttcccaactaaacaaggagttacgtattacacagtggccttgcctttgagctgcttaatcctaatcccttcaccaatccagtgatttcaccagctcaaagagctaattgtggcattcacagaggatcctggtatgagtcccaattgtgtcaactaaatgctctagtttcctattcactccagcatacgtgaaaggaattgcaaattataagcttgggattcatatttataattgaccttcattattcacaaattccatacttgtgaatttgcctgtttctaaactttatttgtaacccagaatccacattcactgtgtttacacatttatttatggacatgtgtagagcagtaagaaattggagtcatccaacatacacactcccagctgaggtggaaccaggtgatgttctgccactttgtttcagctcttcttgtaaacaagcatctttcttcatggtctattgattgccacattttttgcacttttgtcctttgattttgctgtttaaaatggcccccaactatagtcctgaagtgctgtctagtgtttttaagcacaagaaggctgacatgtgccttatagagaaaaatatgtgttagataagcttcatcaaacatgaggtacagtcctgttggctatgagatcaatattaataaatcaatactatttattaaataaggtatctttaaacagaaacacacataaaacaaagttatgtattgatcagttgacaaaaatgtcatgaccagaggctcacagaaacctaagcctatgtttcccctaggagcagtggctcaaaggaaaaaggacttagtacccgtgattccagcattcgaagtgccttgataaaacataactgttgtgattaatgagaattgatcggacgtgttaatccagtgaaatttagttcaagggattttcatacctgtttttatttgctacatcatgtagatctcagttgaagcatatctttttctcaaaacaagccattcagaacacaaatcttttattttttttaatatgcatcctttcagagaatcattctgtttttctttaccacttgtctacattgatcccaggccattggtgtcaggtttgtgagaattgtataaatatatccataaatatcgggagtgcaagcactgttctaccgttgactggagaaacagagattgtatttctttagttcactgttgacaggctcaggaaagggctcattgagccatagaagttgacatttggcacaattcattccacctccagagtagcgaagcttcaggaaaccatcttccattctttctaatgtttctggtcagtcatcatatggcttgccacttgtcttggtcctgaaattaattaagaaataataacggaaaggggaaagtaggaaataggtaagatgaataatgattaaattcaatgcaattattatgaattgactctagagtaaatggaaaggacaggagatgatagcctttaagactggtggaaactcatcagcaaagggtaatttggttgctgaagtcagacttcaaactcagtgaggattatgcagggcacaactgaaaagaaaggtggacttgttacacttgcacaattagggcttgcaaatggtctttttcggtcagctttggcttgctcattatgttggctttcccccatcctgagtgactaatccatgccgccatttcatcatcatcaatctttccttcattcattgtgcatttacttggagctgctatgagtttctagacaagatgagactgagagatgctatattgtgtaaagtttaactgtttggactgtaattcaagagtgcctggatttgaattgcagcttgccacttattaactatgtcatttcagtctggttaattaacctgcctgggcctcaatttccacaactgtgaagtacagataaacaccaggccccataaggctgttatgaggattaaaagagatcatcctcatattgatgctctgtgcagtgcctggcatagagcaagtacttttctgagaaacagaagagtgaccactgtgccaaggtgttcttagaaaggaagagtggtgcaagacaaggtaagcaggtcagaatcctgcggggcctcacagggagccaaggcaaagatgtttaaacaaattcttaaatgtctttgcatggtttgaagcagggcactgacagcattgtttgcaagaaaagaacgtgtattgccgaaactatatttagtataaatgatttttttaactagaaaaatttgcaagacagccttactactccacttttgttcagcctgatcagcctctgagctaccccacagtgctcctaaataccctgacataaaattctgctaggatgcactaactttgatgttgatgataaaagcactggtgaaagaagcattaagatctgatatccatgatgtgcttacccttgtcagtttaacaggcattattttactcaaacctcaccacttcctgccactgtcttattatcccattttatggatgaggaactgaggctagaaatctcacagttaggaagcacctggatttccactgcacattttctgctccagggctcactggtttctcactgatttccagaggggacttgaatgtgatggagacacagccctgtggtcagacaagctgtcttagctctgcctcttgcctctgtgccctcagttttcctatttgaaaaatgtgcgtaataccacctacttcagagtggttgtgaggaatcactgtatacaaagcagtcagcatagtgctaggcatatagtaaccacttcttaaatgttctactatggtcattattttgctgcattgccagttcactatggtgttttccggatctaatgcacagaaggattagaatgctttgtttccttaaaaggcttctccttcccattaaccagctcccttgtctctgagacagcgtgtcatgcatgatagaaacacagcccatcccctgtaaaggactgctatgtcatttacacatctgttcctcctccctcgataggggtggaacagagaagctctttaggcacacattcaggaagctaagccccaattctttctaaactagttttctccatattatgctttttaattaaacctttcaaggtttaattaggaaacaacatgagtcatctttgtttctgaaaatgtatttgtggtttggctaattatgtagtgagatttaatatgatttctcctcatgtgtgaaattaatacattgaatatttttaaaaggaaaacatctaaagcatttacctgggcaccagatggtgagcaaataatcagttcaaaggaattcctcttaaagtaatgctaagaaaagctgtgctggctttaactgggtcactttacataggatgcctcaaagagagagaaacactgtctcttaaccaatacatccattcctgcagcctttagtgtcactccattgcttggagataagatctagctttctttacaaggtgcttcactctaatactgactcccacccaactcgtgaatgctcttctccaactacatcctacactgtcattcttcaaaaccatgacgctccctcatgccttggtggtcttgtacatggtgtggttctccctgcagtgccttgtctcattgtttttggataaacttatctgcatttgagttaacaatatctttattttctgtattctgatgctttgacatcatgggggaattgctgacgctggaggaactgcctcttgcagggttggtgaattcctagacacagcaaacagctgcctacctgcaaacctccttatttcatatgcaaaccatctaatctagggaacatatccaaccacctccatgatcaggctctcactttctggaccactgtctccctcccctaatcactccagggtcaggtgccagacaactggggacagcccctccacccaacaccactgaaaaattcctcaaactagcccatcctaagcttgctatgtctttgcttggtctctccatggaacccacaatagaggctcctgcccacattttcccttcactccctgtgcctcctgaccaacccccaaggctttcctatgtgacccctcttgagtggcatgatatgcctctgcctctagggatctgtaggcataaggttcttccatcctgacagtactttctatgtctgcttgttttaactgtaaccaagatttgtcataattggttatagtaaaacatctttccaagtgcagctcaaaagctactttctctgtgttggcctctccatttctcttccaaagatgcttactgttcacaagctgcattgtaatacaaacatgtctgtcttcctcattaggctaagctttcctaaattccatgccatgttcttctctgaattcccaacctttagcatgaggcctgacataagtactatgcagtacacatgaggagtacgtgaatgaaatgaaaataatacaccctttcaagctgaatccattagtagcagatgagtcagaaaatagtagggtatgaatgtttccctaattctcccaatatgaatgggcactgtaacttgttggttcaaagtacaagtccctcaatttcaactatgccatgtcccaagtatgtggctttggaaaaggtgtttcttctcaatgtgctttggtttttttatcttaaatatagggataataggccaggctcagtggctcacacctgtaatcccagtactttgggaggccgaggtgggtggatcactggagcccaggagtttgagaccagcctgggcaacatagcaagacccagtctcataaaaagaaaaaaatataaattattttatatagggataatagtagtatctatctccaagtgctttaaagatgaaatgggcatggtggctcacatctataataccagcactttgggaggttgaggcaggaggatcgcttgaagccatgagttcaagaccagcctggcaacaaagtgagaccctatttctaccaaaaaaaaaaaaaaaatgaaagaaaaaaattagccaggtatgttggtacatgcctgtagtcccagctacgtattatattatatatatataaagatgaaaagaaataaggccacaggtcttttgacaaactctttgctctacctgtaatactcttttcttctcctcctctactgcctaacccctccttacccttgatgtcacagccccagggccactttattagagaaaccttctcttatgtttatgtatacaaatatgcacacacacatacagagagagagaagtggaaggtggggaaaatagaaaaagatttattttaaggaattgggtcacacacttgtagaggcttggcacacaaaattttcagggtaggccagcaggtggagacccaagaaaaggttgcagtttttttgccaaaagactgccttttgatacaactgttgttcttccagggaagtcagtcttgttctattgagactttcaactgattggatgaggcccacccacattctggagcctaatctgctttactcgaagtccactgatataaatgttaatctcatcatatattatagatatatatatgatgtatatatacacacacacacacagagaaacatctagaataatgtttgaccaaatatctggacaccgtgtcctagccaagtttacacatataattaaccattagagattgtaacctgaatgagggcaagattcagtttaatatgcctaactgctgtatctagcacattaataattatttttcgagtggacatacagtactgcagagtacatacctaaatgcatagtctgtggtggatggtgttgcactatacaatagaaacttaggaaacagccaggacccagcaatttaaacggctgtcatatgatgaaaggaaagttcccagaacatccactagtgaaggtctgtaagaggggtgataggtagagggaaccaacaagatgaccctttagcctaggccctaagcacagagggtgacggcagtcaaagaaacttttttttttttttttggctatctgtcagtttttgtttccaaaccccaatgtagactttaataagcagagctggatcacacttgggtcacaaggattacacagttctccttaatctccttttaccaaagactgacccagagagaaacactctctaacagaggcccacctcaaatgccttactgctccttccaggtacttagctcctaccctggtagtcccagaagctctacccctgccttctctgcaggagggaatgaggactggcagaactttcagatgccacaaggagccaaaagagaccacgtttgtgtacatcactttttatctaagtgtttcaatgaacagtcaccgagcatcaattcaacaaatggatattgagcaccaattatggggaaaggagatgcaacaggccatataactaataagcaaaggtcaggcaggaataaatattagggagaaaaaagaaagtaggaccagtaggaaggtgagcatctggggaggattctgttataaatgggtggtcaggaacgacctttctaatcagctgacatttaagcatacacctgaagggactgagccaagtatatatttggggaaatgtgtttgtgcaaaggtcctgaggatgtatcatgctttgttcggggaagagcacagtaactgatgtatctagaacagggtgaaaaaggggaagaatattcagacaggaggatggagaagcagcacggagccagatgcaatgaagcattctggatgatgtaaagactggacctctctccctgtctgaggtggctaccacctgtgggttttgagcaaaggcctgaaatcagggtcatgaagaatcaatgggtgcccagcagagggcctgtactctgaaacaaaaggcaatctcccaaagaaatctttattttctaattcactcaaagttaccttttgctcataaagtttgctttctaaggattactactttggtccagatgtgccacctttattacattctggcttctgtgaggagaaatgactgtgggggcagggaggaaagccaggagatcagttaaagaggcttttgcaaaacccagggaagataggatggtgccttggactaggatggcagcagtagacatttcgaaaagtgcttagattttgaatatatattgaatgcagagataatgggatttcctggcatgttagtgtgtggatgtgagagaaaaggatcagtgatagcctcaatgattgtagcctgagcaactggaaaatgaggctgcacacagcggaaacggggaaggctctggtggggcctaggcctggagagttggggaggggaagaaatcagaagtttagtgtacatgtgttaagtttgagatgttttaagttggatatacaagtatggagttcaaggcagaagatgtcagtataggagtaatctgtgtagagatggtaaccaggccaggatactggttaagatcacctaggaggtaagtattgattaaggtcaggaagatgaggaggaaccagtatataagtctaataaagaactgccagtgagataagaggataattgaaagagatgttccagaaggccagtgttgatagtttcaagaaggaaggaacaatgaatggtgtcacatgctgctggaagattgactaatgaaactggcactggaccgttcagttttttctcatcatggaaatggagagagctaaaatcaccaaatatttaaaggagttttgatatcaaagggagagaaattaggcagtagttgaaggggaatttgggatcaatggatctaatggagcacatctgcatgcagattagagtgaagcaagagagaaagaaaaattgatgatacagaagagaggctagcaagatggtatgctcaagtggggaagagaagacccagagtgtgagcaagggctgaaccctagcagcatggagagtccatgtagagcaacagggtgggagacaaggtgaggactgatgcagagtgagtgggtgttgggaatatatggaagtcctcttctgatggttgtctttttcttagtgaaataggaagcaaggtcattagaaaagaaaaggaagactgtcacatctatatcaccttctcttttgattccagtgtctcccaattggaatcccaaagaaccagagcaattgattacaaaagtacttggcaactgaaaagcatgatcagtcgcagaaataatgattatttcttgaatgactgtgatctctataagccttgagtgccctatagtttattcctagagcgaaatcatatttcactggcgaagtaatttaggaaggaacgccattctgctgactaactcagaagcccacagtgtagtcgattctccttttgcctcccccttgtctcttttttattaagtagatcaaattagcctctcctctcaaattgcatctcccaatactgaaagctctaaagaaaaacaacacacaaacagagtagcaaagacaaattctgcaaatgaagggaacagaacagagaagataatctgagcaggcaagaccaagtttgattcttggcagacataggaggaaagaaagctgtgaatactcacacattaatgatttttatattgtcacaactacaatcaaagccctgatgacagtgttgtcataaagtctatacagccactactcttggcttgggtttactgtgtatcctgggctacaggttcagaattcaccatgataaattattccaagactgttcaagctccccttatcacactgtgttttagtatctcttcccaagcctaaaatacaatgtgtacttttacaccaaatatagaatctcagagaaagaagcttggagtttatcttatccaatgcttcttccagttccagaattattcttatacattccctggcagccagccatttgtactttataaacagcctcagttataggtcgaccattccacttatgggatgttttgtattataacaagctgaaatctctcccttctacttctaacttttgaatctttgactactctctggggccacacaagacaacacacatcctatcacctttttgtggggacccagccaccatctttcctccatcttgcccaataaaggtgcaatcactttctgaatcacaaatatgtcttcatttagggtaaaagctttttgtataatctttgcttgctagtaaattagacatttaaaaaacgaatatgcctactggaagtgaagttctgagtagtcctttgcctagagagggttaaaagcttctgtaatgccagcactaccaaatttaacggaaaggacagaactggatgaaattatattttaaatgatatatctgccaggattactacaaggaatgaaagggaaggagcaccaagttatctgagattgaaaggtaaaatgagggagagttgctcaccctgcatcccactgaactgtcacctccatcctgctcctgaacatctttcctctgtcacacattcattcagtggctgcaggctccaatctttgagctaggtgccagagtttcaacggtgagcattctttcacttactcattcaacacctatttattatagacttaaacgttgccagcatcatcctaccaatgggattagcagtgaacaaaacaataggaaaaaacattcctctctttgtgcagttaatattctagtgaggagaataaatgaatccagcaataccgtaaatatatgcaaaattgcagcagttaaccatgctatgaagggaagattcaggatgctacaaaagcatgtaatagaaggaacctgagctagttcaaatgaggaggaaagcctcccctgagggggtgatgcttgacttgcgctcttgaggatgagcaggagaaggactggcacgggagtggcatgtatgagaggtgaaaggaaggcatgatcaaggttagagatcagaggtaaggaaaatccagacaacgcagggcttgtgggccatgttaagttttttcacttgttagctgatgagcagtgagagtccactgaagtgttttaagccaagtgtgtgtgtgtgtgtgtgtgtgtgtgtatgcatgcatgcataatatgagcaaatttgtatttataagagatcactctttctgcaatgtacagaatggatgggaagggagcacggtgaaaatagagttaggaaattattctcatgttccagaggagagatggcagtgacttggatcaaggtgatgacagtgggtgtaaaaacacagtgacagattaacaagagtttgaggaggtaaacccaaattgtgatgatttgaatctgggaggcaagggagagcacgaagactgtagaaatctctggccaggcctgtcatgtgcacagttcagttatctggcatggaagataatgcactgcaccagggtaggcactggacattgttggtttaatatgatgttcacataggacacctagttactgttatgtaaccaatggagcaagatgtaactgtggcataagaaaatataactagatacccgggcgtggtggctcacgcctgtaatcccagcactttgggaggccgaggcaggcagatcacgaggtcaggagatagagaccatcctggctaacacggtgaaaccccgcctctattaaaaatacaaaaaaacattagctaggcatggtggcgggcacctgcagtcccagctactcaggaggctgaagcaggagaatggggtgaacccaggaggtggagcttgcagtgagccaagatctcgcctctgcactccagcctgggtgacagagcgagactccatctccaaaaaaaaaaaagaaagaaaatataactagatattattctagtggttcagctttctaaagacttattatggtggttgtttacaagtatgtgagttaattgtgctagagtttcagaatgatatgtttaaggggtataaatatctataagcccccagttaggtcttcctgcaaactggcaagactacacactgaagagacagaatcccatagccatcaatccatgccaatctggagagacttgagaaatttctcctcttatatatcctccagcttgagatctcttactttgctaagaatgtgtttgtttttttgtacttatggcagtaaaatataatgtaagatgattgaaattccagcatgctcatttttctgaggtttcacatagtgctctgttggacttccacagcatcagaaatggaatcctaggtagtgactaagggtggcgatgccactcactgggaaaggaagttctgtaagagggtcagacttggggaggaaatgccccagttaatttggggcatattgagtttgggtgtctaagatgaaacacagtcatggagacgttgatcaacaatatgagtctggagttccaaggagttgtctagaatgatggctctaagaatgacttacactgtctcaggggagaaccatgcttgatcaagaagcgttgcatatcagaaatgctgtagagagccatttctgcaaggaaggttgggccagggcctccttactctgaggttctatgatttattaatagatattattaaaaccacttgagcatctgagtaaagctgtgttagccctggatgaactggttagaaagaaacaagactacttcagccagcttatggaaatgtatgaggaggaaacaggaatgtgagatggagtccagagccagctgggtctgatgggttccataaataagaactggactccatctgtaagacagatgatccctttctctggagggaaaggtccttgcttttgctggtgataaaacaaaatagccaccccaaccctagccagagtggccaacagagattggccaattccacactcttgccccaggtaaaatatcctgccagcccatttccaagtatctcagtccagggagtctgcccactgcctgctcagcaggggttatgggaacagagtttctcagaaagggcattggcaggcttgataaattgactaacgtgtctgcacacaatataatgaatgatcttcccatctttgaagaaaaaaacaaactttctgctttccaatcaacaactcttaattatctttatggttattaattcgtacatccatatttctccttgatagtttattactcttatgctttctgtcaactattttctatctgtcactttccagtactggatattaacgtttcctttctcaaattctagtcatctccaaagcattttgcacttctcaattgtatttatgtcactgtttgatcttgttttgtgtctaagtaagtggttatcttcttgtaatccatcttgaagatggccgtactgaaacattctgaaattcctgaaatattttagaactatttgcatcttgttttcttttcagagaccttgcctattacaataattatgaggagggtcagcctcagaccctaaataaaactgccccctaagaatgtttgtctctcctgaaaatagcacgggcatctggacatgtccaaaacctaaccccttagcttcttccctgttccttgtgctgtgttgtcagacttaagatataaatctggttgtcatccctctgcgcattaacctctatcctacataattactttctaacttgtgtaccacactctgcaatcttctctatcctgaagccagatggtctctctaaacacagttttaccatgcctaccatgaaattcactgtttaactgcctttaaaggaaagaccccatactcctttcttcagccaacaaggttctaatggcctattcacccctctccaactccctgggctttaacaaactctttatgctccttcagcctgacgaagtcttttttccatctcctgtttctttctccttaaggtcccctcctcaagcatgggttagccgcgccaggcccagctcagattctccatctcattctaattctcttacaataactgctttttgttatatttcaatggtcaggtttgtcttccacaggagaggaagtgtaatcagtgctgatgttagggccagaatggttgggttcaaaaccaagttttgctgctacatatctgtatgattgtggtcaagttacttaacctctctgtgcctcagttttctggatgcaaaacagggatagtaatagaatctgttaaacagtacattgtcctattctctacatttagtactatggtaacacataaccaagcctcaaatatctataggatagtgttcaaaatgaaggtaatgtttattcaggaccattgcaataggttcagggaccactgcacctgcggttttgcagccagggagagaaattgggctcaactctaaacactgcaagttgggaatgtacagccaagtagcagggtgagggtcaatggatagaaaataactaagaggaagcatcaggggtgagggagatcctgactcaactgacccaacaggattcttgcagagaaagaccaggtgatcagacccagggggatggtggaggatgaggaactcaaactgataacaagggtagcagggggagttatttctaaagctggattttacaaggagtggggaaaagaggcataaggagaaagttcagaagcccaactaaaatttggtcaagcaaagaatctttgtcaatggacagccagtgttcaatatttgattggagatagaccaagtactaccttctggtcaattgttaaaaacatatagaactgaagaatacctaggttcttaaaatgattcaaaatattagcaaaaactcagcagaagttggcaaaaataatgttagaatagcagtgtttccaagtatatgctagaaactaaattcttaagcactctggaaataatacaaaactgtgaagttagatctgggtttttttctgtctatcttggtttcttcataaatgagaataataatgccaatattacatgagtcatgaactaaataagattatatgcataaattacctatcataggacttaatagagaaggtaattaatacactgggtttcccttgataaatcaccttccatctttcatacaaatttattttcaatgtaaagtacaaaaggcagttggaagagataagaacaggtaaaactttcctgtttaccctgtgaatgttaaatagttcaatccataaacaatacaacagctaacattttgaaatagcaaagtgtgctggacactgttctaagtatcttacattaaatacctcaattatcctccccacaatcctgtgaggtcactactagtgttatcctcttgtaacagttgggtaaactgaagcttggagaagttttcaaagaagaccaaaagataatcagaaacagagaagaataacttcgtgacaaatctcagagtccattctgaaacccatggtagcattgaacagggaaggaagcaatctcaaaatgatagattttcctttgctcagaaactggaattctcatagtaatggtaccttcttcctctctctcctcccatgttcagaaaaaagttactgcatgaggtagagcaacctggccaacatggcaaaatcccgtctctaccaaatttccaaaactagccgagtgtggtggcaatgcctgtaatcccagctacctgagaggctgaggcaggagaattacttgaacccaggaggtggaggttgcagtgagccgagtttgcgccactgcactccagcctgggtgacagagcgagactctgtcaaaaaaaaaaaaaaaaaaaaaaaaaaaaggtagagtcactgcacatgcttagaactgatagaagcttgattcttttttatcagcagtgcccccccaccaccaccccaagataagactttttaaaatagtggctaacatttttctgtcataattatttatttcttagccaaaagataagccaacagttgcttagagtagcatttttttcaacttcaccgtgcacaatggtctgtgtgactttttccctcactaccccaggattcaaacacattcataaacatgctccaaaatcacctgagttgcaaaaacatcacttgtataaaagagttgcaccataactgatgattgatgttgtctaacccagagaactatattgcaatgaagttgaggattaatcgttaaatgtgataataatcctctatctttgtttacatctgtaattaatgcagttcaggaagaagcccttgaaaccttatgtaaacaaggtctatccttactggaatagattacagccatatgtcaccgttcaaaaggtaattggtacatttcattagaaagtaattgaaaaaaattattttaatgcctcataataaataatcctgataaacattattagcagagatatctgtaccatgtagagaatttgctttgcatcaaaagatggcatatgctatatatcattcttggatttttctgaggagcttttacttgccttgtgattgaataaagactagtacacaattacatgcgaagctttcctttgagaacaagtccttcttatagccacatgcctttaccatccccctgactggcattgacagtaaggccttagtttactctctatctctccggtgaaaatctcccacgtgtattaacagaaatacttctaacagtggcttaacgcaaaggcctcagaggcagtgagactaggctgtgagctctcatgctttagctacgtggaattgatgatgggatctatctctcagggttgtagcaagcatgaaatgggatgatacacataaaggatttaagtaattcttggaatacaagaagcactcaatgaatattactaaatgatatcatcattatcttttctatcagtgtcttactgcctgatcttttaagattagccatcccaggctgaccttttatttaaattacattataaaatcaaggttagtatatataagtaatttttctccattcagtaaaatgtgcaatattctcgttaccagccataggcagaactaaaaataacttctaacatcccatgtccccctctcctcagcaaggccctgaagtgaaaacagaacaattctttttagagtttcataactttgtgagctactatgtagattaaagccattccatttagttcttcaacaaaggaagtgcaaaaatcccaagaggccaagtaaaatgaaattatacttctgacagggaaccacctgaaatatcaaaacaatggccaaaaagaggcaagttaaaaatttttcattgtgcatctccaatacttcagcagcatttgagaggttttctccacctcctttcacaattgtaccacaatatagtccagacctacactaaagacaatatacacatttattacaagtatataattagaatttttattacctttaagattcagataagtgaacacttatccaaaatcacaggtctactaagtaaaatgtcagaccctagattctgtgcagttttttttagcttttatgtgaagttcaggagtacaagtacaggtttgttacataggtaaacttgtgacatgggtgtttgttatacagattatttcatcacccagatattaagcttagtaaccattcgttattttccctgatcctctctatcctctcaccctgccaaaatgccccagtgcatgttgttcccctgtatgtatccatgtgttctcataatttagctcccatttataagtgagaacatgcaatatttggttttctgttttgtgtttgttagtttgttaaggataatgacctccagctccatccatattcctgcaaaggatatgatttcatttttttatggctgcatagtattccatggtgtatatgttccacgttttctttatccatgctatcattaatgggcatttaggttgattccatgtctttgttatggtgaataatgctgtaatgaacatatgcatccatgtgtctttataatagaataatttatattcctgtgggtatataccctgtaatgggattcctgggtcaaatggtagttctgtctttaggtctttaagttctgtctttaggtctttaaggaattgccgcactgtcttccacagtgactaaacttatttacactcccaccaacagtgtataagcattcctttttctccacaacctcaccagtatctattatttattttttgactttttagtaatagccattccgactggtgtgaggtatctcattgtggtttggatttgcatttctctgatgattactgattttgagctttttttcatgtgtttcttggccacatgtatgtcttctttttgaaaagtatctgttcatgtcctttgcctacttttaacgaggtttttttgcatctgacaaaggtctataatatctagcttctagaaggaacttaaacaaatttacaagaaaaaaacaagcaaattttgcaaaaatgttctcccattctgtaggttgtctatttactctgttgatagtttgtttctttggctgtgcagaagctctttaattagatctcatttgtcaatttttgcttttggtgtttcatcattaaatctttgcccatgcctatgtcctgaatagcatgtcctaggttgttttccagggttttcagagttttgggtttcacatttaagtctttaatccatcttgagtgaatttttgtgtatgatgtaaggaacaggttcggtgtcagtcttctgcatatggctagccagttatctgagcaccatttattgaatagggagtcctttttccattgcttgtttttgtcaggtttatcaaagatcagatagttgtaggtgtgtggtcttatttctgggttttctattttgttccattggtctgtgtctgctcttctaccagtagcatgctgcctccagctttgttctttttgtttaggctattcgggctcttttttggttccacatgatttttaaaatagttctctaggtctgtgaagaatgtcaatggtagtttaataggcatagcattgaatctataaattgctttgggcagtatggctattttcacaatattgattcttccatgagcatggaatgtttttccatttgtgccatctcattgagcagtggtttgtagttctttagagacatttcacttccctggttagctgtattcctgggtattttattatttttgtggcagttgtgtatgggagttcactcttgatttggctctgggcttgactgttgttggtacataggaatcctagtgatttttgcacactgattttgtattctgaagttgcttctcagcttaagaagcttttgggctaagaccatggggttttctagctatagagtcatgtcatttgtaaacagggatagtttgacttcctgtcttcctatttgaatgccctttatttctttctcacctgaatacccaggtgagaacttccaatactgtgttgaataggagtggtgagagaaggcatccttgtcttgtactggttttcaaggggaaatacttccagcttttgcccattcagtatgatactggctatgggtctaatacttagtttatcgtgtttttaacatgaatggatgttgaattttatcaaaagccttttctgcatctattgagataatcatgttgtttttgtctttagttctgtttatgtgatgaatcacatttgatttgtatatgttgaaccagccttgcatcctgggattaagcctacttatttgtggtggataagctttttgatgtgctgctggattcagtttgccagtattttattgaggatttttgcatcaatgttcatcaaagatattggcctgaaggtttctgtttttttctatctttgccaggttttggtatcaggatgatgcctcatagaatgagttagggcagagtccctcccttctcaattttttgtcacagtttcagtaggaatggtagctcttcttcatacatttggtagaattcagctgtgaatctgtctggtcctgggctctttttggttggtaggctatttattactgcctcaatttcagaactcgttattggtctattcagggagtcagtgtcttcctggttctgtctagggaaggtgtatgtgtctacaaatttatctattctagttcatgagcacagaggtgttcataatattctgtgatggttgtatttctttggggtcagtggtaacatctcccttgtcgtttctgattgtgtttatttgaatcttctcttttcttctttgtctgcctagcagtctacctatgttattaattctttcaaaaaaccagctcctggattcatttatttttttgaagggtttttcatgtctctctttcagttcagctctgatcttgctttgagatttgctagctttgaggtttgtttgctcttggttctctacttctttttggtgttggattgttaactagagagctttctaacttgtccatgtgagcatttagcgctatcaatttccctcttaacacttccttagctgtgtccccgagattctgatacattgttcttaataatttcaaagaacttattgatttttgccttaatttcattatttacccaagagtcattcaggagtatgttgttcaatttccatgtagttgtgtggttttgagtgattgtgctttggtttgagagactgttattatttcagtcattttgcgtctgctgaggagtgttttacttctgcttgtgtgatcaattttagagtaactgccatgtggcaatgagaagaatgtatattctgttgttttggggtggagagatctgtagataactatcaggtccgtgtaatttagagctgagttcatgtcttgaatatctgtctcaatgatctaatattgtcagtggggtgttaaagtctcccactaatatagtataggagtctgagtctctttgaaggtctctaagaacttgctttatgaatctgggtgcatatttatttaggagagttagctcttcttgttaagttgaaccttttaccattatgtaatgcccttctttgtattttttaatctttattggcttaaagtctgttttggcagaaactaagattacaacccctgctttttaatgttttccatttccttagtagactttcctccatccctttattttgagcctatgtgtgtcactacatgtgcgagggtctcttgaagatagcatacaaatggatcttggttctgtattcatacatgtgtatttgatcctctcatcatgatcttagcgggttattttggagactttatgtggttgctttatattgtcatcagtgtgtttttgtagtggctggtaatgatctttcttttccatatttagtgcttctttcagagctcttgtaaggcagattgatggtaacaaattctctcagcatttgtttgtctgaaaatgatcttatttctccttgtcttatgaagaattctaggttggaatttattttaaagaatgttgaatactgtcccccaatctcttctggctcatagggtttctgctgaaaggtcttctgttagtctgatgggtttccttttgtaggtgacctgtcctttccctccagctgcctttaactttttttttttcctttccaccttgtagaatctgatgattatgtgtcttagggatgattttctcatggaaaatcttactggagttctctgcatttcctgaatttgaatgttggcctctctacctaggttggggaagttctcatggatgatatcctggaacatgttttctaaattggctccattctcctcatctttttcaggtacaacaatcagtcgtagatttggtctctttacattatcccatatttctcagaggttttcatcattccatttcattattttttctctagtcagaaaggcagttttcaagctctgaaattctttcctctgcttggtcttttctgctgttaatacttgttattgcattataaaattcttgtagtctgttttttacctctatcagtttggttgcattcctctctatactggctattttggctgtcagttcctgcaatgttttatcatgatttttagcttccttgcattgggttacaatgtactcttttatttagctcagtcaactttgttctgatccatattctgaattctacttctgtcatttcaaacccttgctggtgaggtagtatggtcatttgataggaatagggcactttagctttttgagttttcagtggttttgcactgattctttctcattttggtaggcttatctaccttcagtctttgaggttgctgacctctggatggtttttttgttttgttttaaacagtctggccacttttcttaaggcctgctgcagtttgctggggatccactccagtccctaatcacctcagattttccagtacctggaggtatcaccagtgaaggctgtgaacagcaaagatggcagcctccttctttctctgggagctccatcccagagaggcctgaaacctctgtcagccagagaccctggttgggaggctccacccagtgatgaggaatggggtcagggaccttctgtgctggggtactactttcacccgcagtcagcttggactctccaaagcccaaaggctggaactactaagccacccaaacagcacagatggcagcctgccccccactgcctctgggagctctgtcccagggagttttcaaatctctgtcagctggagagcactggcaggggtggctggaggccccagttgtgaggttcttccctgtgaagaggaacaggatcaggcatctgcttaaagaaacagtcttgctatgtttttgtagagcagctgtgttgtgctagggggtatcccttctgccccagtcagattggactctccaaacagtaaagatgacagcctgcccctcccctcaggagctctgtcccgggtaggtgcaacactgctactggtggctggctggaattccaacccagtgggtcttatcctgtgaggtgccataaaagcagggcccgcagaccatcgctgctttgccccctggattcagccactttcctaggggtatctatggtggtctaacctcctgctttgccagagttgcagctacttgtgctgggaagcctggaaaaccagagtatctaaagttcccaggtctcctgtgtgcctgagaagctgctgtgccaagactccatgtagctctgtgtgtcagactgaaggccctggtggagtgggtttatgaagggatctactgatctgagggttgcaaagatccatgggagaagagttttcctgggatcacacaatcactcgctgcttaccttggcaagggaggttcccttggctccacattctgctcccagatgggccgtcgtcctgccttgctcttctccattctctgtgggtcgagttgtttccttgattagtcccagtgttgactgtctggatgtgtcagttggcagtgctgtatttacttgccccttccttcctttcctctctgtgagagccacgcatcctatctgcttttagttggccatcttggccactctttgtgtttacttactctgctttattgcagttttgttcatcctgaattagagcacagaaagccataggataaacttgacacatcttcctggagaatattttacccaaagatttggatacaaatcaaataactcacaaatgataaactattatttttcattaaatagggatattgtatatggtacaacaccaaatttgtataacttttgaagctgaacagaagagatttccataaaaaacacttaccttttagtgagtctgtgtgtctgtgtcccagacccccagaggaatgcactaatcctctatgagagctggcaattcaatggaaagttttaagaaggctactttgaagccagatagtcctggttacctgagccccatctccaagtgaatgacagggtggacttgggcaagtcattccaccttactgagcctcatctgttcaatagggattctaccacatactgcataggatgtattgagaactcgcgggaccatatgaaagtctgaaagcatcgttggtgttcactacatagtgattattattattgaatgtaatcactttaatcactttccaaatatgccttctgacttgttcagccctcagctttcacataatcccccagctaaccctactgagaccaacaccagaacgacctccatatcgcttttaaataccatttcaggcttctcatgttaccattttcactaacagaggatcctgaaatgggtaatataaaattgcaaagtaggtaagctagttactaaccaaaatatttatttaatggctggaccaaagatagaagtttttcaatttgtatccaatagataaccatttaaaatgatatatattattttaaatgtatacattcacatcacccagagtctcttgacacaaattaagtacttcctcaattttagctgattacaatgtactttttcccagagccctaaaactcagtctattactgtagcatttgttcattccagtaaatagtggcagttttcaggtaacatttaaaagcatgggttctagtgatagagttgcagtgggaacatctactctgctgctagctgagttaccttaggcttaacttcccccaactaactgtaaggtggggataataatattaatgtgacttcttcctacaatgttttatttagcacattgcctactgtatagtaagtatgcaataatttttaggtataaattttagtaagtggcttttaaaaaattaagcttgagtgaggtatagttatttacatataagacactaatattgttttcagccttcctagagctatgtggatcacctactttgctccccacagagagggattcctgtacaatatatcagtaagtggacacagaatactcttgaggatgtctactgaaggctagcatgggggatgaagagagcacagggtgaccacttgactcagtgcaggagatctcttacattataatcatatggcaggcagtatacttacattgactattaatcttccagaatctatttgctgctaagaaacatgaagtgtgtttcagggctgagagatggaccctttcaattgctagtccaaccctctcattgtatacaggagaatgggtccccatcgcgagttagtggctaactcaatgacaggcatctcctcctaatccagagctccttctatgatgcactgccccataggctgaaccgattttcaatcctgatcaaagctagagatttcatttaaatgaaaaatccaaataacatttgtgaatgtattacttttaattgctaattaaaataatcaacagcctagctgtctgttacacatggagtcaagttagttgcatgggtcattagatgttctgagagcattaggtcttattgggaagacttgaaaaatcagtactctaatgaaaattgagaagatggaaatgtacatcttttctttgatattcaaatcaattatttagtttctatctcactttagaaagaatcacagtgtaaagaatgtaatagtttggggatggagggtatggggaggaccataaagagagtccctctggaaactgctattgtgatgtttgtagtttcatatgcagtcaccttggaaacctcgagttctgaggaacaccatttgctacaaaatcccagcttctattcacagttcagaagccatgttaggctactaaggcacagtatttatgatcagttttgacctctggcaaaagtagttgacaaattctacagagaatctgtcaagcttttcctctctcatagttgttaaagttttagcatggaagaagaatggactatttttagccacttacctttgaacattttggattaaaattactctgcgttccagttctttgcagtctgttatgtggccactacatacaacaggatgcctcttgtggataaggaacaccagagaggggattagagttaggaacaaaagaaatcatcagttctaaccagtttgaggggggaatgactacactaacaccaatcactgccatatcgtaaggcttcacctacatttccacatttcgtctttataacagtgctacaaagaagacaccaatatctcttttgaacatgagaaatagctcagcctcaaaaagccttctccaaggtgaaacatccagcagacatccagcagatgaggtgcttgggctcaaaatcctgagtctgaagctcaagctttaaagaaatatcctacattcccttctaagaaatttggaataaaaaattgtaggtggcatgaaattgctaataagttagaagtaagaataaggtatttaagatatattaagagggggaaacatctaaaaggtaacataacaaaatatggccctagcatcatatttttttttctaagttcagtgaaagataacactaatgagactgccaattctaatgcaactagactgcaataataatcttaagttgttcagaatcataccaagaagggaaagaaaggaaagtgtgctcatttggccctagaccttgctcagaacatagcaagagcattgcattcaacacgaggcagcaggttctaagagggaagtcaattcaaacaaatatttcctgcacgccttgatgctgggcataaaccaagtagaattatcacatttacagagcttaatctagaagaagagataaattaaaacaagtaaagagacaaataaataattgcaaattgcgtccagtggcatgaaggaaatggatatattaagagtaagaacagaaggtgggcctcccatttcctgcagggtaggatgaccaagaagatcactctagtctacttgctggaggatctgtcaaatatcctcttcagcctggataaaaaaacttcaaaatagccagaatgcttgtctttataaactgtgtgtatttacctatggaagctgcagatgacatatgttacaggaagatatttctacccaataaatataaaagctacttttaaacagtcagaaccatggattattacgaaaacatactagtgaggaatcagagacctgggtttaatctacaagtctctaagcacatggtcttggccacaatgtttgtttaaccgctctgaacctcccttgcctcctgccacaaatggaactggtactagataccagctagaatgcccaactcaaaaagcacatccatggtatataatatggattcacttatggtttatgaatctaaatctgtcagtgatacttgccatggactttaattagaaaaccctaggcctctgcagttcctttgaatcagactctgaaaaagcttaactcaaaaatagaagatgagtcacaagtgttgcaggaaaatgatgtcataattttattgtcaaaattattaatatccaggcagaaaactaattggaccatggagttgaacatgatggtagccaatatcatgttcttaaagttgcctggcattaaaatctcactcaccgttacttcaaatgtcccattacattgatacagaccaggctcttcaatatggctgttggttcattagtgttgatcaaacagcacagctaaaatatgggaacaatttttaaagtggttttctggaagtagaaattaaactgagctcttgaagattcaacgagtgctaatgaacttcaggtcaatgaagaaattgtttgaaaaatatatacactttaaagattgcaatgaattatgtcaccttcttagagacacacaacttttgaattaaagaatcctactgatttgctcaagttttatatagacagtagcattagagtggcaacacagaagtataatgggcccacacagtgggcactgtagatctttattttatcaagtatgttaatttagctattggggttttaacttgggttacctcttctcagaagcaatatcctaagcatgctgttctcatcagtggaatggcaggattccctattcacatttgaagatctgctaagtcagtctacgtcaatggttctcaaccacctccttaaagaaaaaaattcaaatcaataaatgccctggcattccgatttaatttgtgtgggttgtgacccacgtttcaaaagctccccttgtgattctgaccacaatgaaatttcccacccaatctgagaactccccaagtgcagctgctttaattgaccaaaaatacaccaactttataccttcccaccagttttttctaagttatttccctttcagtcataactttctctgattattatttttctcaaacttgtaacacacagagtaatcctaggtgttggtgtgaaactgctgtttcctgggaaagaccagagctaacctcttctatttcagctaccacatatattatttggcttttatgatgttctgaaggtcgctccccaaagtaacaaaagccattgtctccattctctaaggatggaaacacaatatgatctaaaagcttgtctaggtttggaagtgattaatgtagattcttatgatgaaggaaatgaaaacgagaaatctggataagtaatcactgtttcaacaaaaacaatttcaacaaaaaatgagcctgagacagagaacaaactgataatgccaacagctaataaattattctcttagttttcaaaacagactttgtgataacatttaaagttttgtagggttttttgattcatgagacttccaagtacagccaggaaggaaagggacccagtttcccatgtttcacaggtacattaagtggaatttgagctgagcagaagttttaactgaatgcagaaatgtgccacgaaaggaaggtttgatagagaaaaatctcagagcttcgtaaacctgggagagatgaccaattttctccttgtcatattccctgggccgaaaactacacatcttcaaacacgagctgtgaaaccatctcagagggtaacagaggctggacactttggaactctggtcagggctttgcctcgtgtctaactatagaaatgacagcatttcagaggaaatgtttaccctgggaggatgcaatctacatggtgaattggctagacaatcagttcctcaattgcaccttcctagtcttaccagccaaaaagagacagtgagacagtggatgctccatggaatccaattatgttttcaggtttttttttttttctttttttgagacagagtcttgctttgttgcccaggctggagcacagtggcactatctcagctcactgaaagctccacctcccagcttcatgccattctcctgcctcagcctcctgagtagctgggacaacaggcacccaccaccacgcctggctaattttttgtatttttagtagagacggggtttcacccatgttagccaagatggtctcgatctcctgacctcgtgatccacccgcctcggcctcccaaagtgctgggattacaggcgtgagccaccgtgcccggcctcaggtttctttttcttgaggttttatacacaaagtaccattaactcagcgatacggaaatactccaccaaccacaatcaaatacacctcccactttactatctctagccccacatgtccacatttctgcttgatgactcaaacatcttcaagtcgacatatttcaaacaaactcatgatgttctatccactatccatatactctataagcattctgcttattctcttccctctctcagtggctgacctccaccatctactggtaataaaatctacaacactagaaatcagccttggtccagtccatcaccaaatccaaatcaccatcttcttccacctggataataacagactcctagctactttccttgcagtcctcttgctacctcttatgcactttccactctgttagagaaacagaaaaaactggacatagatttactataagaaattgactcacacaattacagaagctgaaaagtcccatgatctgctgtctgcaagctggagatccgggagagctgatggtgttgttccagttcatgtcagaaggactgagaaccaaggagtagatggtattaatataaattccaatctgaaggcagaagactaatgtctcaagtaggcaggcaggcaggcaacgttatctcttgctcagttttttgttctatacaggttatcaatagattagatgaaactcactcgcattaaggaggaacctgttttattcttcagattcaaatgttaatctcatccagaaacaccctcacagacacacctagaataatgtttgaccaaatgtatgggtacctgtggtttagtcaagttgaaaaataaaattaaccatcacaggaatattttttgcccgcttataccaccaatccatttaaaatccttattctgcaaagccatacctcacttgcttcctacatcttttttttttttttttttttgagatgaagtttttgctctggtgcccagactggagtgcagtggcacaatctcggctcactgcaacctccgcctcctgggttcaagcgattctcctgcctcagcctccccagtagctgggattacaggcacccaccatcacacctggctagtttttgcatttttagtagagacagggtttcaccatgttggccaggctgatttcaaactcttaacctcaggtgatcaacctgccttggcctcccaaagtgctggaattacaggcatgaaccaccgcgcccagccttgcctcttattaataccacattatctactttgtttaaatttcttttaactcataaaattactttctttctaaaagtctttatgctgaatgctggtccttctgcgtctctgtgccccttaagcccagtataatccatgtttattaactaaatcaactagctctacactgggaaagaagagctgattcaaaatgatgttttgtaatggccaagcttgcctttcatagaagcaaatctcaaaatggttttgctctagaggacatatcactgctttctgagagaaatagtcttcaaatgagactatccaatacatttcttaagtctttagagtagaagcctagaatattatgaatagatttttctttcaacagatctctacaaactcagcagattcattggtaaaacttaaatacctgtttcagataagaaggagcttgagtttcaaagtgacccttatttgacttaaaagtagaacttatataattagagaagattatgttccttcttcctattttctggtgcttattttatttaagccaatctctataatgcaagttgaaactggttgaaattggttcccctgagtacaatgtgttcaagccaaagcaggcagttaaaacagggatacctgagccagacacagtggtgcacacctgtaatcccagctattctggaggctgaggcaagattgctcgagcccaggagttcaaaaccagggcaacatagtgagacccctgtctctataaatccacccctcattgttatccctgttttatttttatttttaatgtatcaacctacctgagctggaacaacatttcccaaaatccttccctgagttagcatggctgcatgaggtttggaaggtgagaatgcagcatctgccatactctttttgtgctggaaaatcagtgcagagccacaggcactgttggagatcacctgctcgatcaccttgttagtgtggggcagcagccgagactttagtcttttggctcccaccaattttcttctagcttctccaactcctgggctaggtacatgctgagtttcaggaagaaagacagaagtggtgggagattgtcgtgggttccagttcatcatcattctcccccacttcacatccatctttttttcctgattcccatcccactgacttcaagctccagcatcagacacaaagacaaccttacctagattgtttaaccaggtctcccaaatgtgtaaggacaaattcctataataaacgaaattatatatctgtctcattcatagatgttatctttctctaatggagccatgatcaacaaacttccatggagctttctagccaattgacaactcttcagccagatgtgattctcagaaagttggcacatccataatttaaaaagaagctgccaacttttaaagttgagctgattttatcataccatgtcaagttccgtaatcttttgaaaaattggaaacctggacctccagtgcaacacagatggtagttttaagttccctaaccagtccaccctctgaaaactattaagattattcaacattcaagccctaaaggagcgtgagaacacagagacatcagctgatcattgaggcccctttaacgttatagattttgctaacctagatgaaatttagcttcagttttcatggcctcctgggttatgggaacaaaacaaatcttggggttcactgaggtggggagtcttagagatttcacagatgaaactgggacccccccagttaccaaagcctcagtgtaagggtgaaatagaatctaatctgcctagtcttccctacctggcccttccactcagaggactacaagggaaattgcctgtcttgaacctcagcactgaatgaaaggggaaaaaataaatttctctaccacttgataacttcaaactggccttcactctggtttgtagcctggctgaattcatatcacctggatgggcctgaaatctcaagcagagaaattagtttacggtgggtccaagttcacggtggcaccagtgagtgatggaaacaaatgcaaatcctctctagagaaaacatcttaaatgcaggcttcaaataattcctgcagataaaaatccaagcaatgtgaactcacagtcaagaaggacaaaatacactcggaaacaaggcaccatgagcaagagagcaggcaggaaaacaaggcagccaatgtagacccacagaggcttcagttatgagaattagcagaggaacaaacaagtatgtttactatgcataaaaaaacacaggaataaattaacagagtaaaaaataaagacatataaaaataacacattagaaaagaaatgaaacagaatttctagaaatgaaaatacaatctcaaaaagcaaaattccaatgaatatgagaaatagagaaaaataaatcaatatgaacatatatctgaagaattacctcaaaagcagagagacagaagaataggaatgctagagtaagaacatctaatccaaattgcagaatcaatgaggaaagagagactagggcaagaacagttttcaaagacatatcaggtgagtattatcctaaagtgaagaaagacacaaaaccacaagtttaaagggtaaaaaaaaaaaattaaattaaaattaaaatactgcaaataaagcgaaatttacatgcagacatatcagaatgacactatagaccatcagagataaaaaaggagtaggcgagaaaaaaaaaaccaagtagaagttctgggattgagattagactgacagctgacttcttcatcacaacagtgagaagcagaatgtgaaagaatagtaactttaatacctgagagaaaatgattgtcaatgcagtgttgtggatatagccaaaatctctctcacaaaaggagggcaaattaaagatctattccagaaaaacaaaactgggggcttaccccagaaggcatctactaaaggaaaatatcaaggattcttttgatattggaaagcctaaggtaacagaaggaatatgtaaagagttaaatacgtagacataaataaatgttgattgtataaacagtagtcttgcaggattaaagaatacagaactaagagaattaagacagccaggtagtatcctgaggccagataaatacaccagagagtttagaaatagatccacacatatatgcttaattgattttcaacaaaaacatcagtgctgttcaatggggaaaggattatcttttcaactaatggagctggaacaactggataaacctattagaaaaaatgaacactattcttaaaaattaattcaagatggatcataaatttaagcataaatgctaaaactataaagattctagaagaaaacatgggaagaatatctttgtgaccttggggtagtcaatggtttattagacaaggcacaaaagtactaaaaattacaaatattaataaattgaaatttatcaaaattaaaataaaaattttaagctactcattaagagacactgcttaaaaaatgataaagaaactcatagattgggagaaaatacttgaaatatatatgaaaaagaatttttacttaggatatatacaaagtcaataacaaaaatgcaagtaccctaattgtaaaaagttgggggagagatttaaatagaccccttccaaataaacatatttgaacacccagtaaaacacatgaaaaggtgcctaacaacattagtcatcaaaaaagtgaaaatcataataaagtactattatgtagccaccaaaatttctataattaaaaagaccctcaacatcaatggtgataggaatgtaaaactgcaaaactatcctggaaaacagtttgacaatttctaattgtattattaatctattgctgtgtaacgcattaccccaaaacttagcagtttaaaaccacagacatttattacctttcattttctgtaggtcaggaatcaggtgcagcttagctgatggatctgattcaagacttttttatgaggatgctgttaagctattggacagggcagtgatcttaccaaacgctggactaggggagggtccatttccaaaaacactctagtggtcatttgtaggattaagttctctgtagactgttggactgaacaccttagtttttcttgggctcatggcctcccctccctcagtttcttgggcctctccacagggcagctatcaacatggtagccggcttccctcaaattgaaagagtgagaacaagagcctaagatggaagccacggtctttttacatcttaagctcataagtgatatcccactaattttgccatattctacttgtgtagaaggaagtcattacgtccagcccacgttgaggggagagaataacataagggcatgaaaaccaggagacaaggattcctggggaccatcttagatgctgcctcaccacacacattaaagacatgcctgtcttataacctagtcattccactcgaagctgcctgttcaagagaaatgaaaacttttcctcaaaaagacttgtgtaagaatgttcatagtactttctacaaaatagccacaaactgttaacaaccagatgtcaattaacagtagagtgggtaaacaaatcatggtctattcatgcaatcaaccactactaagcaataaaaagaatgaacaactgatgaacagagccacacggaagaatctctagtttcaaaaatcataaaagagtaaaaatctattattctcattatatgaagttcaaaaacaagcaagatttatctgtggtgctagaaatcagaagaatgcgtgcctctggagggtggtgggtgtgaatgcagagaagcatgaggtaactttctggggtactggtgttggatgcgatggtgattacctgaaactatacatctatcaaaattcatcaaagtatataagtaagattagtgcaatttactgtatataagttctacctcaataaaaagtcatctgaaattttaaaaatttcggttatattaaagacctctaaaaacataatagaatagttgatatttaaaatgacagaaaaatgtgtccaaggcaaataacagaagcatagtggaaaaactatactaataggaaaataaattttaaggcagaaagcattacaagaaataaagagaatcactatatattaagataaagaggataaaccaattccaagctggtatgcatctaataacatgcctcttttagtaaatgataaaacagataaaaatagatatgaatattcaaaaaatttgagtggaacaactaaataacttgagttaataagacatataatatggcaccaacaactgaagaacacattctcttcaggtaggcatgcaagatttatacatactgagacaaaaaggtagtttcaattttttcttttttttgagatggagtctcgctctgttgcccagcctggagtgcagtggtgtgatttcagctcattgcagcctccttttccctctggggtagctgggattacaggcgtgtaccaccatgctcagctaatttttgtattttcagtagagatggggttttactatgttggccaggctggtctcgaaatgctgacttcagatgatctgcccacctcagcttcccaaagtgctaggattataggcgtgagccattgagcccgggctcaatttttaaggaactgatgttatacagaaaatgttctctattataagattgtcagttcaaaaacaatgttcaaaagttcaaaatttaaaaatactagaaatctatactaataaatcttatgtatttctaaaactaaagaacgcccttctataaacctcataggccaaaaagagaagtcatactaaaattagaaaatatttacacctatattataaatactcctttgggatgccgtcaaagaaaaattcataacttaaatgcatatattaaaatttggaaaggcaaaaattaacaaaacagcacattttagaacttgaaacaactggagaattatctgggacaagacagataaatttatgaactaaacataaaaatagatcagattgacaaacccaaaagttagctccttgaaaggactaataataaacctctggcagtactgttcaaggcaaaaagaagacgtgaaaaaaatatgtgggacaaaaaaaagacagacagctacaaacgcagggggcatcttattttttatttttaaaaatcttctttatcagtgcaaaggagaatagcaggggacattttaaaaatgaggatattattttaaaaagactttgtcaacaaatttaacctttatatgaaatggaaaaaaaaagctaacttacaaaaaaaactggagaagaaacacaaaacctctatgaggctgtaattattttttggtggaaaaacatgtatttttcatgcccagagggtttatcaatgtgtttaaacatacaaggcacaaataattctaatctttcataaacaattctggattatagaaaagtgatagaacccgacattggtattacaagaaagaaaaattatagaacacactcttttatgaatacagatgcaaattaccaaaaaaaatgaaatattttcagaaatatatagaaaagataatacataatgacaaagttgggctcaagccaaaaacacaggagtagatagttattggaaaattaatataattcaccacattaatatattaaggagaaatatattatcttaatagatattccattatataaaatagcatttgataaaattcacattaattaatgatagaaacttttggcaaaatgagaatagaagagaactatcttattaaaaggcattaggggagaaaaatcctagaataaaaaacatacttaatggtaaatttggtaaattgttgaaaaatttcctctttaaggtgaggaagaagcaaggttctcatttctttacttctaatcaacactgtattgtatggttctagacagtatagtaaaaaaagaaaaagaattagtataagaaatgacagtcgcgcgcagtggctcatgcctctaatctcagcactttaggaggcccaggcaggcagatcacttgagttcaagatcaggctggccaacatggtgaaaccctgtctctactaaaaatacaaaaattagccaggtgtggtggtgggcacctgtagtcccagctacttgggaggctgaggctgtagtaagccaagattgcgccaccgcacttcagcctgggcaacaagagtgaaactctgtctcagaaaaaaaaaaaaaagaaaaatataaaactttcacaaattaacataatttatagttgcaatgaaaacctaaaataacctacagatagattatgaaaaacagcttacctaggtgttgatttttaagatcaacataccaaaaaagtcaattagatatctatatttcaggaaaataggatatctatattccagggaataggagaatgagaaatacttttttaaaaaacaccattttcaatagctacaaaagataggttaaactattgaaatacatcaaataaaacataagtaattggagatagctacagtgtccatggattgaatttgaatcccatccaaattccaaaagaatttccttatgaaacttaagttcattccaaaatgtatgtggaagacccaagaatcgctaagacattcttgaacaagaataaggtaagaggatttgccttatgaagtataaagaattttaaaactcaagtaagctacaatatttaattaaacaatattttgcagggatagacaaatagaataatagactagaaaaccccaaaagagagccataaaggtatgggaatattatttatgatggacctaaatattggctttttcaacatatgttgagataatctccatctcttttgaccccaacctcagactatacacaaaaattaatacctgatgaattagagacataatgaaaaaagaaaacataaaacctttgaaaacaatatagaagagcttcatgacctcagtgtagggaaggattgctcaggtaagacacagaaagtgcaatccctattccaaaagaccataaatttgtctgcattaaaatgtaaaacctctgttcatccacagatggtaaatataaaagacaaaccacaaacggaaagaagaaattgtcaatacatagaacggctgaatatttttcagattatataaaagtattccacaaatcacacaaaaaataaaaaatagacaaaaatagaaataaacaaaatagatgaaaacatttcactgacaaaaatcccaaatggcttacaaatgacaagatgcttaactccattaataattaggtaaatgcagttttaaaagacaatggcatcccatttcacagtcatttcatacttagctgtatcaaatgtcagcaagaaagtgaacaactggaacattatacactagtgggaaagtcagttggagcaatcactttggaaagctatttgccattatctaataaagctgtagatatgcagatccttaggagtagcaagtctactctcccacattagtctgaaagagacttttgcattcaggcatcaggagccacacacaagaatgttcatggttgcaccatttgtaaaaacaaaaacccaaaaccaacccagtgttcgacagtagaatggacaaataaatcatggtatatggtaacactagggaaatggaataaattacagctatgtgctgaaatgtagaataacctcagaaacatcatattgaggagggaaaacaaaagtcattaaagaattataaagtggaattattctgcgtgtgaagtatgcaatagtagtgtattgtttaaggatgcaaatttagtcataaagaaaagcaggaaaacagcaaacacaaaattcctaatagttgttactcccggggggaaggaaatagaagggatcaggaagaggagctcaggttgctacaaaatttgttttttcttaaaaaagatgataattatacaaaaccattgtcattctttctttttttcccccccaagatggagtcttgctctgtctcccaggctagagtgcagtggcacaacctcagctcactgcaacctctgcctctcgggttcaagcaattctcttgcctcagcttcccaagtagctgggattacaggcacctgccaccacacccggctaatttttttccatttagtagagacggggttatcaccatgttggccaggctggtctcgaactcctgacctcaggtgatccacccgccttggcctcccaaagtgctgggattccaggcgtgagctaccgtgccggccagcattatcattctttataccatatttataattttatattattttgtgtctattcataaaatttaataattcagatcaaaattcaaaacattttaaattagaaaacactaaaatcagaagccctggcaaccactggccaggttagatagaagagcagctgtccccgtagacagcatctccatcgcctcattcacatttaggccagtgccacataccatgttactgttctgggaatgtcattttacttacagctttctcatgggttactcactgtcatcacctatttagtcttggtgggggcacctgagtttatgacccttggactagagccgtgcttctcaaagtgtggcccgccgaaacaagcagcatcagcatcacctgggaacttgttacaaatgtggatgtgtgggcacccctctagacttactgaatcagtaactctaggggtggacccagcactgttttcacaagcccaccaggtgattctgatgctcacatttgagaaccattcttcttgaagatatggcacagcctggcccggcccagctccggcccccacccttcctggccactcctcctttctgcatctcttcagtgaggctcttctttctcctctgagagggttgcagtttctcctaatggaagtagtgttcatttccaagagtcagcaggacccttaactgccactcccatcaggaggaaaccttccatttttccttactacatgccatctaaacaattgtgttgtggtcattaatttatgggcagaggttgacggacatcacttcaggagtgatgctctctgcagtttccacagggttttggtaggagtgtactagtccattttattactgctataaagaactgcccgaggctgggtaatttataaaggaaagatgtttaattgattcacagttccccatggctggggaggcctcaggaaacttacaatcatggtggaaggttaaggggaagcaaggaaccttcttcacaaggtggcaggaaggagaagtgccaagcgaagggggaaagcctcttataaaaccatcagatctcatgagaactcaccatcatgagaacagcatgggggtaaccacccccatgattcaattacctcccaccaagtccctcccatgacacgtggggattatgggaactacaattcaagatgagatttgggtgggacacagccaaaccatatcaaggagctttatctcagtggaaagactagcgtgtgaacaacttctgttaagtctgcttgaacatcaaaggacattaagctgggctgtaaaacagaaagccagttaccttttttgtcactgcttccaggaaatcatcatctctattttgttgcagcctttcacaataggacactttcagagtagtgccctttctcaccaccctggttctttcatggctgagatgtggggaaaggcaggagtcatttctgagtctacctctccggcctgggtccctcctgctaatctcagaggcctaggcagtgggcaagaataaagcgaattctaatgcctgtctgaaatgccagtcctgcatctgataaagctctgtaagctccatactttttttctatttcaagctttctttttcaccaaactattctgtttatattgaatcattcactttgaactctatgtaccaagtttgaacacattccaaatatcctaaatttgatattgctgaagtagaccgtttaaataagttataagaaatactgtataaccatgaagtatgcatcacccagccatatatactactattacctcactattgtttacatagattggttttagaaatttaagcattaacttcttgaagaaaggattacagaaaataggggtaaagatacaatagatggaaagaaatacagttattctggaactaatatggtataaacaaatattagctttggagtccactaaattgaattcaaatcttggctctgccattttactaggagtataaccatgagcaagtcactgtaccatagattccttgtttgtataatcaggactatagaaacaccagattgataggttttggtgaggattaaatgagataacacattagcagtgtcaccacctagtaacaaaccccccaataacacatagctgatgtttaaggcaagaaataagaccagcaaaacagatcagaacaaattctaaatggagttcagatctcttctaaggaaattgtagaacatattctacaagttttgataagtaacatattcaaaacttatttcgggaagatatatttttgtgtgaagttcattgggaaaaaggaaaaactagagacaaaacttgagacacagttacaatagtccgggttacaggcaaccctttcataaccccctcctggtgattctcatgctcacatttgagaatgcttctaagaaattttaggaagaaaagaggagggaaaggaagaaagatttgtccatggtcatttagtggccactccatggcttgattctgaaaacggagaagttctgagttaaaagacgtgttaactgagggaagaaggaagaaagagaaaagatgacaggaggactctcaccttggcaagggggatgatggcagtgacactggtaagaggtgagcaggaagtatagtaaaagcacaaactcatcctacaaggagaaaggtatcgacattagtggaaacagaagcagttagaaaacttaggataaactgtgtgcatcaatcagactgtataggagagaaaacacagagaatggcaaaaaaaaccatcttcatatctcaaaagtgagagggagtcaagagcacaggggcagctccagttagttggattaaggttctagaccaggccgtactgcacagacatcactttctgttgtcctgctactgagtccctctccctgttgcactgacattatcaaaccaaatgcaaatgagatgaaccacaataatgggcagaactgcacctggttcagcacaacctggtgaaggtcttaagaggaggggaggtggggagtggaggatttttgccacacccaaaggggtgagaccacagaagaaaaaattatttacatagaaactcaggccaatcctttcgtaagtactccaggactattgcttctcttgatgattttagttgagtcattgtagggggggacaattcaagggagaaggctgctgcctggaagcaatcctcaggaacctagacctgaaaaatgtggatgagctctctcttggcatttgtgcaatgtggctgggggttgctccgtagtggatcttactggtcagcttgctctgtttgccacttactgaggcccaagaggctttaccctactcagaggcagtggcaaaaacagaacaaagaatcaatagtgggcaaggagaatgaggttcctttttaacatgtttaaggtgtctgaaagttagaagcactgaaattaaattcaggaaattggtctggatcagagtgttttgagaaccattgctgaggtctccgttcctacgttaggatactttctttgtaacagagaggaggatcttcatacattcctatctggtaatagtattaaaatcaattgggtatgatggttcacgcttgtaatcccagcactttgaaaggccaaagagagaagatcacttgagcccaggaatttgagaccagcctgggcaaacatagcaagacgctatctctacaaaaaatttaaaaattagctgcccgtggtggcacatacccagctactcaggaggctgaggccagaggatcacttaagcacaggaatttgaaatggcagtgagctataattgtgccactgcactccagcctgagcaacagggtgagaccctgtttctaagaaaaagaaaaataaaattagaatatttaggggatggttgagtttcagttaatgtttttctcattatatgaattaggcaaaaagcttcctcctaaggagtattatcctgttttgccatcataattagcatagaatgtggctgattctcttgatttattttttatcttacataccataaaattcactcatctgcaagttttcacaaatacatagagacctgtaaccaccactgcaatcaagttccgtcacacaaaacatgttttccttatgctgtccctttgcagtcagaccacctcccctcccagcccctggcaaccactgaccctctctgcagtgcagaaatgacagctgcattgaaggttaaggcctgaggctttcttatgattggttggtattgtaacaatagtaacagcagtaatagtaatatataatacatatttgcatttctattgtgtcaggcactatttgaagcactttatagatgaggaaactgaggctttaagagattttagaaaggaaagaggaggtaaagaaagacttacccatggtcatttagtggccaccccatggcttcactccaagcatgtcagactcctagacccatttttttaacctctatctgattctgcctccatggaagatacagaagcaggacaaagtagaaaggatacctaccaattccaggaagctcggtttagatccgggattgacttacttttacaaaaaaaaaaaaaaaaaaaaaaaaaaagcttatatgagtttgattaattataccaataaaacaacacttggatataagatcaagtgaaaccaggatcctagaacactttccttacagcctttgtaaaatgcaatgaagataaagcctagacttattatgctccctgtcataaacttgaccaggttgtaaagcaaaactttaaaaaattctctgatcaaatactggaatgctttgttaatgtccttgagcatgaacttccttttgtatttattaaaaagaaaaagggatctttattgacgatcttgggtgtttttcaggttggagtccccaacccggtctctagtgatggaggccccaaaaggagtggaaatcaatgcagaagctggcaatatggaagccacctgcaggacagagctgagactggaatccaaagatggagaggtgagggatgagaaggacagaagttcaaagagctacagcttcaacaggccaacccttcccataactggttgacctcggagttggatcctacagtgtatcaacaaaaggagccaagcaggttttatttctgaaacaattaattgagcagcatgattataagccaaacccacaatccatcaaagtgatgatttcttatttgtaaaatgcagagataatggcatgtattccaagtacagaattatatgaccatgaaaatgaatgctattttcaaattctctcttgtcaccttaaaataagattttgttagccaacataattaagctgtatatattatacacatctggctcaagatgaacttaatttacttgtcattactttgtgtcacatgtttctgttttcactgaaaatggggaggcagattgaacagctgtcccaaccagaacaagccaaaactttatagggtaagactaggcagcaagggaatgaaacactgcagatattcattctcttatgccaacacagtcccagctgggtgaacagaaatgctgcttgtgtttttgctagcaagacaagccaattactacccacacccaaaatgtgatttgtctgtaaacttttaaaaatgccttcaaagtgctcataagtgaactttgctatttaatcatagagttaaaaaatctgtgtgtttttttttttttaagaaaaatgctattccacctgactattcaatgagagaggttatcagtctctacctgcttctatacatccactcgatggatataaaagtcccccttttgattggtatggcatttcctattttgttttagaagagatagtcagaacattcagttatcacaactgcctcttcaagcagctacaaactgcaaaccacacacatataaaaatagtggctacctcacatatgcagtttatagctatcagaatttgaactctggaggaatcagttataatcgtaaatctaatggcagcttccacaactgcttatttttataggcatatttttataggcatgtttttctcaaagtatattctatagaccatcagccccataaattgttagaaaaaaaaaaagcagaaaggctcactagcatttaaaagttggaaaatgttacatactctattctcttcttgaacactcaccttgcacacagtcatagtaggatctgggaagtcccatagtaaagaaaattgttaaatgtcacattttcacatttatttgactctaggactctatttacattctgtatgacatttttttgcaaaatgctaacatagatcaatgcagcattatcttgctagaatctaagcttctgtgaaggtagagactttccatcttgttggtatccaaatccccagtaccaaaaataatcaacacatagtaggtgctcattagatttcagttgaattgaacattcacttgctgtttctgaatgtcaagagaagagacgacagcctctgaccaatgctttccttcctattctctgtctttagattaagttagatgctgcgaaaatcaggctacctagactgcctcatggatcctacacgcctacaggaacgaggcagaaggtcttcgagatctgcgtctgcgccaatgggagattattcctgtctcaggcaggagctgggtccacttgtcagataaacacaagtgtctgcctctgaaagactatccatagtggacattgttggcagcataaaggccttttttggctttagacactggctgccagctatttttactagaacacagaaagcctatcaaagaccttgtgtgtatgtgtacgtgtgtgtgcgtgcttgagtgtgttcgcgtgtgtgggtggatataaatatatataaatatatataaataaatatatatatcctctgtataaaatgaggtttcagtacaaaaggaaccatgggtgaccctgcgatatccactgtcattttccatcccatccccaccacctgagtgacagaaatctaaacacacatccgtcccaacattccccagaccattcagaatcacacagcgtattaaacactgacagaatcttcatctagatattcgagtagcagcatatcttctcttttagtgtcattacgagggagtgatggcgggaatctcagtcgcactcaagctctgagacctttgtatcaaaaataggcatttgatttcctgttttagctttagtaaggctggctaacttccccctcttcaagctaggaactggcaatgctgtagaagtcagccgtaggaattcaaaatggctggcctaccttggctaccagacatattggggtttttgtagttgaatgaatgaggaggatgaatttcagcaaattttgaactgctcacccaacttctgctatcttgctccctccaaactcacagattctcctacagtcaaattaggagctgtaaatcagcacaaaataagataacagctgttcctcagtgagctggaagctacttaatggcctgatgggcaatgaacaaacgggtgatatgtctctgtttaagggaaaaatggcttaaaagctgttctgttctcacttctgactttaaccaaaagatttcaacccacaatgatcaggtcaatcaaaatccctaagagcagaactcctaccccaaaagaagcctggaagtctaattaagagtagcataaggaacctaattatgtttaccatgtttcttgggattggtgggaaatgtcaaaacatgccctttatttttaaaggcattcacaaactctctgactttgttcttcttatatattttttcagtgccgggatattcatattcctaaagccactattgtgttttctctaagaagcactacatgccaccagaattgtgcactgaaagataatacaaactgagtgtctttatgagaatcactgtgtcccctgaggcccagcagtacctgcttccctgtatgtggaagcagcacctcattcccgccatcagctacctctcatcaccccaccttcatcatcatgctccagggtcaccctggccagctcttgtgctgggacaggggattacaccatctctgttcaaagagggggaaatgtgcctatgccttaagtcaatgcactcagcaaggagaagcacatcttatttatcttgttacctatagtttactttgggtgattggaggggaatgacttagttatgactggacatcttaaaagctgatagacaagccaaatggctggcagatgatgtggatttcaaagagcccagaatgaactcatcactggcttagacagtcctggatgccatttggaaagtagtggccctgcaagcctaaatgaagtagtatttgtaggcctgggtggcatttggatttttcttttccctcaacaaggttttactttttcttactttacaagcaagggaagttttgtgataggagagaaataaaagatttgatattttttgagatgacactcaagcatcaggctgagatttgcacacatgggatgtaaaagcaagctgtgtgttgcttagtcacttacttagaagtagatggtgggggacagcggcgtgggtcctagcctggccagtgatgctgctggcgtccagaccccagactcactccaagcactcttgttcaatatctcatgcagaagagttgggctggtcactcttaggggtgagaccccgtgattggttggtttgtagcactaaggtctaaaaaggaaaaccataaaagacatcagattacgctggatcagtataattaatattccatagggccatgttgccagaatctgtatgtatcaatacagggtttttccaagccaggaaacgccctccttggctactaggagcacctatcccatatcattcagataaacaatgatagctacaaagtcatttgtggctagataggttaagacaggtgattttttaaagtagactgtctttgcattttgccatctgaagttcattaatctttagatgacaaaaaagcaaaaagttcccagaacgtttttgcttagattttgttctaatcaccacgtgaaggaatgagattagcaccacaagtttcatgccaataaaagagactggtgtgatcccacatgcaaaatttaatcctaagggtagtgagatcacaaacagaataaaaataagagcaatcaaccatataaatcaagtacctattgggaacagacataacattcaatttttcatttatgctaagtgaccacagtatacaaagtaataagcaggaaatttgatatgggttaaattatgcattttgttcagattttggaaattggtatgcattataagtttctcaatgtacatctttttatcccaacaccctcaaactagaatatttgtcagtggtcaagagaaaaaattttacctgaattcttgggggccggcggggagcttttacattaaaaatctactaacgcctactttttaaaaaatgagattctttctaatctttatatatgacattttctagacaatcgcacctttgggtatattaaacagctggtatcataacaaagaatccaaatgaaccttcaatatactagaagttctagtaggttaatattgttcagaagatttttacaaattaaaaactgatttccaaatatgttcaacatttacttctatttgatatctgctcaagaagtcatagaagtcttgggaaactattcgagtatcacagaggttttcaaaagcccttatggtgacatctacctaggtaaaagcctgacatgtggctttataattgttatgttacccaagggataaacttgaactggctttgaacatcctttaggtcattttctctttggataattttcatcgcatatccagcaactatagaccaaagtttgcttaaggtttgaccctagagcagaggtgggcaaactatgacctggaaaccaaatctgacttaccaccttttcctgtagttaaagttttattgtcacatagccacatacattcatttacatgttttctgattttacactacagcagcaggatggagtagttgtgtcagagactatgtatcccacaaagcatagattacttactatttagtcctttacaggcaaagtttcctcacccctgacctagaggtttttgtggtatgcattggatatagcaggaaagaaagcacatttccaaacagcagggagtaagcttacatttctgtgtaggtttgggaatatagttacttggcaaagtctttcaggaaggaagcccttccttatgttacatgtggaaagcctgccttccaagacatgtggaagtaattgatccacctgccagagaaacacaggctcagaggatgcctgggaacagggaggatgggattagtggaagcttaatggaaaaggaaagttatgatcctccaagacccttaattgatagaccataccaggttctgcaggtcagcatcattgtgtaatgagagtgaagtaggggaccctgtggttcaaccttagaatctgtttcctgtaggctctttctgctgtctatattcattaaagttttccacttcaccctcccatagtctagagggatgcccattccatggtcctccagagaatagttttgacttaacatgtctgtttagcccacatcacgtcagttatcaacaccgccactgtgcttactgttcctacagccacaccaggcttgaagagttagtgagaccaacaaataattggaagtattggaaaaagcaaaatacatggggacaaaaaaaatacagtgaaattctttttatcaaactgatgctgtgagaaaccagatgaatgccagtttggctttatttctaagaatctgggtcttcattctctggtgtagaaggaatgcaaaaaactataacaacaacaacaaaaacatattttgaaaagacatattctgacatctctgcttgtgtgtggtaaggcaggttcctatcagacatttatccctttggtcaagatcccttttgctcatccagggtttcatactcaatatcgcttaaaaaaaaaaaagtatcagctagggatgactctggaagtatgagtatcatggtggggaggaaggaattttttttaaatgtaaatgacccccatttaccagaccctaatcaaagtcacttaagggaatccctcagccttttatttggaaacagttgaaataaactggcagcagctagatcagagtatcttgctttattttataaaggccaaaggtagtatgaagtttggaccaaaaaggtaaatagatccattccagcacctgatactgatttttcaaggctctatgaaaggtcaaaaatttcattaaacaagaccagttctccctcttccccctgtcccaagaaatcttaggcatgaaaaggataaggaaacagctcctggaatgatacatttgcatagtgccctagtagcaggttgggaaaaagttataatataagaaacaaccttcgaaaacaggccttttatctcaaagataaaatgtctttcttgtggtctttcatcactatctccgtggtggaaggttcccctagttccaacatatttccattaaaatagtcaaagccacggcattgggatgtcagatgcctctctttctttgtggtaatcggaatttaaaattatacagttgcctctgaatttctcatgcacaaagccaaaccactgataagagataaagcagtctgaagcctgctgcttcagccagcacagcacaccacacacgctcgcactttcaaaagcaatgtgatttctatggttcttaaaagctttcttcataagggagtccctgaaatttctcaaggcaggtttgaatggcaaagggaaaataattacttgtgggaggtcctccttttgagtattgttagagcatacatgtaaaagaaaataacctttttggggcaactcatgctcacacatgctgttttctttggttctccccctaccttccttttgtagatattgacagaataggaggaaatgagcatccttatttgagaaagagcaagaatgtcatgagcccttgatgcaatagtaagtgtgatgtcatcatacagtgttaatgatgctatcaaatccatcaataaacagtctcaaaccttccaacaacagtgctcactgctgctcctcaacttcagcccagcaagcagtaatatcatcacccattttgagatatgcaggtggaatagaacaaagaaacagccactgtaatcgagaagcatgtttactgtctaaatccacctgttgcagtaggaagccagagtggggttccaaatgcctcattaagtatgtggacagcctcactagtaagtgagtgaatttggcttcatcactgaacattagctaaggtcagcttaataacacaaatatgaggccgacttctttgcgagaagagaaaagaaaacatctgcttgatttaaaatccaccccacatgcctagagttgtctaatagtccctcactttccaatggcttcacatcctacttctacatttggggttttttggtgaaatcagagatagctcaggatttcataaaacgagaaactccaaactggtctattaggttccatgggaacacttgtagccaaaggattgtctgagggcaggaagacgacacttgtcaacaaggaagacagtgtttctttagttcccatattcatctaattcatggggttctaacattttggggggccatagattcttttgacaatctgagccaatctatgaaacttctccccaaaaagaaccaccccacaaaatcttgcaaaacgtaagagattttcctggatctgaagctacccgaagacatgggaagagttgtattctattattcaattttaagaatatttattaatattcactgagctattgctagccactgtgctaaacattttacatacattctcctatttcatcctcaaaacaatcctttgagttgggttttaatatagttccaatattcggatgtgaaaactgaggcttatagtggctaagaaacttgcccaaagccactacctagaaaatggcagagctggaatgtaggtttaactcctgaccactatgctataaagtcaccacatgtcaaactaattttcaagttgttgggacatgtcccctactaggttttaaactagatcttccttggtagatgaagctatagaacttctattttccctgctttctgtagtctctcacagtgacagcatctatactaaagtatagatacctaaggggaaaatatagaaagcctgcctgaataatagaatctagaacaacaacaaaaatattaattttttctgtgtatgcttaggtcaagctt

SEQ ID NO: 37912 - DNA, 38059 bp, Homo sapiens
ctccagcctcctggagaagatgacgtccagcgacaaggacttcaggtgcagcccgccgccggcccccttctctccttcccgctctgaagccgggggccttcttcccctctcgaagcgccagcccatcccccatgaccatgcagccccctgcctcttctctcttctccctgcattaagctgcccccctccccacaggcccactcctgcctcgtggtccccactggagctccggccgttctcccctaggggccgtcctgcccctccgcgactccagtccctgcttcgtctcccaccgtgcaggcttcagccctacctctcacccccgatcagagccccggctccacccctctgcaccctgcctcggcctctcctccctcgtgtgtgtccggcccccttcttcccccgcagctgatgccccagcgccccctcccccccgcccccaccaccttcagcgagcccacagtgaagccctacgcctctccctggggaccccagcacctgcctctcctccgcattgaacccggacccttcccgggaccgcaacccccagctgactttctcactggcaccctcagtgatgcctccttctcaacatcacccggacccctccctccccgtctccctcccctcctgcgattgttcagacccagcctaaaggagggggctgggctgagtctggctttccagtcacaggtaggtgatggttggggtgggaccttctaggttttgtgtgccactctccttccccactccctttttccttctttccccctctcacagcatcacagaaccacaggaatagagctgaaaagaacggtggaaacatctggtccaatgagtttccacctgcattccctggggaaactgaggcccagggaggaaaagggattggcccgtggtctcatggccagttctggcccctccagctgaaagaagaccttggagactcaatgaacattttttcactttgtccccattttacagatagggaaactgagtctcagagacatgaagggcgtaggttcagtcacagcgaggaagtgggagacttagtccaaatccaggccagtctaatacagaggccaagatcttagtgaggtcctctgattccagccccctgacaggtgaggagacagacctgctctggtggtctgactcctactcttctcctgcagcccattcctcagtacccctcaagagcccccccacattaatagagcctgggatccaaggtcttggcttcagatcccagctgccgtcactcactggccgtgtgaccatggacaagtaacttaacccccatgagtctccctgtgcttctgtttctataaaatggggataacagaacccatctctgagggttggggtaaggattaaataagatagtacatgtgaaatgctcaggttcatggcaggcactaggtcggtgcttcataaacggacactgttatgattctgtgcacatccaaaatctgccacgccctgtcccctctctagaccttcactagggggattctttgctctcccttgacctcctcccttcatctgacagctcctataactcttgaccccaggcaggattaggtacctcctttcagctcccatcatgcctcccctcatgtttctgctagatcacttttcagccctgggagaccctgagctcctgggccactgggactatgcacttcctcttagtgccccaacacctgtgctgagtacacggtaggtgcttagtgaatgttcgctgggtcccaggctccctactgtgcaccccacgtgtaatctcagtccacccatgggtggtagtgattgttcttcctgttttccggaggcttggaggagtgcagtgacttgcccaaggtcacagagctggctagtggcctaggggatttgcgctagtgtctctcaggcctctggtccagtctctgggagagggagttggccctgccagctacagcccgagaagccctttcagcctgtctctgccagtggcctggagaacacttaaaaccaccccaagcatgtgagaatggtgtctatttttaaagtccgaataccagggtgctgggtcctgcagaccagctgtccaggcgtccgtgtggccaagggtttcagctgagttgcctctagggtttctctgtaatgaaactgagactgtcctctggttcctggagcggggcagcgactgcaaatgggggtcccaggtggggtggagggagacctttgtttcctgttcttcctgggccctggctttatgggcaggaggtgccccattaccacggaggctccagcagtcaaaacgagtacccttgcaggtcttgcaggaattaccaagtcatttcttgaaaacacagtagtattattggttgaaaagccaggagacctgtgtggtgggctggttttccgcccagtttgctgttaccgtaggcagtttgtgcagcctccctgagcctagttttcttactacctcatgctaagagctagattgtcctattgaaacctcccaaggatactatgaggtagggcaaagaaaagttcccattttatatatagaaaatctgaggcccagagaaaaggaggtagttgcccaatgtcacctagttgataaatggcaagactagtaagtatactcacttaaagccaaactttggtgctcaagctcttatccaccaaattatatacttttccttctctctcccatccctacacacatacacgtataaaacatggcttgctttctccgagagctagtgtctgcaggaaccaggggtgtctgaaatgctgaggcatacttcagaagagttggtttctgaattcggactatttggctgtaagttctgttaagggctagctctctcactacctctcctcctgctctcaccctccctgacaaagccctctgcagacctgttctttgttgagcctggagtcccagagataaacctgatgagcctctgccctcagtgagtgtacagtccaatggagaagatgctctggtggccagacttgtattgcagtgtgagaagtgctataaaggaggggtgcagagtgctctgaaaggatcttgtccagggaaccattgtgcttaggggctgtggatgcaggggtagggcagggaggtcagtcatccttgagctgggacatttgagctgggctcttgatgggtgaataggaggagctcaacagatgaagaagaagagcggggatagaaggcctatcttgggcaaagaggcacatcgcctgggttgccaggctgagctgggcccccatggactgcagcagaaacacaacttggagaccctgggtgccatctcagaatgtcccctcagctgagcagacgtaggggtgcatgtgctcacctcaggccttggcctggctcaaatccaaacctcctccttcactttacctttgcccagaggtgggcacagtcagtcctgccatcctgcccatgctgccagcccagcctccttctctctcctagcaacttgtggctaatctacctgttaaaaataaataggtcatcgaccagtccacccctggtaacagggcactgtgggctgcagtgacatctaggagcaggtctgagtctgcacagatgagagccagaatcccaactgtgatagattttgccacaggaggcgggggtcagggctcttggttgatttgctcaaccatgctggaaagcagggccagcgtggggtggtagagtggcccagcagggtcagtaaaagctggaggctttctccgaggcagccttacagtatctcctcgctgctctgtcctgttttctcctgagactccgctctcacatgcctgcaggagccagtcagtgggtgaagtgggcctagtggggaccaggtgaactggggagagggcagccacaacctgattctaatcaggtattgtcaccagggattgtaggccccgttgtactcaaatattctgttttcaagataatctggaagtcagtgttttgtttttgtttttgtttttgtttttttttgagtctcactctgtcacccaggctggagtgctgtggcacgatcttggctcactgcaacctctgcctcctgggttcaagtgattctcctgcctcagcctcccaagtagctgggactacaggtgtgcaccaccatacctggctaattttcgtatttttagtagagatggggtttccccctgttggccaggctggtctctaatttctgaccttaagtgatctggcgaccttggcctcccaaagtgctgggattgcaggcgtgagctgctgcgcccagcctggaaatcagtatttttttttttttttttttttgagatggatactcgcactgttacccaggctggagtgcagtggcacgatctcagctcactgcaacctttgcctcccgggttcaagtgattcacctgcctcagccttcccagtagctaggattacaggtgtctgccaccgcgctcggctaatttttgtatttttaatagagacagggtttcaccatattggccaggctgatctagaacttttgacctcaggtgatccacccgcctcagcctcctaaagtgctgggattacaggcgtgagccgccatgccaggccaaagtcagtatttttgtgtcaactttcccaatgttcaaatgttgacaagtaatttaaatttttgaaaacatgtttgcaagctggacacagctgagggctactagtttcagacctctgctcctaccctcttaattttggcgggaatggtgcccaattcccgcaccattcctcgacttggaaagttggccccagcctcaactttccgtggcttccagcttagactcccactgcagtttcaaatgcctgggacagcatcaggcttttggtgtcaggccccatgaatccctcacctccgggtgggtagcccttgcctctggtgcccaccctaggtcagtgagccagtcagctattggcgctggtctccaaaatatgcccatgcccatcagcatggcgtggggcagtggttttcaaagtgtggtccctgaccctcagtgtcctccaggaatttgttagaaatgtggattcctgggccccaactcagacctgctgattcagaaactctgggaatggggactagtattatttaacaagcgctgctggtgattctgatgctggctatagctggagatccactgctctaagggcagggactgagccggttctctgagatgggagtggacagggctcgccctcctccatctgtttggcagacaggcctctagctctgacttggacacaaggtgtctgttcaaccttctggtatcccttggctgggcgcggtggctcacgcctgtaatcctagcattttgggaggccgaggtgggcggatcacgaggtcaggagatcaagaccatcctggctaacacagtgaaaccccacctctactaaaaatacaaaaaattagccgggcgtggtggccggcacctgtagtcccagctactcgggaggctgaggcaggagaatggtgtgaacccaggagatggagcttgcagtgagctgagatcgtgccactgcactccagcctgggcaacagagcaagactccatctcaaaaaacaaaacaaaacaaaacaaccttctggcatcactttctcagctgttgtgagatgtggatgatgtcctgtgccattataataatggcagtgccatttactgagcacacaccatgtgcacttaaaacaccatgaggcaggtactagtctcatccctgttttcagacaggtaaactaaggcttggagaggtgaaatgacttgcccaagttcacactcataaatggctgaggcgggggccaccgatcctgaaacattatgcatttagccagcatgctgagccgttgctagtctgccactatgtggcagttggtgtcacacatatgtgggtctccttgtagcccaaccatgcccactgcccaaataatccaccatcatgtggcacttaacgacggggaaacattctgagaagtgcatccttaggcgattttgtccttgtgtgaacctcatagagtgtgcctacacaacctagatggtagagcctactacactcccaggctatatggtgtggcctgttgctcctaggctacaaacctgtattgagtactgtaggcagttgtaacagagtggtatttgtgtgtctaaacatagaaaaggtacagtaaaaataaggtagaaaagattaaaatggcatgcctgtatagggcagctccattaaaatcttttttttttttttttttggagacggagtctctctctgtcgcccaggctggagtacagtggcatgatcttggctcactgcaagctccgcctcccgggttcacgccattctcctgcttcagcctcccaagtagctgggactacaggcgcccgccaccacacctggctaattttttgtattttgtttagtagagactgggtttcaccatgttagccaggatggtcttgatctcctgacctcgtgatctgcccacctcggcctcccaaagtgctgggattacaggcgtgagccattgcgcccggccagctccattataatcttatgggacaaccattgtatatgttgcctgtcacttaccaaaacatcattatgtgacacaggactgcatttgacctcgaatctttgtattaaggtctacttctaggggaaccctgaggtactgcccaaatccaccagggcccaggagctgctcagcaatctcctccaccctccctgtgcaggttcatggccaccagcgacctgatgtcggagttgcagaaggactccatccagctggacgaggacagcgagcgcaaggtggtgaagatgctgctccggctcctggaggacaagaacggtgaggtgcagaacctggctgtcaagtggtgagtgtcagcctcggtggagcaggagagggggccctaccttgtgtgggagcatcctggggaccgctgtccctttggggtacagcctcgcagaggagacctgctgagcagctctcgttgaatggtaccttagtctgagttttcccagaagatgctgagacaaggattcaaatctaagtttatttgggaggcgctcccaggaaacatggtagaggagtagggaagtgaggcaggaaagggaagaggaccaatcaagggtatggtacgaagcaagtgaccacagtgggcctgatgagcttaaccccatggggacctctgggacacagtataggacatgtcccttggacttttcccactcaaagggtaagggagctggggtattaatccaccagctccctggtagtcattggttaagggctgcttctggggtaggatggagggttgtccactgcctgccacctccagccagagaaagccctcagacagatgtaaatgctgggaaggtcaagctgacacacatcaaggtggtaaaggcttaaaggctgggtgcggtggctcatgcctgtaatcccagcactttgagaggccaaggcaggtggatcacctgaggtcaggagtttgagaccagcctgaccaacatggtgaaaccctgtctctactaaataataattaaaaaaaaaaagttgccgggcatggtggtgcgtgcctgtaatcacagctacttgggaggctgaggcaggagaatcgcttgaacccaggaggcagagattgcagtgagccaagattgcgccattgcactccagcctgggcaacaagagcaaaaattccatctcaaaaacaaacaaacaaaaaaggcttagggcacatgggactgggagaggtcctaaaagccccagccttagatcactgtgaggctgtgatcctgagacgttggccagttatctcgagtagaaaaagacaagacaagggtatgtgcagagcacgtggggatgcttgtgtggtagggtcattctcacacccacacctgagaaccactagtgtagggcagaggttgtcaagcttgactgcaggttagcatcacctgggtaattttaaatagaatgccagggatcaagggacaacagggtgagagaattgggcactgtctctcaaaccactgtctgtgagctgggtccaggcattcttctggggcatgttaatgaatttgcaatgtgatcccaagagcagagagaattcagtaaagggttttatgtaggaaggtgacatggacaagtttatgagctgggaatgtctttctggtcatggagtagacttaggatgggtttcacaccagcagaaccaatacctttttataacaaatagtttgtaataccgtttcctattaggaaatgaaattcatacattataaaacctacctctacacataatgccctaaccataaccataaaggcaaactagaaggaatgtagtttatagtaatgtgtgtttccatgtatgcgtgcttgggcactgtgatggtagaagtgatgaagtcacgagaagcctgcatctacacgtgaactcatcatgagtacagatacagacagggggtgttggggactcaggtttcagaattggaggccattgctcttagtggcaagattttcttttttttttcttcttttttttttttttgaaacagagtctcactttgtcactcaggctggagtacagtggtgcaatctcagctcactgtgacctccccctcccaggttcaagcgattcccatgtctcagcctcctcagtagctgacattacaggcatgcaccaccacacccggctaatttttgtatttttagtagagtcggggttttaccatgttggccaggctggtcttgaactcctgacctcaagtgatctgcctgcctaggcctcccaaagtgctgggattacaggcatgagccaccacacccagccaggattttctaaagtgagtgaccatctcccaataaagtttcccagaaaacaaagtagaattttccttcaatttacctgaaaattgcattcttagaaaatctaaaatgtggtatattaaaacaatgtaaaaaagtattttgtgtctatgtataaaatgaaattttagactcagataattatagaaaggccttttgcctatacaaatgcccattgggatgttagaacctcttgcggggcatggacagtgctttgttttacattattgtctttctgccgttcctgcttctcaaccccttaaaggccagaagtactaactcaatagttttgatgaccaaggacccccataaattgccaaggtggtattactcctagtgggaaccagtgctataggaggtaggatggaggactccatgattacgtagatagaggagctgtggagaaggaagttgagagaaccaaggtttgaaaaccatggtgcacatgcctgtagtcctagctattctggaggctgaggcaagaggatcacttgaggccagcagttcaagaccagcctgggcaacatagcgagacactgaaaaaagaaattagccaagcatggtggcttgaatatgtaatctcatctgtgtaggaggatcgcttgagcccaggagtttgaggctgcagtgggctatgatcacgccactgtattccagcctgggcaacagagcgagacctcatctcaataaaaatcaagaaaaaagaaaaccattgtgcattgcagtcacctgaagctcttgttgaaaccctgtattccctgcccagggattcagattcaggggatggagcaggaagggagctggggcagaggatgagactatagcaccctggaatctgcattctgatgcacaccaatgtctgagaaccactcaggtagggcagaggttgtcagcctcgactgcatgttagaatcacctggggaattttaaaagccctcccccaaccccctccaggccacatctgaaaccaattaactgagactctctgagggcagtgcccaggtaggcattttttagaggcccaggtgatggcaactaaggccaagaacgagggcgtctagtgccgctgtttttacactttcctgtgcattggaatcacctggggaccttgtggcgctacagatcctggctcagtagatctagggtagggtaaggcctgagattccacatcctgaacaagctcccgagtggcattgccaatgctaactcaccaccaaactttgagaagcaagcctctaaggcagaggttctccaagtgtgctccctggaccacctacagtatcagcctcaactgggagcttgctagaaatgcacactatcaggccacacctagatatagccctcctgactctgaaactctggaggtggggcccagccatctgtttaaacaagcccgccaggggattcagatgcaccctcaagtttgagaacccttgttctggagcactatttggccatttcctgagacgtaaaacacaagaagaaatgtaggtttgggaggtcccaggaacgatgttggcatagccagagagtatctctttctggccaaacaggggctcccctgatgatctgaggccttttcctcagcacgtgtggccgcaggagcatgaggggacataaaggggcagcctgactcaggctgaaccttgtgcccttggattcaccttcccactccctgctcagcctgggtcctctggtggtcaaagtgaaggagtaccaggtggagaccattgtggacaccctgtgcaccaacatgcggtcagacaaggagcagctgcgagacattgccggcattggcctcaagaccgtcctctcggagctccctcctgcagccacaggtacccaggtccccaggactaggtactgttagtatttgtcctagtttatggtaaaaaaacaaacgaaaaaacaaaaaaaaaacactgaggctcagagagttgaagagacatacctgaggtcactcagctagtaagcagggcagagaattcaggcccagctcagtttaagttcatggttctgtgtcaggaatgcttttagctcaagtgatgaaatctaactaacggcagtttaaagaaatcaggggtggtttttcctcacatggcaatcctggaggaatcagccactccatttttgtagcagttcatttagtggctcaatgttgacagggttccagtcttgccccatgtcccctccctttatagggaaagcacacgttttcccagaaacccccagaggacttccacttatatctcactggcaagagctggatcacccagccactcccagcagcaagggaggcaggaaaggaagtgtttaactttccctgcctccctagtggaatggggaaaggaagaagggcttgggtgtgtgtaagtcacccagaagctcggccatcagctctgcagctcccctagctgtctccttgactttggccagactctgggtcaaacctgggacctctggagccctggtaagattcccggggatgtgggctcaggaacacagccagagcagaggcagactagtggtggaggctgcctttcccccaggccagggcctcactgtgcccaccttgtgccctgtgcaggctccgggctggccaccaacgtgtgccggaagatcacaggccagctcaccagtgccattgcccagcaggaggatgtggctgtgcagctggaagccctggacatcctctctgacatgctgagcaggtgtgggaggccatcctgggtattgaggaagagtgggtaaaaggggacagggagggactcaaatcacagagctagcacctactgcacaccaggccctgtgcttggggctccttaatcatcccagcagcctcgtaaaggagaactcaattgtcacaattttacaggctctgagagatgatgcggtcagtaaaacctcccatgacttgaacacctgctctggccagaaaaatgtcaggtgctggcctagtgttgggaacatggggttagatcagtcttggttgttctagggaggagttcacagacatgtataaaactgtgaatggagtaagcacaacagtaaggataagagcagggctgataggagctcagaggagcccccagtccagctgggagtgaggagccttctaaaagagagtgctgctagagctgagccttcgaggaggggcaggacttagctgagtttgggcaggtataaagaggatgctggaggggagactgtccccagtccagaaggcagagacaggggaagacttggggtcccagagtctgccaggggtcgtggggcaggctgtaatgtggagaggtgggtatgcagagctgaggtgcagggctggccaggagccatggggcaggggtgagtatttgtgtgttctaccctgatctttctctctgcagtggagagtaggtgggaggggattgaacaggcaggggactggttaagaggctgctatagggaaagcaattcgggttgtattcaggagggggactccacaggacttggagtgggcaggggaggcagggactggaggctgacccctagggttctgcctttagtaactggcgggggcagacagaggtgctgtgatggggtgcactccgggagccagcagcaggtgtgtggggaggaaggtgatggattcaagctggggcatgttgaacttgaggctcctgggaggcactcactcaaccacacactccatgagggcagctcccaggatcagtctgtcttgttcaccctggcttccagcacagtccctgtcacttagcaggtgaacaggcaaacaaatgaaacctaggagagggggttgggtaggacatagaaataagggagggtaaggtcagcgtgtttctgtaaagtgagaaagaaaaggtctcaagatgtttacaggacagaaaatgcacgggcctcgtttgaaggtgtggatagaagctgctgaggcaggcaggagctgtgctgtgtgcgcagaaaccattgtctggtgttgcctcttgtcttgagcccagagctcagcatctccaaaggcactagggagccatggaaggagttaagcagaggagtgaccaggtgagaagtagactttatactgctctggtctcagcgaggaggatggacagaaggggatggtattgaggcaaggcctagacttccaagaaatagggacagccttactagatcctctatgctttcccctatcaggtctttctccctaggctgggagccaggctttgcactgctgagaagtccctttctctctccgctttctctcatgtaacaaaagtaattaaaataattcctcctcacagttgcagggcacctcttttgcaagggccattgagttgccataatcctgggaaggaggccgggagagaatggggagaggggcggagcctggcccaggttgcccgcggagtgcgatcggcctgatgccccctcgtgctccccaggctgggtgtcccgctgggcgccttccacgccagcctcctgcactgtctgctgccacagctgagcagcccgcgcctggcggtgcgcaagcgggcggtcggagcgcttggccacctggcggccgcctgcagcaccgacctcttcgtcgagctcgctgaccacctactggaccggctgcccggcccgcgggtgcccaccagcccgactgccatccgcaccctgatccaatgtttgggcagcgtcggccgccaggccggccaccgcctcggtaagggggcagggggcggggcctgggctggcatggtgggcggagcttagggtgagccaatgactcggtaaaggggcggagcttgggccgcagtgcagccagggcctaagggtgggccgtctgccttggtagggaggatggggcggggcctgggctgatgtggtgggtggggcctggggcgggcggctgaagcccctgaaacgcagaggttggggccggatagggcttgagaggcgcagggcgggccctgagctcgacaaacccccaggcctgagcccctgctgagtgcagacggttcagagaagggggttggttcaatcacttatgagacgtggaggctggctggtaattacaattttaagtcatgccactaaactgttagactatgttctcttctcccagtttgacaaagatatcttagtaacagcccatgagccaagtttgaatttttaagaaacaatttaatgtgcatacaataaaccgcactatttaaagtgtgcaattcagtgtgttttgacctttgtgtatatccgtgaaacctttccatcacccccaaaagcttccttgtgtccgtttgcagtccagctctctgccttgtccaggaagccactgatctgctttctgtcactatagattagttttttagaaatggaaagctgcaatcaggtttgaatgtatcctcagacaccttggagttctgactataccaagacagtttggatagaactggcatatggtcagcccctcccaacccctggctctctcactgcaaggggccttgcaggcacacggcggggggtgggggggggaaccccagctgacatggccacaccctgtcccatttctcccaaacagcagccagccctcagccatccttggttgcatggacctaggaaagaggcctgcgcaggctcggacaaggggtcaggatccattgggcaggaaactcgggtccccagatacccagacagaatggagtctaggagtgttgggggtctctaggtcagcatgtctcttcttatgctgtagggaagggtatggctggagaagggcttgagtggagtgctctaaagcctggagaccaggcaggaacccctcttgcctggtctattagggcagtacctgcctccctttctcctatccaaggacttaaacctagtgaaggaaattaggccaggacatgaataatggttttgataacagatgctatttatcgagtgcctgctcgtgtagaacctggactaagcttttttatttatttttttgagacggagtctcgctctgttgcccaggctggagtgcaatggtgcagtctcggctcaccgcaacctccgcctcccggattcaagtgattctcctgtctcagcctcctgagtagctggcactacaggcgcacgctaccatacccagctaatttttgtatttttagtagagacggggtttaactatgttggttggccaggttggtcttgaacccctgaccttgtgatcccatgatctgcccgcctcggcctcccaaagtgctgggattacaggggtgagccactgcacccaaccttggactaagcttttttaacttcttttttttttttctttttgagactgagtctcgtgtcttgctctgtttcccaggctggagtgtagtggcacgatctctgctcactgtaacctccacctcccaggttcaagcaattctgcctcagcctcccaagtagctgggattacaggggcgcactgccacgtgcagctaatttttgtatttttagtagagatggagtttcaccatgttggccaagctggtctcgaactcctgacctcagatgatccatctgccttggcctcccaaagtgctgggattacaggtgtgagccaccatgcccggcctaagctgtttatctttttttttttttttttttggagatagaatctcgctctgtcccccaggctggagtacggtgacgctatcttgtctcactgcaacctccacctcccaggttcaagcaattctcctgcctcagcctcctgaatagctgggactacaggtgtgtgccaccgtgcccggctaatttttttttttttttttttttttttgagacggagtctcgctctgtcgcccaggccagactgcggactgcagtggcgcaatctcggctcactgcaagctccgcttcccgggttcacgccattctcctgcctcagcctcctgagtagctgggactacaggcgcccgccaccgcgcccggctaattttttgtatttttagtagagacggggtttcaccttgttagccaggatagtctcgatctcctgacctcatgatccacccgcctcggcctcccatagtgctgggattacaggcgcgcctggcctaagctatttatcattatataatttatcttcacaaaatctctgcccaggaggcactgttatccttgttgtgaagattagctgactaaggtcaaagaaatgttgtgacctgcccaaggtcccatagcagttgggtggcagagtcagggctagaacccacatttgcttgactatgaaacctctgagttgaatctacagtggtcagggctgcaggtgcatagacagtctgagtgctgtgggctgggggaactccgggagagtgtctggcttgggttcagtgatccacctggccctgcaggggctcacctggaccgcctggtgcccctggtggaggatttctgcaacctggatgatgatgagctccgggagtcctgcctccaggcttttgaggccttcttgaggaagtatgtatggtggggttgcctggggatccctttgggaagttggtggggatgctggcccaaagcagtaaaatttcaggactcccattgggccctgtcccccactcctgtcctggctggatccagcaaagcattcctcatcctgccccacaggtgccccaaggaaatgggtcctcacgtgcccaacgtgaccagcctctgcctccaatacataaaacacgaccccaactacaactacgacagtgatgaggatgaggagcagatggagacagaggatagtgaattcagtgagcaaggttggtggacagcccatcattggggttggagggtggaggtgaacacagccttcctgggatcccccaaccaaagacagcggtcacatttggtgcccctgtcctgatgccagctctttctcaagctccagtcccacccgctgtgactgcacagaccacagtaatgatagtagtcattgctgtcatttattgagcatctactagttgtgttcctcacaataaccctaaaaaaacagaaattattacccacgtgtttcagacaaggacacatactgagaagagagtggcctgagataacacaactaggaattggcatagctgggccttagagccaggtctgtcaggctcccccacctctgcactgccaccgtgtacccttttatgaatggctttcaggagataatgtctttaacccagcagaggaaagctctgatggtggaatggcaggcactggcaggggagcaagatgtctcaatgggggtggacttgatagcttctttcctcctatgcctgtggtcctgtctgtcattcagacagatttccagggcagagatgcccctaggcctgaaggcagggcatcgatggagacgatggatttagagcctgatggggtacttggaacaagatgggatggtaaatgagattggacaggcatgcgggggccttgaatgccaagccagggaggtgggacacttgtcagtaatagagagctaaggatgtgtgttcgtgggtggcctactgtgggggtgacagtgatccattagaggggatggctgctgagctgcccggtggccgtggcccactgtggctgtccagacaccaccctgtgggtccaagtggtccacagagtggtatgggcaaggccatgctgggctctgagcctgtgccttggggtgctcccaggcaagactgtccccctctgagcctcctgtgtgcctccacaggtgatagggctgggcctcgtggacctgaatctcagctctgctgttcctcgctgtgtgccctgagagtctcacccgctctgagtcttagtcttatcgtctgtaaaatggagcttggcagtaccttcacttttgaggtgatggtaaagactgcacgagcccttgactttcagggagattgtcaggtagaaagccacacaaacccagcatttcctctttattaatcctgcctggaagcctttggaatcaggacccttgagaggcagagatcgggggagagaagaggccaaagggaggctctgtcccttctcccttctggagtcccagtaaacgaaacatcacatagccaaacctgatgccaaaagatgagttttgtgccccaaattgattctccaagtctacatgaagacttggaagtctgttttttccctggtacagtccagacaattaagggtctggaggcagaggggaggaccctagtttaactccaagtatttccttaacttggggcaagccacttcctctatctaaaccccagttttctcatctctataatggggaaataatccctgtctcaaaaggtcgtcatgaagctaaaataagattatgggtttgacatgcttagccccatccgtagcactcagtagatgcccattaaaaggtagggaatgttccccatagggtatctataaatgctgatcatcaaaaagtgaagcacagtgcccagctctctctcctccctgtcccttctcccccgagccacagacctgtcctgggagatgagggttccacgtgtgtcttgttcctgccccagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgggcgtgccttcacctccacccctacccccgatttgcctacccagccactcactgttagtgtccctggacttggaaactcagctgggagaacatccagccatggaagggaagggaaggggtccctggggtggggggcgggagccagccaggcttctggagtgtagtagtgacagccagcctgcctgagtgagcttgagcaagttgcttggtctctctgtacctgtaaaatggacgcagaaaatttgcctactctccaagggtctgtgtgcggtcaccaaaagcctggcacagagtgagggacgagtgcttgggagatatcttgatgccgacatcctccctggggatgtgtctggcaaagcctcctggtagtgggcaggtgggtaggtttcttgggtgttccctgaccttgacttccccctcctgcccacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggtaggctggactgcaaccaggtatctgctgttctgggccacttccagaacccagaccccacccctgagttgagcccccagttcctgagacagtctgagacccaatcccaggctcagtccctggtcaagagtctccagtggcctcccactaccagcagtgagaacaaggctggctccagtgagttccctggacatgtttccctcagccctggccactggtcagggctgacttcttggaaacttctgcagaagagtttaggtgcttcagtccagctcaggcacttgtaggtaccccagccttgcttccagggagggccgtgttgcatcagaggcggtggcctcataacctttgcattcaccctgcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtaggcacacaggtgtgggcaaggcagcccacctcggaggtgggcagtttgccactgagcatccaggcagctggggcagagtgagctatttcaagtcactggatacaagaatcacggtatctatacgacagaggcaaggaagctacagaggaacacacagtgatacctgagacttaaagccttcctcctatgggactgtgggatagaagggacagagtccttgattggtccctacaacaaatacatttaaaaatctcatgatgttggctaggcatggtggcacatgtctgtaatcccagcactttggggaggctgaggtgggtggatcacttgagcctaggagtttgagaccagcctgggcaacatggtgagaccctgcctctaccaaaaaaaaaaacaaaacaaaaaacctcatgatgccaacttcataatccttgatgtggacagtagcttagtgctccacacagaggtcaacaaaaacagttttcccagtagccgtagactgcagcctgcagagggtcagctctttcggctagcctgagccaagagcagacgtcagtatagacggggacaggctgacatgcccccgaggcttggagagggctgggcaagaaccaggaggggcaggcgttttggcttgtcgtgttttggcacaccaggtgtcttagcttcaggaggtggaaagcagacaggtagggtcatcaggctcctaggaaaatgagagttcccagaatgaaaggccagtgggcttcgagctggccagctggccccttacagaaccagtggatgctctgcttgacagaatgcaggtacagtgtttggtaacctatgtggtacctacagtaattaatactgagtaaatcaagagctgctgttgttactaggtaggttagtgatttcagttaaggccttcttgggttgctgggttcgtaagaagcagttgtctggcctcaggactggatggaagaacattgttgaggacactgtctattacatcacacaaccttgagagacgagagtgttaagatgcagaggagccctgctttgcctaaacacctatttgtttctatctcacgtgcactgttgaaccagccacccggtcacatttcctttttagcaccaactgctgggaagcttagagccagatgagtggtctgcttctagtaggttcctgggacttccttattgatgctctctgtacatcttcctgctagtctccttctcacctccctgccttcagtcgtccttggccttgttcttgttttcagttcacttaatcttactctcttgtgcctgtcttcatcagccaccctaaatcttcctgggagccagtcaggctggcaagggaaagaggtaaaagctgaaagtctgaattcagtaactcttccattcattcatgccttagcaccaaatggtaaacttttcctcgaggctgaacataaagcctgtggggtggaaacaccttagcccattcactgcattgtgctggggttgggcagggagcaaagggggcgagccactgaggagagattcagacgcaggtggagcgtccacccattcgtttccttcattaagggaatgtacttcccctctttactgggcttctctactcagaaagcaagcggcaaagcacaagtaagcaagctctctgtgaccgagcctggaggtgatccgagttctgttaggcctccctgaccaccagccagaacgcagccccaggaagaggggcccagccaggaattctggatctgctgtgtggccctagacatgaacttaaaccctctgagtctctctttcctcatatgtcaaagagatgatttttattggtgattttattggttcttttaatactactttattattaataggatcattgttaggactcattgagataacatgtctgaaaaatcccaaggcctgagggaaggtctttgttggagcagttcctgtcttggttattggttccctgtttgcagcctgtggtgttacctgagcactggcagtcctactgtttcagctgcagcaggaagaattgaggggagattcaaggctgccaagggaaatggtagaatccactttcccagagatggggagggggtacagttctgttttccagggaagcagggggaggagcctaagcaccttctgatctgtgagcctccaggattggcccctgcccctcactaactcacctcttcttgtcctgcaggtcggccacacacccggagcaccgtcatcacagcggtcaagttccttatctcggaccagccccatcccattgaccccctcctgaagagcttcatcggtgagcacctacctcttgcccctccaccttgttcagtgcccccacccagtccttgagcttgggctgatgtttactacccaatagccaagggcaatgggagacccgggaggtgtgcccatgatgggcagcagggcctggccctccagttaaaaggcctgggttcacatccctgccttcctactgccactcaatcatgggtgggtgtggcatgcccatcacacctctaagcctcgctttcctcatctgtcaaatgggcgtgagaaactcttattatctgcattttctagagttgtcctggaagcccatgggcaactgagggagaagatgcttcatcaacatatagactcttgggaatggaaaaccaccagcctctcacatgccttagcttttgcgggccccaaagtggggcagggaagagtgctccccccggccccgcctgtccactagatcgccctctgtctgaggggccttctggcctgaggagcccaagcagccttcactgggaggagaggaactgagacctccctctggggctcggcaggaccactgggtttttcctaggaaggcagagccctcgccccttcagagcttggagcctgcagcccctcactgggccacactggagtctcagcccacatctaggcagggcagcccagtagagagaggttttggagctcacctgcctcaggttcaaatcctggccctgctattccctgggtgtgtgagtgtggacaagtcttctcatcctcagctataaaatgggggtgctgggccaggtgcggtggctctcgcctgtaatcccagcactttgggaggccaaggcaggtggatcacctgaggtcaggagttcaagaccagcctggccaacacggtgaaaccctgtctctactaaaaatacaaaaatgagccgggtatgatggcaggcacctgtaatcccagctactctggaggctgaggcaggagaatcacttgatcccgggaggtgaaggttgcagtgagcggagattgcaccactgcactctagcctgggcgacagagcaagactccgtctcaaaaaaaaaaaaaaaaattagttgggcatggtggtgggcacctgtaatctcagctgtttgagagactgaggcaaaagaattgcttgaacccgggaggcagaggttgcagtgagccaagatcgtaccattgcactctaatctgggcaacaagagcaaaactctgtctcataaataaaaaaaaaggaacggttgtgctgatactcatctgccaggggcctgttatgtgggaccaaggggccagcagacgtgaccgtgttctgcactggagaacacgtgcagaagctctagcaaggtcatcggcagcaactttgtcccttgccctaatgcagtgggcacatgccccccctccggcctgatttcctccattgtaacggagctgcccttggctagcaccaccagcgaccttcacatgggggttctggcttgctttaaaacatttgaactggtttttgagctctcactgtgtatcaggcaccacactaggccctttaatatacctcatcatagtggatgctcacaagcaaggagctgtgagcatccttgctctgctgggagccttcctgcccttcccagtgcatcacatcaggggcacatggaggtggcttgtcccctggctggcgatggtaactttgatcacccagttcaggtggataccgccatggtttctctccactctaaaattactctttttttcctttggaatgaatatgaatttttgagtacataaaataagtattttatgtaaacatccttgttctcatcaatttttttgcccactaggtttagcatccacggttgtttcttgcctgggtcaatgattactgtgatatttgccaaatggtgactttctagttccattattctttccatagttacaagtttgcattctactgtctggaagaactttttcttctctcccacttatttattcatcaatttatttgtcattagagactcatggcttcttcccacttcattccgtgggctatactgttactgtctttaattttgatgcattggaagcccttcaagctggttcctattttttattgacatgtttcaatcttttttttttttttttgagagagtctcactctgtcacccaggctggaaggcaatggcacagtcataccttactgcaacctgcctctcaggctcaagcaatcctcccacttgagcctcccaagtagctgggattacagatgtgcgccagccaccacacctggctactttttaaattttttttataaaaacagggttttgctatgttacccaggctggtctcgaactcctaggcttaagtgatccactcaccttagcctcccaaagtgctgggattccagacgtgagcccccgtgcccagcctccatcattctcttaagtgtatccttgcttttggcacgatgagatgctccagattcattgcgaacctctcctgccccagtcctggaatcagccatttctccaaggagtcctgattccttttagtggagaatggtattttgaatccaaaatctggacactagatgtgcctgttgctgttggggcctcattgcttctaggccctctcagcagacagaactaggaaatgcatgtctatacgcagagacacaaacacatacgtgtatacatgtgcttccagatgcacacccatgcacatctttctttgtccctccttctttccctccctgcctctctttctctccctctctcttctttctcttctacctacctacccacctattttgaaaaccttgagttcatagctgcttcgtattgcagtctagccccctttccatatgtgtaactcctttctcttacagtaagaaacccagctcccattatctacaagatatttattttcttaatcctgaaatacacagaaagtagtctgagaattgctgactcttatctctgtgaaaactaatactcgtgtgtagtttttttgtgtttcgctagagggcagctagtcaaaatactcgaagtggcttggtttgttctctccttcataagctgggtggttatgtggatcattttaaatacagtttttgttggtttgtttttgcagggggtgggtatgggtacggtggttcactcctgtaatcccagcactttgggaggctgaggcgggagaataacctgaggtcaggagttccagaccagcctggcaaaaccccatctctaccaaaaaatataaaaattagccaggtgtaggctgggcgcggtggctcacgcctgtaatcccagcactttgggaggccgaggcgggcggatcacaaggtcaggagatcgagaccatcctggctaacacagtgaaaccccgtctctactaaaaatataaaaaaattagccgggcatgctggcgggcgcctgtagtcccagctactcaggaggcttgaggcaggagaatggcgtgaacccgggaggcagagcttgcagtgagccgagattgcgccactgcactccagtctgggcgacagagcgagactccatctcaaaaaaaaaaacaacaaaaaaacggggtgtggtggcacacgcctataatcccagctacctgggaggctgaggcctgagaatcgcttgaacccgggagatgaaggttgcagtgagctgagattgtgccactgtactccgtcctgggcgacagagcgagactgtcttttgactcaaacaaaaaaatgataaatacagtttttttgcattttggttttatttttagggattcccccatccttatttctttattaagtatataaaacattaacaattctaaaatgtttaaactataatggctgggcgtaatggctcatgcctgtaatcccaacactttgggaggctgaggcagaaggatcacttgagtccaggagtttgagaccagcctgggtaacatagtgagacccccatctctaaaaaaatttttttttccaaaccaacatggcacatgtatacctatgtaacaaacctgcacgttgtgcacatgtaccctagaacttaaagtataataaaaaaattttttttaagtttaaactctatatcatagtccttttctgctactataacagaatactacagattgggtaatttataaagaagagaaattcattcctcacagttgtggagactgggaggtccaagaacatggcaccagcatctggtgagggccatcccatggtggaaggaagggcagaagtgagcatgggagacagagagacgagaggcggggcttaacaggagctccctcccatgatcactgacccactcctgtagtgacggcattaatccatgcgtcagggcttcaccctcgtgacctaatcacctctcaatactattaccatggcaattaagtttcaacatgagttttggtggggacattcaaatcatagcactgtacaagtctgggcacagtggctcatgcctgtaatctcggcactgtgggtggccgaggtggtggattacttgaggtcaggagttcgagaccagcctggccaacatggtgaaaccccgtctctactaaaaatacaaaaattagccaggcatggtggttcgtgcctgtaatcccaggtacttgggaggctgaggcaggagaatcgcttgaacctgagaggtggaggttgcagtgtgccgagatcacaccactgcactccagcctgggcaacagagtgagactctgtctcaacaacaaaacaaaacaaaaacaaatcatggcactgtacaaaaaggagtatcctgagaagtgctggtgactctgtgtaagtttcttgacctctctgatctttaagagcctcacctgtaataacaagttcacattcacagagtccgtgctgtgtgccaggcactctgctctgtgcttttaatgcattaccacattcaaaaaatttttttctttttttttttttcaagataatgctgaggcaccacattttaaattctaaagacagtcccatagcataggttctgttacgactcccattttacagatgaggacattgaggctctccaaggtcccacagtaaattggtagagctggaatggaagccacatcagctcaagcccacattcttatctggcctttgaagggttgtttgtgcctggcacaaagtagatgctcaccacacccagcttacccccattcagccagttctgcacgtgcacagtaaccagatggccggggtggtgagggaggtgactttgtgctttggctgtgcatcccccacgcccctcatgttcttctgccaggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtgtggagcagagctggggacccaggggaagctgggggtgatgccacctctcatgcctcactgttagggcattattatctcatcagagcaggtgccggggccacatggcctgggtcaagtcctgccctgactccgagctgtgggaccccagccagggcaacctgatcctctctgagcctcagtttctcctcgtgagcacatgagggtgctaattgtgtctgcgtcatagggttgctgcaacaatttggtgagtgaggtcctgtaagtgttcagaaccaccgcaggcacacagccagcgctcagtaaatgttgatgtttgacaggtgttcactgaacatctgcactgcgcccaagtgccaggactcagagttgggcctgactgggtttctgccaccaaggagttcatcgtggccccctaaaggacagagatgccaactctgctgattacagacagcccccgccttacaatggttcaactttacaatggtgcaaaagcagtagcgttcagcaggctcctcaccttatgatgggattgcttctggaagccaacttacaatggacctattgtgatgtaatcccatcatacaccaaggagcagctgcgtttcacttagagcccacctggtaaaggaaggattcgggggcagaggttaaaggtgatttagtaagtttgagctgtggaatactagcagcattgaggccctttaagctgggctttgaagggtgaaaaggtgtttaccattaaaacagggcttcatggttgaaagcttcagaaagacctgggtgtcttttttgttgtttttttttgagacaggatcttgctgtgtcacctaggctggagtgcagtggcacaatcacagctcactgcagcctcgacctcctgggctcaagcgatcctcccacctcagcctcctgagtagctgggactacaggcgtgtaccaccacacctagctaatattttgtatttttttgtagagatgcggttttgccatgttgcccagacgtctcaaattcctcctgcctcggcctctcaaagtgctgggaggacagccatcatgcccaacctacctgggttttaaattccagttcagccacttacaagcagtgtatccttaacctgtccagctcagttaattaacctgcccaactcagtttcctcatctgtcattaaatgggatcagtaacatttacttttttttttttttttttgagatggagtctcgctctgtcacccaggctggagtgcagtggcgcgatctcagctcactgcaacctccacctccctggttcaagcaattctcctgcctcagccacccaagtagctgggactacaggcacgtgccaccatgcccggctaatttttttgtatttttagtagaggtgaagtttcgccatgttagccaggatggcctcaatctcctgacttcatgatccgcccgccttggcctcccaaagtgctgggattataggcgtgaaccactgtgcctggccagtaacatttacttctgatggcatttgtgatgcttgaatgaaacgtcatcagtcaagcagtcagcacagtgcctgccactcagacagtgcctgctcagtagattataagaataattgttcttattgccactgttatcacttgggggaaatgacactgcaggctgagcaaaggcatggagacttgagagtataaggcacgatttggggctggcatggattgtggaatagagatgtggggtttgtagcagaagctagaagaggtgtccttacaccctggggccatatcaccaaccttcatccctcctgcaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccgggtaagaccaagccccctgccagatctatgtgcccctgtaccaagggatagtcgggcaccattggggccatgcttgtttgtccttgctccctactccaggcacccaatgaaaatagctgcattgttgttttctgataagaaaaggaacctgtgtctcaaacacctttggtgggagtctacactgggcaggctctttggaggatggtttcacagcaaccagaaaaaaaaaattgtccaggtgtggtggcttatgcctgtaatcccagcactttgggaggctgaggcaggaggatggcttgagcccaggaggttgaggctgcagtgaaacatgatcacaccactgcactccaacctggacgacaaagcgagaccctgtctcaaaaaaaaaaaaaaaattcccagacgaaatttttgaccctgcagggcactttcagctgtggaatactagcagcattgaggagcgagctgcatctcttcgtgttgtgacctgaaagagctccaagccccaatgttgagtggcaagagctagttccagaagttaggaccattttcttaacagacagagtgagtctggggctggtggagacgtcggtttcttcaatttatatctttctatatcatttttttaaatgttaaagtttattcacatatatgatagaaatcatttaattgtggcgaaatattaataatacaagttactatcttcagtaacttactatctgcaggtgaagtgtttttttttttttttttttgagacagggtcttgcactgtcactcaggctggagtgcagtggcttgatctcagctgactgcaacctctgcctcccaggttcaagcgattctcctgcctcagcctcccaagtagctgggactacaggtgcccaccaccacactcagctaaattttttttgtatttttagtagagacggggtttcaccatattggccaggctggtctcgaactcctgacctcaagtaatctgcctgccctggcctcccaaagtgctgggattacaggtgtgagccactgcgccaggctccatcttcactattttaaagtgcacagcacagtggcagtaagcacattcacattgcggtgcagccgtcaccactgtccatctcagaactcttttctccttcccaaactgaaaactgcacccattcaacactctatgaatttgactactctaggtttctgcccttgtaagtggaatcatacagtatttgtccttttgtgaccaacttgtttcacttagtctgatgtcctcaaggttcatccatgttgcagcatgtcagaatttcccagtgttgtatgtacagaccaccagtttgtttacccattcatccatcgctggacaaatatttgggtgttcccagcttctggctattatgagtaatgcgactgtgaacctaggtgttccgatatcctttggaatcctgccttcagttctcttcactttacccagaagtgaaattgctggatcatacggcaattctgtgtttaatgtcttaaggaactgctatactacaactttatttttaagtttttatttatttgtttgagatggagtctcactttatggcccaggctggagtgcattggtgcaatcttggctcactgcaacctccgcctcccgggttcaagtgattctcctgcctcggcctcttgagtagctgggattacagatgtgcaccaccacgctcggctaatttttatatgttttagtagagacagggtttcgccatgttggctaggctggtcttgaactcctgacctcaggtgacccacccacctcggcctcccaaagtgttgggattacaggcatgagccaccacgcccggccccatattacaactttaaaaaatatgtactgtaagcgtgagtcactttttataaggaaaaattaatacaaagtaatcaaaagtaacccatacttgttttaaaagatttacacaagatgaaagcaaataaagaagcaagtaataatcacccaaaagcttctccacacccagagaggcctgctgtctcagtgtgtttcttgggatgatgcacatagaccctcattcattagtcagccagtattaagtgagtgccaacacgccaaggtcaatgtgagaggtggggtccctgttctcaaagctgtggagatgagtttatgagacctgttttctagaaatgggatcacacacatgctgtttttttccccagccttttaacttacatttactgtatgttgtttgctttgcttttcaatatatatcagtcctgtcaacagctgcaggagttcccatttctgttgcactcactgctacacatgtatgttatttgcacattttcacaattacagacaatgctgctgtgaacaccctggtgcattactgtgacccacggtgtgatcggtgggcttctagggtggagtgcatgttcctgctaaagcatccgatgcgcgtggtgaggctgcacctcctgcagcgggcgtgcctctgaccactccagacttggagttcctgggacgctccttcctgcacttcctgtctgcctgtctccccctcggctttattattgctttaaactcttgcttcctgccaacccccaagaaagagaaaagaagaaacaacataagttctctgggattccagccccaagatcttggttgagaaagggggttgggttttccagtgtatgccatgcaaactagtggaaaatgatggggcgcacaaagctgaacaggactttccaccacagggttccgggaggctccagacgggaggggtgtactcagcttccatcatctgggtgtgcctggtattaggcatcttgtggggctactgaccccaggacacagagtgaggagttctgggccagcccaaagctccaccttgtggggatttttctccaggatcgagcaagtctgtttcttccatccagtctggccatatcctctcatgcctgccctccaggagcgcaggacagggcctaggcaccagtgcagccttggagtccactctgctgccaccccctggggtgaggagggtgggtgttacagctatagagcccacagctttgcgtcatcaagtcttcaagtgagcctttagagagggagtgaacaccgcccagttcacaggggagacggaatcttgtctagttctagggcacagggtcatggagtagccaagagtcatagctcctgaagtccagcaccgctgctccttgctgccgtgggctgggcctcctcctttgctgtggggcttaggggtcagggtgtggagatgggtagggcgtggggatttcagacaaccagtctttatggtgtgcaaggcttctttgtgaggacttgactattttcaaaagacaggacaattattcccctacaggctgaatctaggcctgcagccatgtttagttgttgttaaaagtttttgtttggttttgaaatcaggtgtcaacatttaaaaatcgagactttttttttacatgaaaattgggatttcttttgaaaacaatccagtggccccaagctacatgtttgcactcccacctggccacactcagccagagctgccccagcagcccccttcactcatccccagcatctgcctgactggtgggcatctgagcttgagaacgactccctccctggtgcttttctgatcctccttgggtcatccaagtgtagttggcaaagaaagtgtcaccatttgaggaaacagacccagagagggagagactctggcaggacttcacggtggtctgaacttgggcttcaggtttcagttgtggggcctctgctctttcccagggctggctgctgctcttgctcctgcaccatttcactaagaaccatctccttcctctgggcagatgctgaccttcatcatggttgcccggctggccaccctgtgtcctgcacctgtcctgcagagggtggaccgactcattgagccactaagggccacctgcactgccaaggtaagtccctggcccagccctagcccaggccctggagcacctatggagtcctcggccagtcgttcagttacccttactgagcacttcctgcagtgcaggtgatgttgtgaaagtgcttcatttaatcattgtcattgccctataaagtacctcttattatcattgtatacacaggggaacagaggctttgagaagttgttattggccaaggctacacagctagtaaattgcagagctggattcagacccacctctgtctctccttccattcattaaacacttcctgggtgctgagcctcgtgggagatactaaagatgtaacattgagcctgataggttccctactgtcaatctctcacctccttgttgggaagctgggtcagatgactggtctaggacaaagctgctgctagactggagtgcctgaagggtctggaggagggatgtggggtgcaagccctcatggaaagctggcgttgggagcagagcctggcgcacctacgtggtacctagtaaatacctgttgaatgaaagaatacatttgggttttttaaggatgggaatcattaccaaaaggagagcagtgttttaggttggcacttaaagaggagagatacccataaagtggtgattttcaaaaatgaaatcttctgtggataaaacactaaaattggtagtttattcatagaaacctgccttgtaagtttacatttttaacatatgcttattattgagtccatccaaaaaaacacttctacagggccaggccagttttgacagtctctcatttctggttttctctgagctctatggcaccaagaaaagtcccagttcttaagagggaggtatatatggcactgcagtgccagaacattcttgcagtaaagccgaggtggcaagagaagctctgccctgagtttccacaagagccactcatctggccacgcggaggatgctgtctgttgggcattgggatgagcatgggtaaatccacacccacagtccttacccatgaccctgaaatctaccaagctctgacaaccaaaagctttttaggaacctgtttgtcacacaacttgacttgaagtggcatgaggctatgatctttaattcttaccaatgtaccacttttatataagggacttgatcatctgaggattttggcatcccctgggatcctggaaccaaactcccatggatactgagggacacctgtactactcacattactcatacatgtagtagagtattcatgtatttgattacagggtattgtacaaaacccctcgggaatgttatctgcacagtattacctttctaaaacccaaaatgtcttggattccaaagcacatctggctccaggggtttcagagaagggagtgtggacttgtgtcgtttaatcctcttggcaactcttacgacgaggcagctcttacttatagatggggaaatgaggctcaaagatgtagttacctgaagtcacagctcttgggggcagagccatttgaacacaggactctgcaactccaatgccaagctgttacccactgcattgaattctttaggaagagcccagcataataaggaacttgaactttagtccataagcagtggaggaattactgagctcctctgcctaggtaggagatggtgggggaagaggaaacagaaactgcaggaggtagtttggggtgcttacactccggctgcatctgcaaaactgattgcggggcagggacttgagtatggggaggaggctgctagaagaccatcgcagtgatccattcattcagtctagtcatatggtgctaagagctggttttaagcacagcaaatataggctggatccctgcagtctgtaggaggtaagtatgggaacacagtacttgccactgtcaattaacaaaaagcgagcacttcagattggctgctcagaggcccctcaggctgtactcaagctgatttgaatggcaaagaacctctgtggggaaactagccagtgcaaaagcccagaggtggagttaggaaatagctggtgagacagaagcctcaggagacctcgcagcagggatttatgttggggaagatgatggggcagagaggaagccaaagaccagtgaggaggcagtggtgtgggccaggctcaataaaggatggctgcttctgctgtttcctactttaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagtt

SEQ ID NO: 37913 - DNA, 1415 bp, Homo sapiens
gttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccaggtaagaaagaaagcctcagggctggagcgagtagagcagtaaagacggctgggaggtagtggtcagatagagggtaaatatttcaggagggaagagggaagaaactttctgatatgacagccatcaaatgcatgagtacttgtgaaagaaaatgggatatgccaatcaaaggagaggtcatatttctgtttcctgggcttcaggttcttcatagaattgtgagactatgtgagaaagaagattttaaagggagctgtaaaatcttaaaaggcaaaataaaaatctaaatagttatgattaaaaattttgctcttattgcttctcctactataactatcttctctctttctacacagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccatgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattct

SEQ ID NO: 37914 - DNA, 7663 bp, Homo sapiens
agcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggaggtgagtgttcgctctgggaaggggctgtagctgccctttggaaggaagggtttgggggtgtaagaggcgttcagattctcggtctggtgtgccccaaattcagatgtgaaaatagatcatggggatgcaatcccagggcactgtatttctcacttccttgggtccctggcacgcgactcccagctaacacccaaccacacacatttctacatactgtttcttaattttgttttgggatatttaatctaagcggtcagcaagacttcttataaaagctggtctacgtacactgagatcaaaccccacaatcccatggtgtttctgctcctgccctagcaagcctgggtcgacttgtcccggggcagccgcggcagcgcagcgtggacgggcccggacacccggtgcctgcccagccagcgacgctgaaggcacatttcaagagggaaatagttcagtcctcggtaatttgtcaacctcgtgctggctttaaaattctcctcccaccttctagtcctgactgagggggcccaaaagcaaactccccgggggcttaaacgctcggattcctgagaaacggcaagtgagaaaggagttgcagttgtacgaagaaggagcgaggaaaaggtgtttgtggagggagccccggatctgtcttcctacctgttagccgagaacaaaagggggctggcgtttcccgaagcgaaagggcgcagacagccactttctctgctaaacaaactgcagtcctgggcagaacaagaaaattactcacgcagggggagcaaggggagcacagagaaacagaacctagattatgcggaaggcatcttaatttaattaactccttgggaaggcagaggcgctctgaaggggcaggaacttcgcagccgtttctctattcacctgatacagtctggccctaacaatctgtcctttaacaattttttttctttttaatgatcttctttgatctacttagtctatagctctctaatttatataaaattctgctgtggtttgggctgaaattcagtgagcctacctatccgaccatcagtcatttatctcatataccagtgcacaggttttagcagatgaaccctgactgtatattatttttagataattcagtgtaatattaccattaccaaagagcgaaactccttatcaagttacttcttaatttttttctccaatgttttgaaagcttcactgaactgaaataagtgtgtacacatcttccttggtgacagccagtcaagtaaattttacaaaatttctccacatgcctggaaattcctgtgaagaagactgatgaaagaaaagtagcctcagctccaccaacatatttatgacttttcattggtttaagtttctttccttgcaagattaaaagtaaccagtggtctgaaacgggacggtggagaaatgacagcagatgatgatcgctgttatttcctgaaagggagtgtgggaactacaaggctcagctctagacaaaacgaaagtactttaggatctctgcattcacttaaaatacttcttttgacatacatttccagcaactcaatgggagtgtggaaatttaaccttcctaattatttgtggcaagagccattggtggatatttaaggttgttctgtttgtaaaagggtttcaaaaggaccaatggtttgctcttcctctatgaagaaactatctgccctacaaattaaaacaaacaggtactatgaaatagcactttttttttttactaacatgaacctgaattatattagtcgttaatttctgtattataaaccattcagagaaaagggaaagaagatggcactcaactttgtggcagtgtaacctttatggcagagttcgctgtgcctttggtatagaaatcacaggtcacaacagtactttagccaacaccactcccccacatgcccgctcccccctccccaacgcatacaccctgtggtgggagttgtgctttgcctcctgtatttatttctaagaaatctagtctgggaatacacccaaataataatttcggtttcctctctatgggaaagaggttgcttttcaacacgaagggaaaaataatattttgaatctctggaaaatcctcattacgcaaagagaaggaaataaaggtataaattattatttttaattgaaagggaaataatcaggtagattaccaggaatgttagtagaatccttttcccctgcctccctaagagacttgccaccgagcaaaaatgaatcgtgatttgtggtgggaaagttgattactaatgggggtttgcagttgcggttgaatggtctgactgagaccctctgactgttacccacctctcattaactcttagcctgaactcccagaccgcataccaccaagcagaagcgattcgttaataaatctctgtcccgagcccttccagaggaaggtgtgggccccgcagaggcagccagatcctgccttgccagagcgctctgtcattagcgtagccccctaagtctgctcacagatggaaccataggcaatacttcataacgcgctggagaggacaagtcagacgcaggaaggggttgggtgggaagggaaggctggagtctctcctgccttcctgctgggttcaaatgccaggcttggcggttggtggcacagactgggaaacgtgactcctacacctgggggtctgccctcagagggaaggccctggtcccccgaactggcagaactcctttctaaaaaggggctggtagtgggagaaggtgggcccgctgtgaatgtaggtgaggtgatcccgggaacctgggtctgaaatcagacctgtgttgccattgggagcacggagagaggggaagcgccctgcttaggcccaggccgggcgtcctggtggtgggaccgcagccgcactcacctccaggccaacggacaaggttcctgcaagccagcagggccactctgtgcttggcctactgcagctcccctgcagctcctttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagcgcgccggcttcgctcttgcacgccggcttgccatccgggtaagcgcgggaaaggcggccacagggcgcggcggcagcgcagcgcgtgggatctcacgacccatccgttaacccaccgttcccaggagctccgaggcgcagcggcgacagaggttcgccccggcctgctagcattggcattgcggttgactgagcttcgcctaacaggcttggggagggtgggctgggctgggctgggctgggctgggtgctgcccggctgtccgcctttcgttttcctgggaccgaggagtcttccgctccgtatctgcctagagtctgaatccgactttctttcctttgggcacgcgctcgccagtggagcacttcttgttctggccccgggctgatctgcacgcggacttgagcaggtgccaaggtgccacgcagtcccctcacggctttcggggggtcttggagtcgggtggggagggagacttaggtgtggtaacctgcgcaggtgccaaagggcagaaggagcagccttggattatagtcacggtctctccctctcttccctgccatttttagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacaggtgaggcgggcaaggaggatggctgggagagggaaagcgaatttgtcctggacacaccgagtcctgatagacattcccagtgtcattataatcccctgtgatctaaaatacaccctcagtcacgctcctcagcccggttcagctaattcccaacatctaccctttctttcccccagcggctcttgctacgttcttgtttggaatgagggagggcctttcctcagtcttggacaggaacaatctgttggccttagtcctgggatggttatcctgtctcctcccggtgctgtggggagtggtgcaggcagaacccaggtaccctggggtgccggtcctggctgcagtcgggctacttctgttgggtttcgtccctccccccaccccccaccctccacccaggtgcgccccagagcctgccgtggggacctttcttttaagctgtatttgtgggttgagagggggaggaggtcttgaggtcaccgaatttacaaacagctcccacctcccttccgcgaccttaaactctgcattaatacaaggcaattgaaggcattcaataatgtaagtgttatcattgggtaaaaacttctcaggagttggggagacctttttagcggtatcttttctggactctacctgctgttccccagagatgagacttctgtacccatcctgcgaggctgttaagggattcactaaaattagcacttctaaactcagccttgccttacatcctgatttggccaatttaaatcccagagaaaaccatggaggccaagaaaggcccgttcagcggggtttcgagctccagaatacgccagagagggcgatcaagtgtagataaagcccgcgggctggtgaatattttgaagagaattagttgagattaaccataaagagaattacacaggaaaaaaaaaaatctaaaaacgtaaatggaaatcttgtttcttttgttcttccacgacttccttttaagtaattgctaaaagtaactcttcaccatggggcaaagttatttcaatgaaaccttatattgattttcagatacatccattccaaagaaaaacccttcaaatgtcaggagtgtgggaaaggattttgtcagtctagaactctagcagttcacaaaactttacacatgcaggtaagtttgttttcttgtttaaaaacagtggctggttcgtgttatcattactgctttgcaaaaggtgttcaatggcagactctttctcttaaaaggctctatttagattagttctctaggtggggaaaagcaacacttgatttctttaatacataaaattaatcttgtttaacataaagcatttttatatttttctcaaaaaacggccactttgattatcataaatcctaattttagaatttttttcatccaatctgtcctgcatttaaagctttcgtgtttaggaggaaataaaggtaattttgataatggaggcatagtgaaatcccatacgttctctttcccaagggcctcataatttgtagctttcaggacattgaggaatagtttagttttccagcaaagaggagccttattacccaggagaatgttgttccttaagagaggattagagtttttccttcccccttttcctgcctatgacatggtgatgaaatgtgaagagctggaaatcacaaagcccaccgaggtggctgcgggtctgcctccgaagttatcagtgtaatcgggcctctgtgtatgcctgcacgtgtattttcatgattggaagattaggagcacggatttgttcctgcaagtctcctcttttgttgtcatgagagtgttatgttaacgcttgtgataacgataagacagaaactattgaaaagggtgcagtggtggtgtgaaggattaatcctttgcttgcttcacatctgaacaggaatctccacacaaatgtcccacatgtggaagaacctttaatcagagaagtaatctgaaaactcaccttctcacccatacagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaactcc

SEQ ID NO: 37915 - DNA, 8346 bp, Homo sapiens
gctcggagcccggagcgtgcctcggcggcctgtcgggtaaggccgggcctcggagcggtggcgcgggggcgggcgcggggagaggccaggctccctcgctcagcttccagcccggcaccccccaccccccaggctcaggcccctcagacccgcagctccctgcgctcgccctccccgccagcttcgcgcccccatcccttccgggcgccccgacggagacagacgacctctgatcccccgcccccgcctgggtacaggccgggccagcccgcgagggagggagggagggaggacgacagatgcaggcggaaggcaagactgaaacctgagatcagaatgttgtcccttctccctgaattcccttcctcccagagctgtttgtgacggtttccaggcagcccagggccaggccgcggctcctatctgcagctgcagggagagagaggaggaaccccgtgcgattctagagacgatttcacaacaaggagaaatcagctttgtgcttacatgccgagcagccagcacggttcttctttgcctgtcctcgggggaaatcagggctctgagagtggagatcgagatgggctagtgggtggcggatgggacgctgcacggccagaccctggactgtggtgggtttccaaactggcacatcctacaccggctctgagactgtgggcactggacctcataccttttgaacctcaaaaataaggaagaattatattattataataattacagtgatacctttgctggagttttaatgcatagtaggtagctgagtctctgatagaaggctcttagttcaggtgaaggtaggcaatggattcattgcccaatgaatcagagacttgaatcaaaggctcagaagcacgtgcgctcccacacataggttgggaagacccagggctgggtgggccctcccaccccactaaagctggggtagctggggcctgccttacccccgccccacccccagactcacctgtctgcaaggtcagagccctttagggcaccctgggtgccctaaaatcccctataactgctgagtccttggccagaatggtcccacatttgtgggcctgggaaagtgttcttgccctgctggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaaggtcagcagaaacaaaaaaaagggtctgctttcctcccatctccctacgaatggacagtctgcatggaaaggttgtgcctttgagctcttaccttgtgttttcagaactgtatttttatgagatcagactttcagaaaagtcacacttgtatgcaggcttccattcatcatcaggtttttcctaagtacctaccacgtaccaggaactgtttttcgtattgctgaggagacagcagtgagcaaagctgacaaaaatccctgcagggcgaggcttctgttccagtggatgaatctgacagctttcctgaaaggcatactacatcctcctgagctagcatcttccagtttttgctttgcatatgatgatatgcaactcataaatattgcctgttatataacactactttcaagcataatgagaggaataagacatagggaatgcattatagtggagatagtggcattgcttttttgcaaggaaaagagaaaaagtgaccctgtggttctgtagtcccagggtgctgcgcatggctcagtgggctgtggcatagcacgccctgcaggggaggtgagggggagacccgcagcttcaggggcgggacccagcccttggcgatgtgacaggtcactctcatgcccagccttccttcttgtccataatggacatggagaggacttctgtgcttggtactctttaattctgagaagagaactctagctctctctctctaagctcagcagaaaggagtggtaaaagtggaggctcttctaacatacctgccgcaaattacactgcacctgttccttggcaaggtgcagcctgggattcaagttcaaggggctgcgaaacttctattactcatcactttagatatgaaagcattttaaatgttttttttaaatccattaaaaaaaaaaaacctctgttactaattgttagttgcttcttgcagggttatatcagttcctagcttgaggttttccagggactttaaaacctcagcaaagaatagttttaaggactcctcccccatttccattaaagcagatggagcataggcacagtgcaaacattccatatctcggtgagtaatgtggacttcgtaccctatgcaattttgttctttgtgtcttaatcataaaggaaccagcctaggtctcataaaaccacaaagggcctcttgatttgtaactgatacatggggaattaaacttttgccagaatgttaagtttaaggaagttattttaaaataagtgagttactgatgttaatagggtaataaaattttaaaagcttcagtctgtactatctttgtggttctgaatagaggatgaatcctatttttactgcttatttctgagaactttcagtaaaattatatttgatacagaatataaatatgaacataccatttattattttctttggaaaaggcagacttatatataaatatttagtatcttaaccacccacatttgtggaactgcaagtgtaacaaagagtgatgtaaaagcaatgtgtaaagttgtaaacattctgtctcacgaagccataaattttggatttcctattgtttgttctgcaatgacaaattaataaagtattgggtttgggatcatcaataattagtaataaaaacacattaatttaatgtgatagaaggaaacaccaaggaatcactttatagtttcaaaataaatggttgtagaaagaagattttctttattttagactttccatttcaacacggttgaagaggttcattcaagattccagagtctgaatgctgatatcaacaaacgtggagcgtcttatattctgaaacttgctaatagattatatggagagaaaacttacaatttccttcctgtaagtactttgcccttcacattctaaaaccccactagacagtgcagatattttccagcacaatcaagtcatggaggtcagttttaatatttgtaaactttcagaaaaacaatacagaaggcaaacatggcaaaaacaatatggaaggcaaacacgacagaatgcaaactttaattgacatggtgattttgtgttacagtctttttagtgaaaagatagctcttggaggttttactgaagcaagagtacaatcagtgtttgtgaaatcttagtcaaagttcagaaaagagtggtaatttctatataacaacaacagtataagggttaggcttaccactactggaatgcacagttaaaagtggctaagatcgtaaatttaatgttaaatgatttttactactataagaaaaactataagagttagaaattttgtgttacatggaattgtagccttttaggacaatttctgttgctttttgggattttagaaaacaatttctatatgtagtaggagttatatatatatttccttttccttttttttaataggagttcttggtttcgactcagaaaacatatggtgctgacctggccagtgtggattttcagcatgcctctgaagatgcaaggaagaccataaaccagtgggtcaaaggacagacagaaggtgagagcctgggcagaatggaatcattatgcgctggtcatgtcattcgtttcctcagtccgccttccctacctgcagttattccctccccagctcccacagtcctggcgcacatcgtggttacagtcagaggacgctgccggtgcgtgaagtctgcactgcacgttgctggacagctctcacatgttcgaagttcaccagagtggaaacttaaacatgatttaactcaagcagctaaatccttttttctcatcagctccccaaaacttttaaagttgcatttcaaagttaaaaccaacattggcaggcgcggtggctcatgcctgtaatcccagcactttgggagcccaaggcgggcggatcatttgaggtcaggagttcaagaccagcttggccaacatgatgaaaccctgtctctactaaaaatacaaaaaatttagccaggtgtggtagcacacacctgtaatcccagctactctggaggctgaggcaggagaatctctcgaacacaggaggtaaaggttacagtgagccgagatcatgccactgtactccagcctaggcaacagagcgagactccgtcgtaaaaaaaataataaaaataataaaaaataaaaaataaagttaaaaccaacactgaatacagcaaaaaaggaattaaaattttgaggagaattcagcctgccaaaaattacctaatactcatatggaaagaaatgtcctggaatttcatggaaatacctgaaatcaatattcacaaactactgtggttgtaaattttttgccaacatcttgtccagtaaaaaagttgtggtaggtggggactgacttgcttttagggtgcaatttatttctttgctacatctctcttcttacatagccctgtattagtcaacccactccagaagacctgtcttccattatgggaattgttcccagccatacttatggtcacgaaggtgacctttatttccatggagtatgttctgctggtttttttgtttgtttgtttgttttttgtttttaagagacagagtcttgctctgtcgcccaggcttgagtgcagtggtgcgatcgtggctcactgcagccttgacctcctgggctcaaggaatcttctcatctccacctcccaaagcactgggactgcaggtgtgcgccaccatgcttggtcttgttctgccttttggatattgtttaaacctttttttgtgagagtaggcatctactcagcgatttgaagaagtgatttactgatgactaaagatatcttcattaagaattttttttttctaaaaaagaatggttgttacaaaataaggctcattgtttatcatacagtccagaaaaggagaattttcctgtcttttgtctttcggcacatttgacttgtttaaaatgtcaggtccttgtgggaagtttgtgtgtcatcctggtctgtctgccccacaggttgttatacttaaagtagagacatgttagtgagtagggctttcctaagttaatatcttgttaaatgaaaattaagtagaaattatatatttgaattgcatttccgtgctaatatattgtcagttcaaatttggaattccgatttggattttttttacgctaacttgatttttttttaggaaaaattccggaactgttggcttcgggcatggttgataacatgaccaaacttgtgctagtaaatgccatctatttcaagggaaactggaaggataaattcatgaaagaagccacgacgaatgcaccattcagattgaataaggtgaggtgaggtaactgtacagagtcatgcattgctctaaaagaatgcagagaataatttcagtgattttttaaaactgttcagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaaggtatggctcctgggcttcatgctttgtggttcctcttgcatgtgtgtgtcgcatggtaggtaggtgcttgttaagtgttcactgatggtgcattttccagtagtttgtcattcctttgtaaatgtagcccatcaacacttactacactaaagcccagagttaatttttttttaaatttacttatagagacaaggtctcactatgttgtttaggctggtcttgacctcctggcttccagcaatcctcctgcctcagccttctgagtagctgggactatagctgtgagccactgtgcccggctaacgtttcatttttcaagaaagatggccagctactttcagtggacacttgtgatggggtcattaaagatctatactaaatataatactggttagtggcagctcatggaaaggctcttgaattagctttagaggaaattacagtaagatgaggattgttttactgaggaaaaagattgaaaagccccaaatagtgtagcatatatcttcatcacgtactataaaattctattattacactgtttgttctcatcacaattcatatagatagtgaattaaattttcaatgggtacaagacagaaaaagcctcatgtgacatgttaggcctatttactagtatgatctttgcatgaggtttccattatatgtagggactctagcctgctctgtgctctccgtctcctccctatccacctattcatcatccttgctatcaggaagggggtctaatgttaatcatttgcatgtacagacttttaatacattgtataacaatcaatgtggcctttcttttggttgtatttttgcattagttttttttctgattgtaaagtgaaaatctctagcctcttaaaaggaattatcagcaccattagaagaagtagagtgatggttctattccagtccaatagctataacaatagtaatgataatagctgacatttatgtagcactatgggccaagcactttatatacatcatttcatttaatgctctcaacaatctataaggtagatataagtaatgtccacatcacatttcagatgaggaactagctccagtgcataatctgcctttaaaatttttacctaggagctaaagttattagatattacttcagcttcagtgggattcagactaaatagaagaaatattttaaatttcttctagcactactcaacctggaagtaatagcagctgtcatgacctatcactgtaatccattgtggtaggggtttagtaaaccctggatgaatggatggatggatgaatgggtagatggatgggtggatgggtggatgagtaaatgggtggatggatgatagataggtggatagattgttggatgggtgggtgggtggataggtgaatggatggatggatgggtggatgggtagatggatgatgaataggtggatagatggttggatgggtgggtgggtagataggtgaataaatggatggatggatgggtggctgtgttgctgggtagctgggtggatggatggatggatggatggatggatggatggatggatgagtggacaaatgggtggatggatgggtggatgggtgggtgagtggatgatggacccaatgtacaaatcccttgaacctttgatgacttggaacaccacctctgccctatttcaccaattgccataatgaaataaaatgctccaaatggaatctgttttggcacaaaacatgaaggaaactaactagcaactgatattatgggtccattgattcaataatactttattgccttacttatgtaaaattgatatcacttcctctttcgcctcatttttaattgcagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcag

SEQ ID NO: 37916 - DNA, 7299 bp, Homo sapiens
tcttgccttccggcccggcgcccgatttccgccttccgacccagctgtgggctgcgccccacgccagcccgcgccccgcatggctgccgccggggccaggcctgtggagctgggcttcgccgagtcggcgccggcgtggcgactgcgcagcgagcagttccccagcaaggtgggcgggcggccggcatggctgggcgcggccgggctgccggggccccaggccctggcctgcgagctgtgcggccgcccgctctccttcctgctgcaggtgtatgcgccgctgcctggccgcccggacgccttccaccgctgcatcttcctcttctgctgccgcgagcagccgtgctgtgccggcctgcgaggtgagccgccaaacggggtcgggacggggccatgcctccgacgcgtgcgcggcgttaattccgggagcgaccagggggacggcggcaagcaccgctgccgccccagcctcagagctccctctccgcgctgccccaggagcaccttctcccgggcccttccaggatgtgctcatttttgctacataagcttctaactgtgcccacgcgcattggtaacccccagcttttaatcagtgggtaccaggtatggtgttaattcagataatagaaattgtcttggaaagatggatcccagtagctttttcgtatttttggcagtcgttcttaacgatcagtcttattaatttgattaactcaaaccacctctaggaggcaactcagttgcgtgtaccggacgaaatctagtttctggattttaaaagcttattcctgaaagcaaaaactttcatttcttttttgttgttgttattttcagttttacgtgcagaggataaaatatgtgaattgctgttttgtttgaagataaaacttttctctgtattcttttttagtttttaggaatcaactacccaggaaaaacgatttttactcatatgagccaccttctgagaatcctcccccagaaacaggagaatcagtgtgtctccagcttaagtctggtgctcatctctgcagggtttgtggctgtttaggccccaaaacgtgctccagatgccacaaagcatattactgcagcaaggagcatcagaccctagactggagattgggacataagcaggcttgtgcacaaccaggtgggtaatcttttttttaagtctcagttcagtttcatcgcctttgtcaacccagatatttccaggacaactttaaaggtaaaattaggaaaggtatagtactttaaaatttttcatgcctggaacacctttgtaaaaaaaaaaaaaaggctgtgaagtctgaatcactgaataatgtcaccatataggcatttaatttatgaccctttatctaaaatgccagaactatagggaatatagtactttagagacagcaaattattagactgtcttcaaaactaaatgattactaatagtgctgtcctttttgtttcagatcatctggaccatataattccagaccacaacttcctttttccagaatttgaaattgtaatagaaacagaagatgagattatgcctgaggttgtggaaaaggaagattactcagagattatagggagcatgggtaagcagtttcaggacttcattcattaagtggttaaacataatacttggaagaaagggctccatgtgcctagaagagaggtactgagaggaagactcactttggaggctgtagcatacaattttcagatattgcctcaggtaaaaatatacttcctggactttgttttctgacacataagaggtgtgttctgctccctgtaaagacaagggtgggtatccagatggtcccatgagtagggctgcacaagatgctggaggcttggtaagttcctctgggtcgcagatcggtttctcgggtcgggatagtgtgagtgcctagcacagtgtcgggcacgcagaagggccccttaaaagtttctctttcatctggccagttttagatacacaattttgtcagtttacttacagtgcatactcttgggtagtacttgtgctgaccaagtatcttagaggcttattttattatagtagccaacatttatccagcacttaccttatataaagggctgtttgtgcatgagctcattaaaatcgtgacagcagaccaatgagtgagaaactgccccattttgaaggtgaggaaattgaggttctgggtataactttctttggtcacataatattaaattttacaatttgagccttgagccatacacaaaaccaccacaaaattagatttatagactcaaaatgaaaacatcagcttactggtttgtagttcataccagtcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttacttcagagtaatggaggtggaagtggcagagaaaggaaacactggacttgatagtgttgaaactgattaatgatatgtggcggttcattatagtatttccacttttctgtatgtccaaaattttctaaaataaaaggagaattgaatagaaaaatgcttcctggaggtagctgtgtcttacctgagacttggcaggaggcagtagggcctgagggaacagcatttacagtgtcctaacggttatactgaaactttccacgtatacttgatggaacatcaatctgaaggcatcctacacttcctccatcagacctgatggtgcaagtgaacaccatcagtgcctttccagtttcatcaaagcagttattttagcttctctgacccaaggtatatcagttctattttaacgtacattacaaagactaatggttatacttagagacacgggtctgttggggacagcagtggcttagggtggctgtaatcccaggaaggaatgtggagaaggaaatgaacatttttttttttgagacggagtctcactctgtcgcccaggctggagtgcaatgtcaccatctcggttcactgcagcctctgcctcccaggttcaagtgactctcctgcctcagcctcccgagtagctgggattacaggcacctaccaccacgtctggctaatttttatatttttagtagatacgggatttcaccatgttggccaggctggtcttgaactcctgacctcaggtgatctgcccgcctcggcctcccaaagtactgggattacaggcgtgagccactgctccaggccagaaatgaacacttgatgactgagtgagtgagcctaccagctgaggatactaatgataagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaattttttaactatgaaggtaggcacagactctgggcagaattctgcaattagagcagaggctcattcttagtcccttcacaatatattcataggattaagttgccaacattaggtagtaaaagcatcatctgggagatatattttgatgccctctgagtcagataaactgaaataatcactttgaggtgattgagaaggcattagtggcacactggtacagccaggtctgatgggggaactgtgacatgccttttgggtcagtgctacatcaagagtaggaacattcatggagtagatagcatgttaccattggcaacttataggtaaggtattgattatttgaacatgatcttcattgattttagattcttagatatggcagaggtattgcccccatctggatttctggtgaaaatattcctcaagaaaaggatattccagattgcccctgtggtgccaagagaatattggaattccaggtatgaccttaaataaggaccatttagtgtgtaatcaccatgattgtttttaaacattaaaaacttcaccaaggtaatttgtgcacatgggtcaacatggcagtatggaagggtaccctataatgaaaatcatcagtttcctgcctcaccttggggctagttccctggaaggaactgtcttgtttttttctgtttcctagttttcagacacggtctattgactgacttctgtgacaatgaggatatctacactgctctccacctccagtgtggttatgtcattattattagtgcctctgttaacttttgttattttaaataatgtataccttcctttcttgttctagtaattaaagtctttgactatatactttatgagaggagtctttactgtttaatcttggtttgtggatttgttagaaaaaatggatataagcattaaagataaatgtccttccctgcccaaaaggatttgttagcatcaaaatccatttgggtagggtggaaatgctcttgagctatggattcactaaccttaccaaagtcatagctaatattggtttgtttctttgggtaaaaaaggaattatgaggaccatacacaaaactctgcttggttcttagtgccaaagctctcaatgtccaaattgaggtgacaggatttgtataaagtgattccatatcaggtggctattctgcctattcactctttgagttagactacttctaagattcctctctggtctctataactacattgatagatgtcctttctgtattcattactagtaattagtgtttcttgagtcaagagtaacaacatctgcaatgatacaaagtaaaagttgcccaaatagaagcctcagcccttttgagtggcatattagtaatgaaaataattcattaacagccacttgtgaacttctttctcaaatggaaaagaccaaacagaaggtgagaggggctttgaagtcataaggaagttttagattgttaaacatgttaattgtataatgtctataatcctgctttgtagtatgaggattgaaagaccaagatccctataatcatcctggctgagaaggtctcgtgctccctgctgtgaagcagctttctaactgtgtgtcaccctcttctcaggtcatgcctcagctcctaaactacctgaaggctgacagactgggcaagagcattgactggggcatcctggctgtcttcacctgtgctgagagctgcagcttgggtactggctatacagaagaatttgtgtggaagcaggatgtaacagatacaccgtaaaggcatcttaaagccttgaaaaatgttaataatcttttataccttgcaattccatttctgggattttatcctaaggaaatacttataccaaaaatagaggtgcagagatgttgacagattgcttacacagtgtctacttattagtgaaacaaaagtgtccagtgacagggaattaaataaattttggtacatccaca

SEQ ID NO: 37917 - DNA, 15519 bp, Homo sapiens; identical to SEQ ID NO: 37385

SEQ ID NO: 37918 - DNA, 13875 bp, Homo sapiens; identical to SEQ ID NO: 37386

SEQ ID NO: 37919 - DNA, 125563 bp, Homo sapiens
ggacctcggcgatgacaacagcaacgacctgctgctcagctgcccgcacttccgcaatgagatcgggggcgagtgtgagcgcaacgtgagcttctcccgggcttccgtgggctccccgagcagcggcgagggccacctggcagagcccgccctgagcgcctaccgcaccaacgccagcatctcggtgttggaagttcccaaggagcagcagcggacgcagagtcggccccggcagtacagcatcgagcatgtggacctgggcgcccgctactaccaggattacttcgtgggcaaaggtgacggatggcgtgtgggtgggaaggttgggtgggccgaggcttgcctccgagacccccactactcattcattcactctgtgccaggccctgctctggcactgaggatgtggcgggaacagagacctcccttctggagggctgtgaggatccggtgagcagagccacccgggcctcagccctgtgtctgacacagcagcactccataaaccttgagctacaggacacagctctgcatttactcagcacatatggacttggggacagctcagtgccaggcactctctagagcctggggatgtagtatcaaccagcttaaaacaaatgttctgtcttcctagtacttataatgttttcatgggtaacacaaacatagaacaggataaatacgaaaaatacacaagggattgtaggctgctaaatgcagtggaaaagagtacagcagggaagaaggaaatggagtgtcggagggtgggggcagatcccagtgggggatggtcagagggggcctccgaggcaggtgcagtttgagtaccaagctgaagtcaccatgtgcaaattgcagacactgttcccagaacagagcagcgaatacaaaagtcttggaactgcccggcgcagtggctcacgcctgtaatcccagcactttgggaggctgaggcaggcggatcacttgaggtcaggagttcaagaccagcttggccaacatggtgaaaccgcatctctactaaaaatacaaaaaaattagccaggcatggtgacatgtggctgtaatcccagctacttgggaggctgaggtaggagaatcgcttgaacccaggaggcagatgttgcggtgggctgagatcatgccactgcactccagcctgggtgacagagtgagactctgtctcaaaaaaaaaaaaaaaaaaaaattgagaattgcttgtaactgctagtaacaggcttaaacaacatagaagggactctcctgtgaagaaatccagagttcagcagcccagggctggtatggtcagtcttaagcatcagtatggtcagccttagtgcatggcatgatcccccactgctccacaccaagatggctgctggagtgccaggcgtcacatctgtgtttccaggcagagaaaaagaggaaagggtaaggacaaaaaggcagacctcttgtcaagtcaacccccttatgcccttatgcctagtgtttcattattggaacgctaagcatgtgggagttatagcctactgctcaaggacattgccagggtctgaatttttacttgtggaaaaattcaaaaaattgcagcctccggcataaatgcgttaaagagctttctcagaagcccggtccaactacttgcacttagtggccacacctgtgtgcaaaagaggctgggaaacgcaggtttttagctagacaaagtttttcttttccaagaatagagggcttttcttaaaaaaaaaaaaaaaaaaaaaagacgaagtactagcagctagtaccccacagcagctaggtttttttttgttgtttttttctttttctttttttttttttttttttgaggcagtctcgctctgtcgcctcgcccaggctggagtacagtggcgcgatctcagctcactgcagcctctgcctcctgggttcacgcgattctcctgcctcagcctcctgagtagctgggattacaggcgctcgctatcatgcccagctaatttttgtagttttagtagagacagggtttctccatgttggccaggctggtctcgaactcctgacctcaggtgatccacccaccttggcctcccaaagagttgggattacaggcgtgagccaccatgcccagctcacagcaactagtttttaaaaatatttaaagtaatatccttgtcaaacataacaaatgtcagttaagtcatcccacaggacactggagctccaacttggagtcagacagccctcggtttggggtatctgttccatagctgatccacgtgatacgttttacccttcagactgtgtgacaaatgaagatgattatatcaatatcacatgcacaaacagaatgacacagagattgaaaagaaagggataaaaaagaagttccaggccgggcacggtggctcacgcttgtaatcccagcactttgggaggccaaggtgggtgatcacaaggtcaggagattgagaccatcctggctaacacggtgaaaccctgtctctactaaaaatacaaaaaattagccgggcatggtggtgggcgcctgtagtcccagctactcgggaggctgaggcaggagaatggcatgaacccgggaggcagagcttgcagtgagccgagatcgcgccactgcgctccagcctgggcaacagagtgagactccgtctcaaaaaaaaaaaaaaaaaaaagaagttccagacagttgcttacaaggaaaaagccaatgaggcaatgtcagtatcacatgaaatagatgtaaaggttgaaagcaccttttagaggaactaaggaggccatttcatgtttcttaaagttcgccaagaaattctggtagttgtgaaccttcgtatacctggcaacttggtttaggggtacctagatttaaaaaatggatcaggctggctgagcgcattggctcatgcctgtaatccccgcactttgggaggcccgaggcgggcagatcacgtggggtcaggagtttaagaccagcctggccagcatggtgagaccctgtctccactaaaaaatacaaaaattagctgggcgtggtggcgggtgcctgtaatcccagctacttgggaggctgaggccggagaatcgcttgaagctggaaggcagaggttgcagtgagccgagatcgcaccatcacaatccagcctgggcgacagagtgagactctgtcccctcaaccaaaacaaaacaaaaaaaaaacgctacggggagaagtagaaaaactcacaaccatagcgggagaagtgcacagattatctctctgaagttgacagaatctagtagctgaaaaataaggatttagaggatttagataacctaatgaaaacttgattttacactgtatatgtattaactttgtacctaaccaacaaagaacacattcttttcaacctacacgtacaaatacgtacatgaaaggaatgtggatcaaataaagatcaaataagattatacattaaaatacttagttctttgttaggcaggtaggaagtactcatcctggagctttaaaaaaaaaagccgttttctttttaaaaatttctttgtagccctgaaagctgttaaagaaaaaaacgttctggccaagcacaagggctccctgaaagtgtaattccaccactttcggaggccgaggtaggatgattacttgccccaggagttagagaccagcctgggcaacatagtgagacctcaaaaaaaggttaaaaatttagccaggtgtggtggtgcatgtctgtagtcccaactgttgtggaggctgagatgggaggatcgcttcagccctagaggcagaggttgcagtgagccatgattgcaccactgcactccagcctgagtgacacagcaataccctgtctcaaaaaacaaaaactcttcaataatatttgttaaagcacagtaaagaatgtattcagaaccatcacagcaggcatagggaccactgcagcggagtctggcagtagggaagagagattgggcttaactctgaatacagcgtagtcaagtaggaatttatagccaagaagcaaggtggggatcagtgcatggaagaaactattaagaagaaatgtcagaggtaaggaagattctggctaaaccaacctaatgttgctgatgacacgccaggatgatcagacatcacctttggatggtggaagatgaagagcttgatcaggtgttgaagatgtccagatattgaggataaggttggggggcagggttcttgctaaactgacttagcgcagggttctttgttaaaactggattttacaaggaggtgcacagatgggcctaggagaagattccaaagcctgactaaagtttggccaagcaaagaatctttgtcaaagctagtaaataagtcattggtcagtgtttattgagtgcctactatatgctaggattcgcaaggagctagatatgcattgatggaaaaagcaacaacccctgtagctgcttcaggaataagctggtatttgtgatctgtagagtacaatgtttattccattctctgatcagctggagattgttgaaccccctgcagatgctgttctgatcggggtcattaattaccacacagtattttgcccttagactagcctttgatttgccaagagcatctcatgagaaccagaaccatcagttaaacattcagtgtaccagtacaatttccggtggtgggtagatgctaactttgtggacttggatcaagacagaccgctggcggatacccacacaagcatgagatacttgggttatacatcaggaagaactatttgcctggaagggttataagatagtagcatgttttagaaaaaaagaggaggcagctgtcaggtagacgagggagcaggaggtgtgtcccatgcctggctaaagcctctgttaccctaagggaaaaaacagcagtgttggccgggcacggtggctcacgcctgtaatcccagcactttgggaggccgaggtgggcagatcacaaggtcaggagatcgggaccatcatggctaacatggtgaaaccccgtctctgctaaaaatataagaaattagccaggcgcggtggcgggcgcctgtagtcccagctactcgggaggctgaggcaggagaatggagtgaacccgggaggtggagcttgcagtgagccgagatcgcgccaatgccctccagtctggacaacagtctcaaaaagaaaaaaaaagaaaaaaagcagtgttgaagttacctaggtaaagaaacatggtgagataaaggtgatgcctaggggcccctatcgtggtccctgacaggcaccaacaactggggatggtcattgccaacactcatcatgtgcgtactatgtgcctggcacggtgctgaaggctgggtccacctttaactttacggctgaaaatgctatctagcgacttggctggggccagacatctattaaggggcagagcccaggtgtgaggaggctctctagaatctttcttaacagtttcacaagggctaatccgcagttaaaccaagtggaccatttgcaaacacgggattaatcgcagtgatgctgggttgatggcatgccatgcactgtactaagtgtttcatatttgtagcttcatttttgccttcacatccactctctgaattgtgggtggcatcaaggtcctgttttctcagatgagagcgctgaggctcagaaaagttctgtggcttggcaggtggtacagtaaggtgggcttttgcctcttacagtgtctccactgggggtgtctgtgaccaggcatgaggtttgcgtgaccagcatcccacagattgcacaggaccctgcctggtcgccctgtctgcaggcctgctgggcatcagggcccctccttcccagacagctgagcctgaactcgcctgctcttccttcttagaacatgccaattacttcggcgtggatgagaagctggggccagtggctgtgagcattaagcgggagaagctggaagaccacaaggagcacggacctcagtaccagtacaggatcatcttccggacccgcgaggtaggtcccatcactctcgttcttattaaagaaatcatagccactcacatctcgagccaggttctgggggcaaacgcttccccagcttcatctcatggaatcctcccaacaaccccgggagagcaatcctgttagtctctccatctcacagaggaagaaactaagacgcagaatttaaatgacttctggccaggcatggtggctcacgcctgtaatcccagcactttgggaagcttggcgggtggctcacttgagatcaagagttcaagaccagcctgaccaacatggcgaaaccccatctctaccaaaaatacaaattagccaggtgtggtagcacgcgcctgtaatcccagctattggggagactgagccaggtgaattgcttgaacctgagaggcagaggctgcagtgagctgagtttatgccactgcactccagcctgccagcctgggtgacagagtggtgagactgtgtctcaaaaaaaaaaaaaaaaaaagaaaaaaaaaattaaatgatttctataggatcagtgaaccagtagccagaccaagatttcagtccagggtgtctgacttcagagcccaacattacaaaacctgtttgcaagagattagctctaataagcataagaaataaaagggaaggtaagggatcattttaggaacatgaggtgtcctacgtaatggaaagaattaaggcaacaagcctcaggcaggacaggaactggggactctcaaccacaggtactgctgttatgccaatcagctcaaggtactcccaatgtgtcactttccattctgagtagagaagcccatggtcctggctggaagccttcccctggattaaatgtcaactgtagctagtgaggaaggcctgttggggcacccatgctctattaggactctaaattgtaagtgacagaaatctatttctaacttgcttaagtcagaaatagcattcattggttcatgtaactgcaaatctaggggtagggcaaacttccggcatagctggacttagagactcaaatgcagtctccagaactctgcttctttaactctctgcttggctctgctttttgcatcgcgagtgtcattttcttctgccactaacaagctctcaccatgtcatgggaacatggagatgggctgctcaaatctacttctttgcactgtctcttccaaaaggctcagactggccaggcgcagtggctcactcttgtaatcccagcactttgggaggccgaggcaggcaggtcacctgaggtcaggagttcgagaccagcctggccaacatggtaaaaccccgtctctactaaaaatacaaaaattagctgggcgtggtggcaggcacctgtaatcctagctactcaggaggctgagacaggagaattgcttgaacccgggaggcagaggttgcagtgagctgagatcgcgccattgtactccagcctaggtgacaaatgcaaaactccatctcaaaaaaaaaaaaaaaaaaggcttacactgatttatctgggaagaactctggctctgctttagatcacaagcccaagtcctgagccagtcgctgtgatcaggggtggtagaggaaactgcccggtctagcatgtgttacccaccttgggtccaggggcagggccaggcactgtgattgacagttccaccagagctccctggaggaggaggcagggcagatcctcagcaaaaagaggggacccagggaagcagaaatgacagagaggcccagaagacccaaataaggaagacctttcagaaaagtggcatttgccagctaggcaggccctccaaaatgggtctccctcagcctgcattgccccagccccttgggcctggcctttgcccagacatggacgcctagcaggctgaggctgccaaggacttgactgtggggccagccaagtcctggacctcatccaggctggcagatgcagctcggagtgccctcgccccatcccctgaccaagaccttcccactgagttgggggaatgggatggcatggaggctttgcagtagccaggaagaggcagccctaaagccatgtgcgccaaaccacaggtggtcaccagcctctgtctccccagccctctcctccctctacccacctttctggccagatgagcaccagagcagaatgagaggtgacagctcacactgcatctggctgttttaggacatatgggcaactgctgggtggtgaaatgacgcctacagtcatatacttataaataggctgggtgcagcggctcacacctgtaatcccagcactttgggaggccaaggcaggtgggtcccttgagccctggagttcgagaccagcctggccaatatggtaaaaccctgtctgtactaaaaacacaaaaattagctgggtatattagtgcacacttgtagtcttagctgctcgggaggctgaggcatgagaatctcttgaacccaggaggtagaggttgtagtgagccaagatcacaccactggactccagcctgggtgacacagtgagactcggtctcaaaaatatatacatacacatatgtatatataaaatatttattatgaaggctattattactgcaaatctcctttatactgtgtgtcaggcaatattctataccttttatatctattaactcacttaaatctcatcacgattctagggtgaagaccctgttgtcctcatttacagatgacagaacaggcacagagaggttaagagacttgcccaaagcaccctccagggagtggcagggcagggtgcctgcctgtgttctggccgccgcactcggctgcctctgggttttgactaagtcagcttagactgcacactggacccactcatgagttaggagctcaaccaactcagtgctagcgtttgtgtttttgttcgtaatgaaaatacaataggcggggcgtggaggctcacgtctgtaatcccagcactttgggaggctgaggcgggtggatcacccgaggtcaggagttcgagaccagactggccaacatggcgaaaccctgtctctactacaaatacaaaaaaaaaaattagctaggcatggtagcaggtgactataatcccagcttctcaggaggctgaggcaggagaatcgcttgaacctgagaggtggaggttgcagtgagccaagatcattccattgcactccaggctgggtgacacagtgagactccatctcaaaaaaaaaaaaaaaagaaaatacaatatataggcaggcatggtggctcacacttgtaatcccagcattttggggtaagaggttaagacggaaggattgcttgaagcctggagttcaagaccagcctaggcaccatagtgatacccgtgtctctaaaaaataaaaaataccagactatagcattaggagaaatacctaatgtaaatgacaagttaatgggtgcagcaaaccaacatggcacatgtaatacctatggaacaaacctgcacgttgtgcacatgtaccctagaacttaaagtataatattaaaaaaaaaaaaacccagactatgtcacacatactgagagtcgtgagactttagtgcatggatactgggttatataattttttgctgtgatttcctgttcactaagtttgaaactggcttgatgccattcccagtgtgtacctgctcccgtccacttcccacccccagcacctacaaaactagccgtgggggactctgatccatccctgatgacagcacggggactctttgagtctcacagccacaggcctgggatccatccattccacagacatttgctcagcgttcccccgtcccagctctatgctgggcatggagggtaccgtagcaaacaaggcagcaaagatgctcgtgagactgggtgtttgagggggagacaaaaggacgcagaacaccttagcaaattatgctgtaggtgcttcccatggtgacaaggtgggggacaaagcaaggaggaatgatgagtgtggcaggtgcttagattttttttttttttttttttttcccgagacggagtctagctttgttccccaggctggagggcagtggcgtgatctctgctcaccacaagctccgcctcccaggttcacgccattctcctgcctcagcctcctgagtagctgggactacaggctcccactaccacaccctgctaattttttgtatttttagtagagacggggtttcactgtgttaggcaggatggtctcaatctcctgacctggtgatctacccgcctcagcctcccaaagtgccgggattacaggcatgagccaccacacctggcccaggtgcttagatttttaacaggaaggtcaagggaggcatcactgggaaggtaacactggagtaaacctagaggaggggagagggagccgtgtggacaactggaagaagagcattccaggcagagcgaacagccagtgcagaggtcctgaggcggagccatgctccgtgggttggagacgtcctgtgagtcctagtttgaccactcagcagttctagaaccttgggcacatggctcctttcctctcagagcctcagtttcccccttggaaattctcagcttacagaactgtgttgtgggctcggtgaggttgcacataccaagcaggcagtgggggacctgacacttgactggaagtgattatgatcggcaccactgttgcagccgatgttccttcccaggaggtcagagccccatgctgggaagcataggttgagctcacggatggggttctgtccttctcatatccacacacacacatgccttggggtcctgtaaaccagggcataggggccagagcgagaggtctgggctgccttccaagccagccagcctgccccagatggccgtccccagccgccaagcagacagtctcgagtggacctgcatctcccagcagatgggatatgagcattggcagtgccaggctccccaccaaggcaggaacagacttggagctgggctttggcactgcttgtccaaaccccagagagcctggacagggtgagcgccaggccagggctgccctgtctcaggtccctttggcactgtctcacccaggacactggggacagagtggggatggcaaccagccaggaactgtgtggcacccccccacaaggcccagtggttctcattggcctagaacacgtgatttttgacaggctttagttctgatagggttagagatttgggtttttattttattggtttttcttttttatttaaaaagtaccaaacgctcattattaagaacttagacaatacataagtatgcaaagtagaaaaaggaaagtttcattagtgaaaaaagcaagtgtgaccccgtttttgttcaataggtacatctgactgtgtgtgtgtctgtgtgtatttgcttatttatttttgagacaaggtcttactctgtcccctgggctgaagtgcaatggtgcagtcatagctcactgcagcctcgaattcccgggctcaagcgatcctcctgcctcagcctcccaagtagctgagaccacaggcatgcaccaccatgcctggctaataattttgttttatttttagagacagaatctcactatgttgcccaggctggtcttgaactcctgagctcaggtgaccctcctcctttggcttcccaaaatgccgagattacaggcatgagccactgcacctggctgtgtgtatgtttaaatgaacaatctccaaagcatattgttaagtagggggaaaagcaaaaaaatgtagcttcctgcttaaggttaaaaaatttaaaactcagctaggtgcagtggctcacacctgtaatcccagcactttgggaagctgaggcgggaagattgcttgagcccaggaatttgagaccaacctggacaacgtagcgagaccccatctctattaaaaataaattaattgccaggcgtggtagctcacgcctgtaatcccagcacttttggaggcctacgcaggtggatcacctgaggtcaggggttcgagaccagcctggtcaacatggcaaaactccatctctactaaaaatacaaaaattagctgggcatggtggcacacacctgtaatcccagctacctgtaatcccaggaggctgaggcaggagaatcacttgaacccaggaggcagaggttgcagtgagccaaaatcacaccattgcattccagcctgggcgacaagagcgaaactctgtctccaaaaacaaaataaataaaaaagaaataatatttttaaaactattaactatgcatgtggctttgtacataaacatttaacacacatctacagataataatggttaacacacattgagctctcactctgtacccaagatacagcactaagcattatgcacggatctttttgaatcctttcattgccttgaggcaggcatttttatccccattttatcaatgaggaaatagggaaattaagcgacttgcccagagtcacacagctagggaggagctagagctagaattcaaacccaggcagaccacctcctaagtaacctcctaggaaatgttcttgaagggtacacctgccgcccagcacagagtcaagcggggagtacgtctgagtcaggagtgagtggggataacctgtaccagctggaacctccttgtttgcatggtactgtgtgcctttcacagctcacttgatttgttgccctcgactagctgatgccagatgttttcaggctctgagcagaggaaggctgtgatctgactcaggcagctgtagaaagaatggactggggacagggcaggggcagggagacctggaggaggctgctgtccaggtgggaggtgatggtgggggtgaccaggtggagagtgaggtggccactcatgacctgccagtgtcccacttactgtcgccagtgctgaaggagtttttcaagtagtgcgcgccgatgaggtggtcagagccaaaatgtgactgtaagtcacccgtctccagggaggaagaaggaagatttctggtccgtgctgtccctcgttcccagcagagggcactgtgggacagtgtcagtaggatataaagacactgatcctgttggtcttaactgaaacccacaaccccagggccacccagattgacagggcaaagcccccaacatcattgcttttcatgattggttttgacactaccgtgcttgtgataagagagatttgtttgtttgttaattaccggggccagaagtgggatcattctattccttccacacatgcctctcgcccaggtgctctttggtgagggtgggttgtgtgcttagaggcgaagtcatgacatgttatttttgccacctcctgtgtttgtcgacttaggcaagcatgtttttgcagttaatacttatcctccttagtctttttgttgttgttgttgagatggagtctcactctgtcgcctaggctggagtgcagtggcacaatcttggctcactgcaacctccgcctcctgggttcaagtgattctcctgcctcagcctcctgagtaactgggattagaggcatgagccatcatgcctggctaatttttctattttagtagagacagggtttcaccacgttggccaggctggtctcgaactcctgacctaaagtgatccgcccacctcgacctctcaaagtgctgggattagaggtgtgagccaccgcacctggcctcctccttagtctttaaaccacagccccaagtgtactttgggtgcttgtaacaagccccctggagagggatttttctttgtgcgttcttggtgtggtgctggtccagtgcatggcataacctggtggccagcagcatgctgtggctacaagcatgagctggtattagtgaggatgtggagcagcaggggctctcagacagggctggtggggtgtaaattggtacaaccacttggaaaactgtttggcagttcagtaaaattgaagattagcatgcctggtgatttagcaatttctatcctaggcataaacccaaaagaaaaggtgttcgtgtgcactgaggtgcttctgtgagggttcataacagcactattcacagttggcaaatactggaagcagttctggtgctcatcaacagtgaaaaggagtaaaacgtcagcctctcgcaacagcatagctgcagctcatatatgtagcattcagagaaagaagctagataacaaaagaatacaaactgcctggctgggcgcagtggctcacacctgtaatcctggcacttcaggaggccgaggcaggaggatcacttgagcctaggagttgcagaccagcctgggcaacatagtgggactctgtctctacaaaaaatatacaaaattagccaggcatggtggcacatgcctatagtcccagctgctcaggaggctgaggcaggggatctcttgcgcccaggaggtcgaggctgcagtgaaccatgattgtgccactccattccagcctgggcaacagagttagaccctgtcttcaaaagaaaaaaagaataaaaaaatacaaactgcctgaagttcaaaaatagacagatataaatgatggtgttgaaagtcaggatagagttaattttgaggaaaaaggggtacaaatgggctgtgggtgctggaaatacatttcttgatttggatagtgattacccaggtatttgctttctgatactttctttggcctcacatctatgtgttatgtactttttttttagacggagtttcactcttgttgcccaggctggagtgcaatggcacgatctcagctcattgcaacctcctcctcctgggttcaagcgattcttctgcctcagcctcccaagtagctgggattacaggcatgcgccaccacgcccggctaatttttgtatttttagtagagacagggtttcacccatgttggtcaagctggtctcaaactcctgacctcaggtgatctgcccacctcggcctctcaaagtgctgggattacaggtgtgagccactgtgtctggcctgtatactttatatatttggatatacctcaccatacacataccaaatatatatatctcaaaacaaaccacgagcttcggagaagtcaggactgggttggaatcttggttgccattttgtcagctgtggtgaccttggataaggcacgtaacctcttggaacttcaatttgcttctctgtaaatcagagataaaacctcccttgaatagacctatacatacagttattactatagtacctggagcacagtgcagtgaactgcaccttcataaatgtgacttgttattaaggtatataagttagacatttatttggctgcaaagcgatagaaaacctgactaccagtagctaaaacaaagggaggttactttaatcatctaataagtctggacgtaggcagctgcaaggattaacttctgtgactttttgttgtctctttcctcatgattgcaatctggctgccacagctccaaacatttcattctcataccactgcccatcacacaaagaagtgggcaggtggaaaggggctttcattttttttttttttttttttttgagacagtctcgctctgtcacccgggctggagtgcaatggcacaatcttggctcactgcaacctccgcctcccaggttcaagcaattctcctgccacagcctcctgagtagctgagattacaggcatgcaccaccaggcccagctaatttttgtatttttaatggagacagggttttgccatgttggccaggctggtctcaaactcctgacctcaagtggtccgcccgcctcggcctcccaaagggggctttccttttattagagggaaatctgccccagaagtcctcaccaagcacaattctcctcatatctcattgcctggaattgatcacatggttgcctataggaaaaacttgggaagcaacatctggggaatgggaatgagatggctgtgattggctttgactaaaggttttcatccctgactgcacatcagaagcacctgagaaggattaaaaatatgccatgtatgcaaacatgcatgtctggccccatcccagaccaaccaaattagaatcactggtggtgtcttgtcttgtcttgtccttttcttttcttttcccttctcttctcttctctctttcctaccctccctcctttcttttcttctcttctcttcttcttttcttttcttttctcagactgagtgttgctctgttgcccagactggagtgcagtggcgcgatcttggctcactgcaacctccgcctcctgggttcaagtgattcttctgcctcagcctcccaagtagctgggattacaggtgcatgccaccatgcctggctaatttttatatttttagtagagatggggtttcaccatgttggccagggtggtcttgaactcctgacctcaagtgatccgcccaccttggcctccccaaagtgctggggttacaggtgtgagccacccacgcctggcctttttttttttttttaaatgaaactggtctgaaaccagtgccacagttcaagatccaagatgatgccagtattcaaggcaggtgggtgttttacttgagcatttacagtaatgtgtacataatacagtgttactgtaataatgacaagagcccacctcctggtaggacctgttttcttcattatactccctactgccttacataattcatctcccccattccagtgtcagctccacaaggacaagggtctttgttcattgcacctagagtaggactcagtgcctcacaggaggcactcagccagtatatgttgaacaaatgaaggtagtttacattattgtctcatttaatcctcccaacaccccttcaaggttacgataccatcctgtacccatttcacaaaagagcaagctgaggctcagagatatgaagtcacttggtcaagaccgcacagccaggaggcagcaggttcaagttctggctcagacttagggctttctgaccttagagcacaaacttccaatcatcacacatgtctctttcaaaacaagatacctctgctatgctcttatccctttttaggtctcgagagccccctaaccttcccttctctcccttgagtagctcatcaccctgcggggctccatcctggaagatgctacgcccacagccaccaagcatgggaccgggcggggcctgcccttgaaggatgccctggagtatgtcatccccgagctcaacatccactgcctgcggctggccctcaacacccccaaggtgacggagcaactgctgaagctcgatgagcaaggggtgagtcaggggctggaggtgggggtgctgctggggcagtaccttgcaaccccactcctggtagctttttctatcttggtcactttcttttttctttgcaagtaacagaaacctacttaagctggtttcagcaaaaggagggattcaaatcaaattctagtggtgccaagagcaagaatgtaactgggtctcctaaaggagggagattgtctgggggtgagatagctgctaggtccccatgtgtgcatgcatatatgtgtctatagtggggggttagtgtgtctttcctccccgctccacatgctggctccctctgcttctcttgcctctcccacagctcccagtctgttagaattacagccacatgcagaccccagcaggctgaccctggtcacaggagagccatcgattgggctatggcgtaggtcaggtggctgtccatggcccagtcaccagtgaccagggggatccgggatacctaaagcaaacatagttattgggagcccactccctaaaaaaggtattgactataagccttgagccctccagattttgcttttgcagaatctcagcccatcccagtccacctactgtgggatgccggccaaggcaacagtctctttcatgcaagtgtggcatcaccagccgtcctccacccgccatagcgagaagaggcggcctggatacctcgttgtgcttctctggagtggaagggagggggagggacaactgggacatgctgccatgccccaacactgttttcccctgtctggctatggctctgggttcccgagtggtcccagcagctcccagggcctcaggcctcagacataccccttgctcccttccctctgccatctctgcctggcctgcctccacaaagccactcttgcctctgcagctctgccggaagcacaaggtgggcatcctctattgcaaggccggccagagctccgaggaggagatgtacaacaatgaggaggccggccccgcctttgaggagttcctctccctcatcggcgagaaggtctgcctgaagggcttcaccaagtacgctgcccagctggacgtcaagagtaagtagggggccggttagatcacagtgagccaccactgcactcctactcaacaggcaaagcttaaaaggcctggggatgccacggtggggacgtggagcagtgggagctctcagacttcacttgtaggagcacaaataagtgcagccactttattttttcgtgttgttgtacttgttgttgttgttgttgttgtttttgagacagagtctcactctgtggcccaggctggagtgcagtggcatgatcccatctcactgcaacctctacctcccaggttcaagcaagattctcctgcctcagcctcccaactagctgtgactacaggtgtgcaccaccacacttggctaatttttgtatttttagtagagacaggctttcaccgtgttggccagactggtctcgaactcctgacctcaagtgatccacccacctcagcctctcaaagtgttgggattacaggcatgagccaccacgcctggccatgtgcagccactttggaaaacagtacagcacattcaagtccagtttgaagagacgctgctctgtgactcagctcctgcactcctaggtatgcactctgtctaatgtgcacgtgcatggcaggagaggactgaatatccctaaccaccggcacctcggtgcacccagtgcacactggcagagttgcgccgtgttcacccagaggagatgaactggcaccacaggcatcagcgtggaagagagccacatgcttcgtgctgcgcaaagacagcaagcctcagaagagtgggacctgaatgatgtcttttacataacaatttttttcttttcttttcttttctttttttttttttttttgaaacagtctgcctctattgcctaggctggagtgcagtggcgcaatctcagctcactgcaacctccgcctcctaggttcaaggagttctcctgcctcagcgtcccaagtaactgggattacaggcatgagccatcactccctgctagtttttgtatttttagtagagatggggatttactatattggccaggttggtcttgaactgctgacctcgtgatctgcccacctcggcctcccaaagtgctgagattacaggcgtgagccaccacacctggccaattattattttttatagagacaaggtcttgctatgttacccagactggtctcaaacacaaggcctccagggatccttggcctcccaaagtgctggaactacacacatgagccactacacctggcaaaaaggtccagcaggatgactcacacctgtaatcccaacattttgggaggccaaggaaggaggattgctttaggccaggtgttcaagaccagcttgggcaaaaaagcaagaccctgtctctgaaaaaaaaaaaaaaaaaaaagcaaaaacaaaaacccagcaatatattgttggtggatatgctcttacacagtggaactctaaagaaaaacagagccaagcgtggtggctcatgcctgtgatcccagcactttgggaggctgaggcgggtggattgcttgagcctgggagtttgagactgcagtgagctatgatcatgccactacactccagcccggatgacaaagcaaggccccatctcaagaataaataggccgggcatggtggctcatgcctgtaatcccagcactttgtgaggccgaggcgggtggatcacctgaggtcaggagttcgagaccagcctggccaaaatggtgaaaccccatctctactaaaaatacaaaaaaattagctgggcgtggtggttcacgcctataatcccagctacttgggaggctgaggcgaatcgcttgaacccgggaggcagaggttgcagtgagccaagaccgcaccattgcactccagcctgggcaacagagcaagactccgtctcaatcaatcagtagaaaaaaaaaaaaaacaagggaatactggagacaatatgcaggatagtggttggctgtctggggagaggtgggtgtgtctaggaaacggtgctcacgttagagtgtgggtagtggtctttttcttaaggtggtatcacataggacgtatttgttgcagcagtctctgtgcttatcatgtgtatgtgtacataaatatatatgatatatggggctgggcgcaatggcccacgcctgtaatctcaacactttgggaggctgaggcaggtggatcacctgagggcaggagttcgagaccagcctggccaacgtagtgaaaccccgtctctactaaaaatacaaaaatgtaaccaggtgtggtggcacatgcctgtaatctcagctacttgggaagctgaggcaggagaattgcttgagcctgggaggcagaggttgcagtgagctgagatcacaccactgtactcgagcctgggcaacaagagcaaaacttcatctcaaaaaaaaaaaaggggccgggcgcggtggttcacgcctgtaatcttagcacttgggaggccaaggtgggcggatcatgaggtcaggagatcgagaccatcctggctaacagggtgaaacaccgtctctactaaaatacaggcgagcgcctgtagtcccagctactctggaggctgaggcaggagaatggcgtgaacccgcaaggtggagcttgcaatgagccgagatcgcaccaccgcactccagcctgggcgatacagcgagactccatatcaaaaaaaaaaaaaaaaaaaaggaaagaaaaaaatatatatatgtatatgatatataggattgaaatgtttcatgagaagtagctgggtgggtggatgggtaatgttcacaggtgtcacagctccctggggaatggactaccactgtccttgggagtgggttttcgtcagctgggagtgagaaggccccaagatggctcagtcagacattgctcttccccacacctcgccaagactcggtttgctcttctagaaaacaaaacagaagcccagatcaggagacaaatcttagagagagaagtgaggtgttaggcaggtgtctggggccatcatcaccttcccctgctcctccgctgaaggaggctgtaggaggaacgagcatgttattatgccatttgctagtttcgtgatcttggacaggtggctttgcctctctcgacctcagtttcctcatctgtagagtgaaggtaataattgcgcttatcttggaagcatggtgagggttccgtgggtcagctttgccccaaacatcctgagccctccctctgtgccgagtgcttcccagagctccgccagcgtgggtgtccccctaggtgggcggggaggcagcaggcctccctgggctcacctggcgtggaggaagctggcaggtgtgagtgttagtattggtttttttgtttttttgtttttttgagacagtctcgctctgtcacccaggctggagtgcattagaacgatcttggctcactgcaaccttcacctcctggtttcaagggactctcccacctcagcctcctgaatagctaggattacaagcacgtgccaccagacccaactaattgtgtacttttagtagagatggggtttcaccgtgttggccaagctggtcttgaactcctgacctcaggtgatccacccacctcggcctcccaaagtgctaggattacaggtgtgagccaccgcgcctggccaggaagtgggttctcttagaggaccccaggaagcatagtgctcctggaatgagtttccccaaattacaggcaagaatggccctggcttgagcagatacctgggtgttacccggctcccaacctggctctggcactggcagctgtggcctcagtgtccccgccagacactgaggcagcattgaatattattaagaacagatctggaggccaggcacagtggctcacgcctgtaatcccagcactttgggaggctgaggcaggtggatcacctgaggtcaggggttcaaccagcctgggcaatgtggtgaaaccccatctctactaaaaatactaaaattactaaaattatccaggcatggtggcaggcacctgtaatcccagctactcaggaggctgaagcaggagaattgcttgaacccaggaggcagaggttgcagagagcccacattgcgccattgctctccagcctaggtgacagagtgaaactctgtctcaaaaaaaaaaaaaagaacagatctggaatccaacagcctgagtactggtccagacgctaccactcagtacagtgtgaccttgggaaggcactccctctccatgcctcagtttcccactctgaaacatgggctcagtaagcaggtttgcctcttcctagccataaccctccctcctattagagagaactcatatcctgatgctcaatgataaccatttctttgcttttcttcatagttttgctacttacctacacatccctgactggtataatctgacctgcttttgcatgtcacatgaatgggatcacactgtgtgtgctgctttgtgtcagcatctttcactcaacatttagaggatttccccatgctgcagccgcgactcattccttttcctggctgtatatttttccacagtgtgaattgaccagtgtgttcacccattcttttgactgacgcttgaagattcttgtacccatatcccaggacacgtgtgcatgatttctctgggctgtggtccaaggaaaggaagtgccaggttatcaattaagcctatcttcaggtataagagagattgctaaaaagttttccaaagtgcttgtaccaagttacacacctaaccagccacctcaagggttccatttgctccacatcctcgccaaccattggtgctgtcagactttttaatttttaccagtctggtgggtacatagcaatggggtttcctttttatctaaatgtatttaattttttttttttttttgagacagagtctaaccctgtctcccaggctggagtgcagtggcgtgatctcggctcgctgcaacctccgcctcccgggttcaagcgattctcctgcctcagcctcccgagtagctgggactacaggcacccgccaccaggcctggctaatttttgtgcttttagtagagacggggtttcaccatgttggccaggctggtctcgaactcctgacctcagatgatccacctgcctcagcctcccaaagtgctgggattataggtgtgaaccaccaggcctggccagtgtatttaatttttaagagtagattgaagtgaaagcaccaagttaaaaaccagcacagatggtacgtgggatatggcaaaaacccagaggttttggaaacatggtcctaactggcatttctgtttcagccgactccacgggaacccactccctctacacgatgtaccaggactacgagatcatgttccatgtctccaccctgctcccttacacccccaacaacaggcagcaggtcagtgattttcagcagaggcacggctgccggatgttggctgcccacccaccagcattggccctcccagttctgtcctgtggatcatatggaggcccttgaccttggaggccatctttactatggtcactttccctgggggttagagagcagcccaggtgtggttcgagatgtcactttggccccagtctttcctgctgcttcttgggcgccctgcccagccccagctagcccgacgcccctccagggcctcttgagtcatcactggtcttaagaagaagagtgaatcagtcaacattattttgactgcaagtaacagaaactcacaccaaactggcttaactagaaaaagagatttatgggttatataactctaagattgtagagagggctggcctcaggtctggttggatccagggactccaacaatattaggaatccttccccatttctcacctccacttttctttacagcagctttattcacaggtgcaaagcaaagatacctcctagcagccctaggctcacatccaccagcttagccacctcagcagaaagagtgctgttttttccagttgtcccagaagtgtttcagagctgagtctcattggactattcacatgccagtcttggggcctggggtaggggtggaaagggcagactggccaagcccgaggctcatgcccaaccctagagagggtgagtggtgccagctcaacttgaaacggatggaggttggggaggtgctttcctgaactgggtgggtgtggctgccagcaggaggcagggataccaggtgggcagcgccaccaaacactcattgccaagaggctgcagctgtgacccggctcctctcttggacccaccttgcaggctgggcccacagagcaattcttccagttcctaatgaacagaagccccagagtgctgacagtttaggaagtaagtgtacgtattttcccagttggcacaagtgactttgtaggccaaaaatgctcaaatattgatttcctaaggttcatctaaaaacatgctattaagagctttggtcttaggccaggcttggtggctcatgcctgtgatcccagcactttgggaggctgaggcaggcggatcacctgaggtcgggagtttgagaccagccaggccaatatggtgaaaccccatctttactaaaaatacaaaaattagctaggcatggtggcgtgtgcctatagtcccagctactcaggaagctgaggcatgagaattgcttgaacccaagaggcagtggttgcagtgagctgagatcatgccattgcactccagcctgggcaacagagcaagactctgtctcaaaagagaaaaaaaagcaaaaaaaaaaagcgctttgatctcagaattagacctgaatttgagttctttcttggctacttcctagctgtgtgatctcaggtaagtgatctcacctctctgggccttgagtccctgctgtgtaaaatgggtataatcgtagtgcccctgaatcagggtcattgagaaaggtccatatactcctgcggcaaccggagcgtgacagggcccgacacacaggaggggcgcagagagcagtgccttttcctgagtatgtgggaggggcgctggggaaaagcttgagtcgtagagttaagaagtgggttagaatccaggctctttccctccatcactatgtgacttaggtaaaattacttaacctctgtgagcctaagttttctcatctgtaaaatggggcaaaatgagttaacgcctctcggggttgttaagagattcattgagatgatgaattgaagataaggctgtgcagtgtttagtacaggaccagccacagtcaatagctgctttagcgatttgatttaatgccacttaaaactcacataaagaactaaccattcaacagtaggagttgagctgcaaagcgtgtctggagttcacactgtgagccatgtcacttagagctccgtgggactcccgtccatggatctcctgcattggcagattctttaacagctacatgaatgctagaactgtgtaaataagaacaatataataggctgggcttggtggctcacacctgtaatcccagcactttgggaggctgaggcggagagatcacctgaggtcaggagttcgaggccatcctgaccaacatggagaaaccctgtctctactaaaaatacaaaattaactgggcgtggtggcgcatgcctgtaatcccagctactcaggaggctgaggcaggagaatcacttgaacccaggaggtgcaggttgcagtgagccgagatcgcaccattgcactccagcctgggcaacaagagtgaaactcagtctccaaaaaaaaaagaaaaaagaaaaagaacaatataatctcagcaaataagccaaacactgtgaatacggcgtcacctgtgaagataacagagtcttcctcggagactgaccagcaggggagaggtgtattagtccattttcacactgctaatgaagatttacccaagactgggtagtttataaagaaaaagaggttaaatggactcacagctccacatggctggggaggcctcacagtcatggcagaaggcaaagaagaaccaaaatcacatcttccatggtggcaggcaagagagcttgtgcaggggaaccacacttttataaaaccatcagatctcgtgaaacttatttactatcacgagaacagcatggaaaagacccacccctatgattcagttacctcccaccaggtccttcccacgacatgtgggaattatgggagctgcaattcaagatgaattgtagggtgtggacacagccaaaccatatcagagggtgagagtcccatagggcactcggaagccacagccatcctgacctcagtcagggtccagggaaggggtggcgcctataactggccctgccagtgacctgggatctgactctgccattgtccatgggtgtggctttgagcaagttgaagaccaccagcctgtgctctctggatcttacttattgagtacctcctgtatgccaggcactgtgctgggtactgaggatacagcagttggccgtgaacaaaatccctgttctcatggagctgccacttcaatgggaagagacaagaaacaaaatgaagtggggaaagccatctctgctgagtgtcaataagtgttaagtaatggggacagaaaagcaaagatcagggagtgttgtggtggggtggatctgaataacgtagtcagcaaaggcctccctgggagggtgaggtttatgcaagaccagaagaggtgacgaaggaagccatgtggggactcaggaagaatgttcctagcagagggaacagcggtgcagaggcttcgaggaagtgtttctggccatggtgaggcctttgtcctttatcctgaatgagagggaaccacaggaaggtttgtcacctgactcgggcattccttgggctgtgtgtgagcagggagtgggaatgggggtgggtggggggagctgtggcagtggtccaggcaggacccgtcaggccgacctgtgacaggttcctgtccccctctgttgccctttcccagctgctacggaagaggcacataggaaatgacatcgtgacgatcatcttccaggagcctggcgcgctaccgttcacccccaagaacatccgctcccacttccagcacgtcttcatcattgtccgagtccacaacccctgcactgataacgtctgttacaggtatgccccccacacccggcccccagcagcgtatggagagaggggcaggcagctggcccaagtgggtcccagtacagggcccccccacacctcacgttgtgcttcaggagaagagctcggcgtatactccccacaccatctcagagagtggtttttagccagaaaggggcatggctccccacttttgctaaggaaaccatcagggatttgtatttgcttgtaatcttttgtttcaagtgacagaaaacccatgtcaatgtggcttaagacaaaaagacagttgtgtatataggctctcaaaagtggcacctttaggcctggctggatctgccaccgccctcctgggggtcacctttccagcaggtctgaggtgaacatcctaccagctgcaaatcccccaaaatgagagcttttctttcccaagagttgcatcagaagccccagaattggggctcactggcccagttggagtcgtgtgcctgtcctagagccaaaatcaccagccaggcctgggcactgggcttcaaggaccaagaggcacgagtgatggcccagaggaaagtcggagggaagcagggcctacctgtggaggtaggccccactttggaggtagaattgaggaggtttttgttgttttgggtttttttttttttttttaagacagggtctcactctgtcacccaggctggaatgcagtggtgcagtcatagctcactgcagccttgacccccccgggctcaaacgatcctcctgcctcagcctcctgagtagctggaactacaggtgcacacccccatgcctggctaattaaaaaaaaatttttttttagtagagatggggtctctctgttttacccaggctggtcttgaactcttggcctcaagtgatcttccagcctcagcctcccaaagtgctgggattgtaagtgtgagccaccgcacacagctgagatcttttcgtacctgtacatgaagtgctttttgttctttctgatacttcatattccattgtatggatgtggagtcatctcctgtcctctactgatgggtattacggttgtgatgcctgcaatgaacagtcttatttatagtctgattgcgcctgagtccaagcatacagctgtaaaagaaattctagaaatggaggtgctggagcagaggacgtgtgtatgtgcaccagtagtcaccgcgaaattaccgcgggtctaccagctgcctccctcggctgggtgagggaagggaggggcatcccagcctgcagcgctggttgtctagcacctctgtgctgcacatgttgcccgctggctactgggagccagcacactgcatggcagggcctccttacaggcatgtccctggacctgaggccacctctccccctgcccatcggttcctggaacatgcagcagcagctacagagtgcctgcacctcaggccctttttggggttgaggacccttggatgagatgggagatatttacacacatgcacacgcacacgtgcacaggcacatgcacacacacacatgcatgcacgcatccgtgcacacatgcacatgcacacacatacatgcacacacgtacatgcacacacatgcacacaggcacacacctgcacacaggcacacacatgcacacacacgtatgcacacaccatgcgtccacacatgcacacacacgtatgcacacaccatgcgtccgcacatgcacacacctacatgcacacacatacatgcacacacatacaggtacacacctgcacacaggcacatgcatccacacacatgcacatgcacacacatacatgcactcacacaggcacgcataaacacatgcacataacacatgcacacacctgcactcacacaggcacacacaagcacatgcacatatgcacacacatatgcacacatacatgcacacgcacacatacacacatgcacacactggaaaaggaggcagccttcttatgatgcatcagaggtggagggttgagctggtggggggagctgctttctcttcttcgtccccactctgacctcccctctcctactggggtcatcacatcagcctgcagctgacctccctcccttccgggctcgcctctgcatggtctccagagtgatttcttctctctcacacacaaacctttcttgttttttataatttaatttaaaatatttttattatgcaatattttaaccattctgaaaaatgcagaaaatcatttaacagagacccatgtgcccaccgccagctttaacagatgttaacattttgctttgtttgcttcggctctccctctttccttcatttttaaagaaagaaaatgttagagatacaaccaaagctgctcctcagccatccccctcccttcccatccctctttccccacaggcagctcctctctggacagacctgaccctgcctctaccctgtggagggagcccggacacagctctccagcttaccatctcctgaaacccccaactcctgtcccccaactcagtgaatttctaattgtccttcaagactgaactcagggcgaggtgcagtggctcacgcttgtaatcccagcactttgggaggctgaggtaggcagatcacctgaggtcaggagttggagaccagcctggccaacatggtgaaaccccatctctactaaaaatacaaaagttagccaggtgtggtggcaggtgcctgtaattacagctgttcctctggaggttgaggcaagagaatcgcttgaacccaggaggcagaggttgcagtgagccaagattgcaccactgcactccagcctgggctacagagcgagactccatctcaattaaagaaaaaaaaaaaaagactgaactcagatgagcctctgacaccctccagtggttccttacctgctccatgtgccattgcccaacatgtttctgtcatagcacacatgacaccataaaaatgatatgatgggctgggcatagtggctcacgcctataatcccagcactttgggaggctgaggcaggaggatcacttgagcctgggagttcaagatcagcctggacaacatagggagaccctatctctaaaaaaacaatttacaagttagccaggcatgctggcacgcacccataatcccagctgaggtgggaggatcgcttgagcccaggaagtcaaggctagagtgagccccattgcactccagcctgggtgacagagcaagactctctcaaaaaaaaaaaccaaaaaaaacggaaaaacagacatcacgtggctgttgcctcctttgacagtaaccccatttcatgtttagcttcctgtatctgtcacagcacagagcttggcacatagtgggccctaaagccatctttgcttggctggaaagacacctggcccaaatgttgcaggcactgaaaaaataattgttgaataaataattctgagtgttctagcaacgcttcttgccctctggtgatcaggtgaccaccaggtcccctcgtctgctggttgtttcgtgagttttcatcctttctgtttcaagtgtgcaatttccgaatggccacccgcatcatccctgcagcctgtggactctcaaaacccagtccctcctgctgggaagtaagggaccagctgttctgatggctcaaaaaccttcagccgtttgcaattttatgatttgtgaaatcatgaatcaggaatataggaaaagcctaaatctgtcactataagcagctaagtgctgaataaagaagttacaaagctcggctgggtgctgtggctcatgcctgtaatcccagcactttgggaggccaaggtaggtggatcacctgagatcgggagttcaagaccagcctgaccaacatggagaagccccatctctactaaaaaatatataaaattagccagtcatggtggcacatgcctgtaatcccagctactcaggaggctgaggcaggagaatcgcttgaacccaggaggtagaggttgcagtgagccgagatcatgccattgcactccagcctgggcgacaagagcgaaactcttgtctcaaaaaaaaaaaaaaaaaaaaattgcaaagctcttcatctctgtaaagtgcaatctgacaatctgactgccccattcagtagagagagggacaggggaggtcatctcatccatccccctgcctggggtaaggccatgtccacaagatttcccacagaagaaaatttacctggtgtgtgtggcattctttgaagcatgtccgctctggaaaatgcctttttctgttaaaactatgcccaccataccttggtagaaacctgtttcgtctgtccatgtttaaaccattactttagtcagcattgagcaactgtgctggggaatccactaagcctagggcggcatccagccacgtggcactcctggggcatgaaggatcactagccagtcaacgccagagatggagagcgagggggatctggcctgatcggccggggtcgcgcagtagctcccacactggtctcctgcatgtgccctgtcctcccgtccattcttcatgaggcagccacagtggtctccgcagattgccaatctgttgtccctctgccagcacctgcctctgttgggaacccagcgagaagcagatctccctcaaggatttaaccaaagggagttgatgccactgacagaggtgtggggagcttacgggaaccatgtgggaagatgctgcatccagggactagccagagcaggaacctttatccacccccaagccttgatgggctcagagggagacgggagatgtttctgaaagctgatgagagctgtggccctgggagaggggcggcccaacaggagcagtagctgtaagggaccaaagatgacagccactgacagtttcatcacagcccctcacagtggaagggaagagaaataaatactccagcctctctcctcccaccttcccattccctgctggtgcttctcattggccaaactcagctggaagccccagggcacaggaacccaggtgacagagctagagagatcttccttcctgagcacagagcagggcagagaacggcagaatggatcagagggggcagacaggaaatggtttcaccaccagatcagatcattaaatggttgcctgctcccatggtaaggataggaagtgctaactcaccagggccccgtgtggccttgcccctggtgacctcatggcctcctgctccttgccttccgggccatgcccaccctggccttccctagtcggctgctacctgtgctgcaccccctggctgcagcactctcccccagctcttcctctggttccactcagcccttagatcccagcttcatcatcacttgctcagagaggccctcccagattctccctgtccaaatcaggtctttctctagttctgtcataacatgccctgttccctttcctcatctttatgagtttatctctgtgtgttgatttggtatgtcccttctcctggactagaagctctgggaaggcagggaccacgttatccccaatgcctaagagcgtggagtccaggaagtgcttgtcaaacaaatggatgagtgtcgcactgtcgcccttgtctagagttgggggtaaggggagggaatcaacaaaacctgggcaagcatgactttgggttggagtttcatggagtgtttttaatccataatctctatttttttaaattatcctacagatggaagagaaacagtaggaattctgtcttgacactgtactgacaaataggttttaatcaaggatgaaaataccatacatttttaggaaagcatagttaacttattgcatcaccctgtgccattaagaaacataaagagaccgggtgcagtggctcacacctgtaatcccagcactttggaagtccgaggcgggcggatcatgaggtcaggagttcaagaccagcctgaccaacatggtgaaaccctgtctctactaaaaatacaaaaattagccaggcgtggtggtgcatgcctgtaatcccagctactcaggaggctgaggcaggagaatcccttgaacccaagatgcttgaacccaggaggcagaggttgcagtgagccgagatcgcgccactgcaatctagccagggcaacagagcagcaagactctgtctcaaaaaaaaaaaaaaaagaaagaaagaaaagaaaaagaacaggctgggtgcggtggctcacacctgtaatgccagcactttgggaggccaaggcgggcagatcacttgaggccaggaattcgagaccagcctggccaacatagtgaaaccccatccccatctctaccaaaaatacaaaaattagccaggcatggtggtgcacgcctgtaatcccagttaccccagagactgaggtgggagaattgactgaacccgggaggtggaggctgcagtgagctgagatcacgccactgcactccagcctgggcgacagagcgaggctccatctcaaaaaataataataatagaagaaacatgaagaacataactcacctgccctgggtgaatattctggcaggtgccttggcctttttgtgcacttttagcaataatctgccaaaaggccactgagcctctatttaatttggtcatcagagcatcacatccaagatattcatcaaatctccaaatgtgactcatcaacagatcttctccctgtccgggctcagggctccttccgcccagaagcctcgatgggttgagagcctggttacctctcctgcttctgcaccttgcacttctcctcctcccagccctgctcactgccagtttctgacccatccagggttggagtgtagggaggaaaagggaggcagggaagtgccatgtggactgtggctggagctggctggctgctcgccgggctcttcaggggcttcctgcacaggcaggagacagatcccagtccgctcgctgctataaggatcacctaggggctgggcgcagtggttcatgcctgtaatcccagcactttgggaggccagggtgggtagatcacttgaggtcagtagttcaagaccagcctgaccaacatggcgaaaccctgtctctactaaaaatacaaaattagccaggcgttgtagcaggtgcctgtaatcccagctacttgggaggatgaggcaggagaattgcttgaccccgggaggcggaggttgtggtgagccgagattgtgccattgtactccagcctgagctacagagtgatactccatctcagaaaaaaaaaaaagagcattacctatggggtccctcctgctgcggggtggggaagggagagaatggggctcacccaccagctttctccacaagttccttttctctctccatagtttaaatagtgggaaatgtggtataagagcttgggggaacagagtcttcagatcattttctctttttttttgacacagggtctctctctgttgcccagcctggagtgcagtggcacattcttggctcactgcaacctccgcctcctagattcaagtgattctcctgcctcagcctcccgagtagctgggactacaggcctgtgccaccacacccagcctcattttctctttacgctctcctgagttgctatcagattttgatagcgcctccatcaaaacttcctgttacaatgaacttcctttattaattttttttcttctttaaacctcagcatctaccagaggaatgcaatgaattttcaaaataacctttgttaagatgacttacaaggtatacttgtgtaacacaagtgttcaaaagaactaaaactcataaacattctacatcagtcagctattcctacaataaagccgtataacaaaccacccaagggctcagtgacaaacgttaatgtttctttctggcttacaaaaaatacaaaattacccaggcgtggtggtgggcgcctgtaatcccagctactggggaggcagagacaggagaatcgcctgaacccaggagacagaggttgctgtgagccgagattgcgccactgccctgagggagtaggtttttgccaaactgtaagatctgccacacggtctatgtatttaaaacaggaataagtgaacagtccttggaggattaccctttgatgtcagaggatgttcagacatctgctttatagaaaatgtgtatgtgccctaacacttttttttttgagacagtctcgatctgtgccccaggctggagtgcagtggcgccatcttggctcactgcaacctccgcctcccaggttcacgccgttctcctgtctcagcctcccaagtagctgggactacaggcacccaccaccacgcccagctaatttttgtatttttagtacagacggggctttaccatattggtcaggctggtctcgaactcctgacctcaggtgatctgcccgcctcagcctcccaaagtgctgggattacaggtatgagccactgcgcccagccgactttttattagatttcgaatctggttagccagcaacttactaattagatgtggactttcattcttcagaaggaaactggccgcgtgtggtggctcacagctgtaatcccaacactttgggaagcccaggaggtaggatggcttgagcccaggagtttgagaccagcctgggcaacatagtgagacctcgtctctacaaaaaataaacaaaattggctgggcatggtggtataagcctgtagtcccagctacttgggaggctgaggcaggaggattgcttgaggacaggaggtcaaagctgcagtgcgctatgattgcaccattgcactccagcctgggtgacagagtgagacctgtctcgataaaacaaacaaacaaaaaaccctattcctattttttgatcgaatattttctctctgaagtgtcttagtgcctttcttcccaccatctaaataatctctccctccacagtatggctgtgacccgatccaaagacgctcctcctttcggcccccccatccccagtggaaccacattccgcaaatccgacgtcttcagagacttcttgctggccaaggtgattaacgctgagaacgccgcgcacaagtccgacaagttccacaccatggccaccaggacccgccaggagtatctcaaggacctggccgaaaactgtgtctccaacacccccatcgactccaccggcaaattcaacctcatctccctgacctccaagaagaaggaaaagacaaaagcacgggctggcgctgagcagcacagtgcaggggccatcgcctggagggtggtggcccaggactacgcccagggggtggaaatcgactgcattttgggaatttccaatgagtttgtggtgctcctggacttacgcaccaaggaggtggtgttcaactgctactgcggggatgtcattggctggactccagactcctccacactcaaaatcttctatggacgaggagaccacatcttcctacaggcgacagagggttctgtggaggacataagggagatagtgcagagactgaaggtaagggagagagcccggcgatagggcggcgatttgtatggtttcggcctcaggaaccactgaaatacttccctagcccagtcagttaggctaagacacgcactggcccggagagaatcacagttgtcacttacaaactagacatcttgtgggttctgtagctaggttcttcctctggaaggtttgtgccagagatctgtggatcttcatgctattaccttggaaagacaagagatacttattaaccttggacactgatagaaagtataaatttaagcttaggttaaaaatgtaggccaggcgccatggctcatacctgtaatctatctcagcactttaggaggctgaggtggtggatcgcttgagcccaggaatttccagaccaacctgggtaaccatagtgagactctgcctacaaaaaaaaaaaaaagaaaagaaaattagggaagcatggtggtacatgcctgtggtcccagctacttgggaggctgaggtgggaggattgtttgagcccaagaggttgaggccacagtgagctgagatgacgccactgcacttcagcctgggcaacagtatgagaccctgtctcaaaaacaaacaaaaaaaaagaagtgtaagagtactttctaaaataattaaaatagaatgaaaaatgtccaaaccattaatggatagggcagaggtgagaggaggaaaaaatacaagaaagcacaaaggaacataaaattacatggcaggaatgagttccatgttagtaatcacagtaaatgtgaatggtttaacttgccctattaaaagacaaagactcacagtctaggtagaaatcttcccctaaacccctcgtggacaaaccaagagtggcagattggtgatagcttagctgctgtctgcctgaagcattgtgctgagaagtactcaggccccatctaagctccacaagaaagaacactgtggtcagtgattgcctctgcagtgggtttggcagaacgccgtgccatgtgtgctaaatagagatagcatataacacggcagttcagagcacaagatctagtcagaaggcctggcttcaagtcccagcactgccacttaccagctgcatgaccttgagccaagttatttagcttctttgtgattcagtttcttcatctgaaaagcaggtacaagaatcattctgcattgctgggtgcagtggctcatgcctataatcccaacactttgggaggccgaggagaaaggattgcttgagcccaggagtttgagaccagcctgggcaatacagtgagatgccgtttctaaaaaaaaaataaaaaaataaattagccgaggcaggtagatcatgaggtcaggagatcaagaccatcctggctaatacggtgaaaccccatctctactaaaaatacaaaaaattagccaggcatggtggtgggcgcctgtagtcccggctacttgggaggctgaggcaggagaatggtgtgaacccggaaggcgaggcttgcagtgagctgagatcacgccactgcgctccagcctgggtgacagtgctagactctgtctcaaaaaataaaaataaaaaataggccgggcgtggtggctcacgcctgtaatcccagcactttgggaggccgaggtgggcagatcacaaggtcaggagattgagaccatcctggctaacacagtgaaaccccgtctctattaaaaatacaaaaattagccaggcatggtggcgggtgcctgtagtcccagctactcgggaggctgaggcaggagaatggcgtgaacctgggaggcggaggttgcagtgagccgagaccctgccactgcactccagcttgggtgacagagcgagactccgtctcaaaaaaaaataaataaacaaacaaaaaataaattagctgggcatggtggtgcacacttgtggcctcaactattcaggaggctgagtgggatgatcacttgagcccaggagtttgaggctgcagtgagctatgatcacaccactgcactcgaacctcggcaacagagaaagacccggactcaaaaaaaaaaatgaaaaagtggccaggcgcggtggctcacacctgtaatcccagcacttggggaggccgaggtggatggattatttcaggtcaggggttcaagaccagcctggccaacatggtaaaacctcatctctactaaaaatacaaaaattagccaggcgtggtggcacacacctgtaatcccagctactcgggaggccgagggaaaagaattgcttgaatccgagaggcagaggttgcagtgagctgagagtgagccactgcactccaacgtgggtgacagagcaaaactctgtctcaaaaaaacaaacaaaagcaaactcctgtgttcctccccacccctctcagaggtttcctgactttgtaaaatagaagtcctctactcaaataaggttttagggaaaaaaaggtcgactccatccctccatttgcggatgtcagagctttggcatcagcctgggctccactctctctcatgcccacattcgtcagctccacttctgtaggcaggcatcagccacctctcccagagccctcaccctggagcgagccaccctggtctctcccggacactttcgatggtgtcctttctggtccttcttacccctgcccttgcttctctgtggcctgttctcgacgtggtagtgagagcaatctgatcacatcacctctctgcctaaaccctcaggtcactctaggttaaagcctcagtccttacagaagcccatgaggccgggtgtgaactggctccctgtcgacttctctgacctcatgtcactgttgcgctctctgccccagccatgaagacctctgaggtttcatgcgcatgctagggcggcgtccagcctcagggcctttgtaccacctcttgctggaacacttctctgatcaccacatggctcgctccctttcctcctacaggcctttggtcacatgtcgccttgtcggtgaggcctcgttatctaagattgcacaccccctcccctggcttggagcacattcacgcgctttgcctgcttaaccaccatctgccatgcactgtgtgttatctgttcactgccgtgtcctcagcacctgggccagcatctggtgcacagtagccgctgagtgagcaggaaccgagtgcaggcacaaatgcgtcgtatgctatagtggccgcaatagtgaggatcaaatgggcgccagctctgcgtcagaccctgctcagcaccttgggtggtcttgcgtctcttgctcacaaaagcctgatgaggtcctcacttcgcagatgaggaaactgaggcccagagataccttgacttgcccagagcccaaagagcctgggttttggagttttttttttgttttttttgttttttttttaattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattaaccctgagtggacacagcacatgtttcagagagcacagggttgggggtaaggtcacagatcaacaggatcccaaggccgaagaatttttcttagtacagaacaaaatgaaaagtttcccatgtctatttctttctacacagacacggcaaccatccgatttctcaatcttttccccacctttcccccctttctattccacaaaaccgccattgtcatcatggcccgttctcaatgagctgatgggtacacctcccagacggggtggcggccgggcagaggggctcctcacttcccagtaggggtggccgggcagaggcgcccctcacctcccggacagggcggctggccgggcagaggggctcctcacttcccagtaggggcggccgggcagaggcgcccctcacctcccggacggggtggctggccgggcggggggccaacccccccccacctccctcccggacggggcggatggccgggcagaggggctcctcacctcccagtaggggcggctgggcagaggcgcccctcacctcccggacggggcggctggccgggcggggggctgaccccccacctccctcccggacggggtggctgccgggcggagacgctcctcacttcccagacggggtggttgctgggcggagggtctcctcacttctcagacggggcagctgccgggcggaggggctcctcacttctcagatggggcggttgccaggcggagggtctcctcacttctcagacggggcggccgggcagagacgctcctcacctcccagacggggtcgcggccaggcagaggcgctcctcacatcccagacggggtggcggggcagaggcgctccccacatctcagacgatgggcggccgggcagagacgttcctcacttcctagatgggatggcggccgggaagaggcgctcctcacttcctagatgggatggcagccgggcagagacgctcctcactttccagactgggcagccaggcagaggggctcctcacgtcccagacgatgggcggccaggcagagacgctcctcacttcccagacggggtggcggccgggcagaggctgcactcttggcactttgggaggccaaggcaggcggctgggaggtggaggttgtagcaagccgagatcacgccactgcactccagcctgggcaccattgagcactgagtgaaccagactccgtctgcaatcccggcacctcgggaggctgaggctggcggatcactcgcggttaggagctggagaccagcccggccatcacagcgaaaccccgtctccaccaaaaaaatacgaaaaccagtcaggtgtggcggcgcgcgcctgcaatcgcaggcactccgcaggctgaggcaggagaatcaggcagggaggttgcagtgagccgagatggcagcagtacagtccagcttcggctcgggatcagagggagactgtggaaagagagggagagggagaccgtggggagagggagagggagagggagctgttttgttttttgagatggagtcttgctctgtcccccaggctggagtgcagcagagcgatctcggctcactgcaacctccacctcccgggttcaagcatttctcctgtctcagccccccaggtagctgggactacaggcgcccgccaccatgctcagctaatttttgcctttttaatagagatagggtttcgccatgttggccaggctagtctcgaactcctggcctcaagtgatccaccctccctggcctcccaaagtgctagaattacaggcctgagccactgtgcccggccaagcctgggttcttaaacactaggctactccgcctcccctaatcttgacagcagctcgcgtttcttgagcagggaccatgccaggcaccatgccaggtgacatgttttacccacatcctcactgtgccactctgtcccacacccacccccgtgcctactgttggcggagtccttttggagcatatttccacagccatacccccacccccacccccagtctcagtgccccagagcctgctggggaaccagtgggccagggaatggtgacataagccatctcccgtggaggggcaggcccgttttgaatgacttgtgacagtgagtctctctctttgtgaagcacccacagggtacagattccacactctccccggcaggctgactcaactgccccagacatcctgaactaacggtatcccatcactggttaattgaatgagtgttgttatgcgcctggccttggcctggccagtgctgggacatagtgatgaccataacagacccaggcctactttcatggtgctcctctctgggacagatattaaacacgcaattcggccaagcgcggtggctcacgcctgtaatcccagcactttggaaggccgaggcgggtggatcaccaggtcaagagatcgagaccatcctggccaacatggtgaaaccccatctctactaaacatacgaaaaaattagccgggcgtggtggcgggctcctgtagtcccagctactcaggaggctgaggcagaagaatggcgtgaacccgggaggcggaggttgcagtgagccgagattgcaccactgcactccagcactccagcctggtgacagagtgaggctccatctcaaaaacaaaaacaaaaacaaaacaaaacaaaaaaaaacaccacgcaattgaagtgccaagagcttaaaaggggggtgtggaggatgccaggagaacctatcagatggtgctaaatcagacaaggagaaggtctcaaatccacaggttggatacagtcccagatgtatttagttagttaccacagtttaacatttagagcaagcttgtccaacctgcagcccaagagggctttgaatggcacccaacacagattcataaagtttcttaaaacattatgacattgtgagtttttttgtgatttttttaagcttatcagctatcattaatgttagtgtatttcatgtgaggcccaagacaattctttttttttttctttaagacagtctctctctgttgcctaggctggagtgccatggtgcaatctcagctcactgcaacctccgcctccccggttcaagcgattctcctgcctcagcctcccaagtagctgggattacagatgtgcaccaccatgcccagctaattttgtatttttagtagagacggggtttcaccatgttgcccaggccggtcttgaactcctgacctgaggtgatctgcccacctcagcctcccaaagtgctggaattgcaggcatgagccactgtgcccggcccaattttactttttaattatagaaaattgcaagcatacactaaagcaaagggaatcatataagaaccccagtcttggccggctgcagtggctcacacctgtaatcccagcactttgggaggccaaggcagttggatcaccagaggtcaggatttcgacaccagcctgaccgacatggagaaaccccgtctctactaaaaatacaaaattagctgggtgtggtggcgcatgcctgtgatcccagctacttgggaggctgaggcaggagaattgcttgaatccaggaagcggaggttgcgatgagccaagattgtgccattgcactccagcctgggcaacaagagcgaaactccgtctcaaaaaaaagagaaccccagtcttcattaccatctacaatagttactgacccatggctgatcttgttctttcttccttccctctctttcccaattattttgaagaaatcctagacatcttatcatttcatctgtaaatttttcaatatttatttctaaaagatacaactcttaaaacataacatagccatcatacataaaataaaaaattaacgataattccttattgtcaaataaacacattgtcacccatgagtgggctataaaatcaatcacagagatgtaattttttttatttttaattttaactttaatttttaaagacaaggtcttggtgtcaccccggctggagtgcagtggcacagtcatcgctcactgcagtgtcactctcctgggctcaagcctgcctcccacctcagcctcccaagtagctgggactgcaagcgtatgccaccatgctcagctaattttttttttattttatttttagtagagatgaagtcttgctatattgcccaggctcatcttgaactcctgggctcaagcagtcctcctgccttggcctcctaaaagtgttgagattacagagattacaggtgtgaggcactgcactcagcccgagttgcaacagtgttaaaggttagatatcttagtccacttagcctgaatataacaacatagcttaggtggggtagcttataagcaaaagcaatttatttcttcgcatttctggaggccaggaagtccaagataaaggtacccgcaggttctgtatctggtgagggcccctttcaacttcacggatggcaccttcttgctgtcatggtggaagaggtgaacaagttccttgggcctcttttttttttttttttttttttttttttgagacagtctcgctctgtcgcccaggctggagtgcagtagcgtgatctcggctcactgcaacctctgcctcctgtgttcaagcgattctcctgtgtcagccccctgagtagctgggattacaggcgtataccaccacgtcaggcctcttttatatgggcactgatccccttcatgagggttctgccgtagtaataggatgggaaagaataaaaagtgtcacagtgtgcctcagtgagtaaagataagactattttatgaagcattgttttggtcacacgtttcccccactttccaaattctcgccgtccaaatcaggaaccaaacagattcagtgacattttcaggtaagtactttaccatccaaatgcttacttcttgctatccacactcaagaatgtgacggatttgaattgcaaggaatatttgtgtctgtgggcatgtgtgtaaaacacgaatgtgtagagtagtttgtgacgtaaaattatttctaaaacacgaatttgtagagtagtttgtgacataaaattatttctttccttggccgggcgcagtggctcacgcctgtaatcccagcactttgggaggccgagacaggtgaatcacttgaggtcaggagttcgagaccagcctggccaacatggtaaaaccccatctctactaaaagtaccaaaattagctgggtgtggtggcagatgcctgtaatcccacctactcgggaggctgagacaggagaattgcttgaaccagggaggcggaggtggcagtgagctgagatcgggccactgcactccagcctgggcgacagcgagactccgtcttaaaaaaaaaaaaatttattcctttcttcaagtggtggtgagaaaagtatgaaagcgggcatcctgataggtatgttacatagcatcatttctagccaggggatgacttctcacaggaaatgtaagccattccgttatctttccataacgcagttttaggaaagggcaggcattcttgacaacttgcttaatagccatggctggttacattcatcttgtttttatcccaagaagaggggatcgcttaacagcatgctggggggagggggcagggctctattcagcaggtcctcagatcttatggtaacacattatccaggggaatatctcacccagtgaagcagggagtcctggaggccaggccctgcgtggtccgatcagctccatgttgggggaaggtctgaggaggagatggggaaagggtttcttcctccaagaatggtgtcacgaggccgggcatggtggctcacgcctgtaatcccagcactttgggaggccgaggcgggcagatcatgaggtcaggagttcgagaccagcctgaccaatatggtgaaaccccgtctctactaaaaatacaaaaaactagccgggcatggtggcgcgtgcctgtaatccctgctactggggaggctgaggcaggatacttgcttgaacccgggaggcggaggttgcagtgagccgagatcacgccactgcactccagcctgggcgacagagcgagactctgtctcaaaaaaaaaaaaaaagaatggtgtcacgaagtaaaagaatataatgtgagttcccaacctagaaaaggtcccagtacttctggtctcatgcttccttgtgtattttagttagagtcattgtgtcagtcaggatacagtattagtggcttaaagcaggtttggctgggtgtggtggctctcacctgtaatcctagcactttgggaggctgaggcaggtggatcatctgaggtcaggagttcaagactagcctggccaatatggcaaaaccctgtctctactaaaaatacaaaaattagccaggcgtggtagcagacgcttgtaatcccagctactcaggaggctgaggcaggagaatcgcttgaacccaggaagcagacgttgcagtgagctgagatcatgccgctgcacttcagcctgggcgacagagcaagtctccgtctcaaaaataaataaataataaaatgatgaaataaataccacagcccagaggacatggcagtgccactcgcaactctttggccaaaacaagtcccagggccccacccaaccacaagggagccaagaagtgcaatcccactgaccccaggaaggagggagttcggggcctttggagccacagctcatgactgccatggtctctgcaaggttagaagccacggggtcgcatatccacatttcccctccagaaatcaggaagccaggctgggaccgggtgcgtgttccccctgcgggtcccctgccatcacccgggaaggtattaatagatgggagttggcaggtttttggcttcaaagcggggaacgtgaccaggggtcttccagaggagctgacccaagcagcttctgaggctcgatcctgcctgtggcctgcaggtgatgaccagtggctgggagacggtggacatgacgcttcggcggaacgggctcgggcagctgggcttccacgtgaagtacgacggcacggtggccgaggttgaggactatgggttcgcctggcaggccggcctccggcagggcagccgactagtggagatctgcaaggtggccgtggtcacactgacccacgaccagatgatcgacctgctgcgcacctctgtcactgtgaaggtggtcatcatcccgccttttgaggacggcactccccggaggtaagggcctccacctttcagccaggtggtgggtggcagctcccagatcgctggcatgaggcctccctggcactgtcacttgaggtcccaatagaggggggataggcaggcccttctaggcaggaatagtggcaacagtgacaggacggggagggcacatctacagagcgcttactgtatgccagttattggtttagcccttcatacgtgcatgatcgcatttaatctccacagttgccctgtgaggggagagcctcattcttcccatttcctacatgaagcacaggatgttaatagttgcttgcctgtgggccccccacacttcattcatttgttcaaaatgtgtttattgagcccctactgtgtgcaagctctgttcaaagtgaccacaacaaagtgcctgctcccttgcggtttgtgttctacagggaaagacaggccgtgaagaaataggtgtgtcataccggatcaggtagtactaagtctcagaaggaaattaaagcagggtaatgaaggggctgcagcacgatgggagagctgcttacaaggcgggcagagaaggctccacgaggctccacagggaggcagccatgtggttttctggccagcgggctccagacaggagctggccagggcacagcctccccagtgtacatgggtgatgtgttcctggagtacggggaggcccatgtggctggagcagagcgagcaggagtgagagctgagagcaaaggacagagaggtgaccaggcaggcggtgtgggcttcatgggttttattccatgcttgggttttattccatgctcagtgggaagctggtaggtgacttatttattttgttttgttttttcttttgttgtttttgttttttgtttttttagatggagtctcgctctgtcgcccaggctgaagtgcagtggcgtgatctcaactcactgcaacctccacctcccgggttcaagcgattctcctgcctcagcctcccgagtagctgggactacaggcacgtgccaccacgcccagctaatttttgtatttttagtagacacggggtttcaccatgttgtccaggatggtctcaatctcttgtcctcgtgatccacgtgcctcggcctcccaaagtgctggagttaacaggcgtgagccactgcgtccagccaacagcaatttcgtagtgtcaactatctagactgggttcacacctgtaatcgtaacactctgggaggctgaggtgggaagatcacttgaggccaggagttcaagaccagcctggccaacacagtgagaccccgtctctgcatctctgcatctctgcctaaaggagaaaaaaaaaacagtgcagttgtagccccagctattttcaggctgaggtgggaaaatcacttgagcctaggaagttgaggctgcagggagccatgattgtgccactgcactccagcctgggcaacagagggagacctcatctctttgttttttaaacagttgttcatcagaattctcctattggccgggtgtggtggctcacacctgtaacctcagcacttcgggaggccgaggcgggcggatcaccaggcgggagttcaagaccagcctgaaccaggctggagtccaagaccagcctgaccaatgtggagaaacactgtctctactaaaaatacaaaattagctgggcgtggtggcgcatgcctgtaatcccagctactcgggaggctgaggcaggagaattgcttgaacccgggaggcagaggttgcggtgagctgagatcgtgccattgcactccagcctgggcaacaagaatgaagctacgtctcaaaaaaaaaaaaaaagaaaaaaagaattctcctattgcatttgattcatgtatctcttgaggctctttttttttttgctttgagacagagtcttgctctgtcacccaggctggagtgcagtggcgcaatcttggctcactgcaacctccgcctcctgggttccagcgattctcctgtgtcagcctcctgagtagctgggattacaggcatgtagcaccacacctggctaaatttcatatttttagtagagctggggtttcaccatgttggccaggctggtcttgaactcctgacttcaggtgttccacccacctcagccacccaaagtgctgggattacagatgtgagccaccgcgcctggccttttccttgcagtttattttggaaagaaaccaggtcacctgtccttagagcttcccccttcctggctttagctggcggcctccccatggtgtcctttagcctattgctccaccactggtattttctgtaaactagagtcaaagatggaagcttgcttaggccccaatgggatgtctttcggccgcagcactcctaggtatgcatctgtgagaaggcactgcgtgcctggtctccccctgcaagtgacactaggggcaagcagaggcttcagacagcggcacctggccatcaccacatgtcccctccagtcctgtttcacagcccagcagccactgctaggccctgcctagatccatcatttcatgacggtttgcagacgagtgccatcttcattctgtcattccttcttcatatattggctggaatgcttctaaaaagagctttctttcagtaaccgtttagttaccctgaggtataatttgtacagagaagacaagataaatacagttttcagaataatgagttggtccctagcaacctccagaagtgaccaatgagagagacgcaccatgttctcagctctggaaacagtgcacagaggacagccaaggccttggcctcatggagtgaggccccaatgggtcaggggagacaaacagtaaacaagtaaatgaatgagatgattttatatcacagagtggggaggcaggagagcatagcaggagaggcaggctgtctaggtttgaatcccagctcttccccttgttacctttgaccctagggaagtggccttaccaccctgtgcccggtttcctcatttgtaaaacaaggacaataacgtcctttccacaagagcgtttgtgaagttgaaggagatccaacttgtaaagcacgtaggacaggccagacccagtgaatttgtgactgtggagtgctggtggctctcagcacttttggaggccgaggccagaagatcacttgagcccagcagttcgagaccagcctaggcaacatagcaagacctcgccactacaacaaattttttttttttttgagactgagtttcactcttgttgcccagactgcagtgcagtggcatgatcttagctcactgcaagctccgcctcctgtgttcaagcgattcttctgcctcatcctcccgagtagctgggactacaggcatgcaccaccacacccagctaatttttgtatttttagcagagacggggtttcaccttattggccaggctggtctcaaactcctgacctcatgtgatctgcccgcctcgacctcccagagtgctaggattacaggcatgagccactgcacccagcccaaatttttaaaaatcagctaggtgtgatggcacatgcatgtagtctcagctactcagggtgagataggaggttgagactgcagtgagctgtgatcacaccactgcactcaagctttctcaaaaaaaaaaaaaaaaaaaaaaaagccaggcttggtggctcatgcctgtaatcccagcactttcggaggccaaggcgggtggatcatgaggtcaggagtttgagaccagcctggccaatatggtgaaaccccgtctctactaaaaatacaaaaattagccgggcatggtagcgtgcgcctgtagttccagctattcaggaggctgaggcagaagaatcacttgaacccaggaggcagagtttgcagtgagccgattgcaccactgcactccagcctggatgacagagcgagactctgtttcaggaaaaaaaaaaaaaaaaaaaaaaaaaggcacgtgggacagtacttggcctataggaggcgctcgagagacactggcaccaagatactggatgtgaggactgtaaagggcacataacccacattggatagggtggtccgggaaggcccgaaggtgagggcaaaggcccttagcttggagacagaccagaaagaggacctgcatggctgcagcagattcagccaagaggagggcacaagatggggtgacgatgagtgccatattcacatatgaccttgctgggctcacaccagggctggtgtgatctctgctttgtagacgagaaaaccgaggcccagagtgaacaagtcactttgcagagttgtacagctagtaagcagcaaagcaaaattcaaatccaggtcggcctgtctccattatactctgcagcctctgaaagccatcacgagctattaatacacgggcatgcgagtgatgtccccaccctcaccttcctgagtcgtgcttgctctctctccacttggtgggggacagttctgggcaggcctaaaccctgaacctgagggtgtggccacccctacccacatcccagatggctcaacctcaggactccagtcatgccccgggtgtctccggttcccagcccttttctcctgccaccttcctaccctgcccggagccacagcccagccacacctgcttagatctctgcaggggcaagtcaaggccagataaccccacaggcaagtgccctggtggctacgctcctcgaggaaggacatgcacccctctccacacactcccacgggtgcacacgataagccagcttgcgcatcgcatgactctcaccccaaacatgcaggtagggacaaactgaaaggcaaagaaaagtctgcagttctccagctttggggagacagggccagggagagtgcaaccagacagaggagttcttctccctgcccttttcaggaggaagacattccctcctgttccctttataaggcagctgctgaaacaggatctcccgtttgcaggggtgggcgtgggtcaggacttgggtggtttttgttgttcttcaaatgcagaggtgtgtagctgacctcatttgcagagctgatgacccaggctctgggctttctccagcctgttgatgcaaccctggctcaaatgtctgttgtagtgagctctgaggcgagcagtgaggacgggatagaagtgccctcgctgccaccagccaggccgcatggcttgcacgctgaccccatgctctcagacaccgaggagaatgcatggggtcttcctcctacccccaggccacaaggctggagttttgtttgggtttttttgtttgtttgttttagttttgtttttcttcttttttcagacgaagtttcactctctgtgcctaggctggagtgcagtggtgtgagatcacgccactgcattccagcctgggcaagagagtgagactgtctcaaaaaaaaaaaaaaaaaaaaaaagaagaatgcgtaagaaagtgggagcagtggttgcttctggtagttgaaactggaggatgggattgggagacagggatgcgtgttatatcattttaatccttaaaaaaaattcaagggccagacgcagtggctcacacctataatcccagcactttgggaggccgagggaggcggatcacctgagatcaggagttcaagaccagcctagacaacatggtgaaacccggtgtctactaaaaatacaaaatgtagccgggcatggtggcaggcgcctgtaatcccagctactcaagaggctgaggcaggagaatcacttgaacccgggaggtggagattgcagtgagccaagactgcgtcactacacaccaacaagggtgacacagcaagactccgtctcaaaaaaaaatttttttaatcaataaatgaagcaggccttctcaaatgttattgtgtatcagcatcatcacaggcagctcagtcaaatgcagatccttgggccctgcctcaggggattctgatgcgtgtaatctgggatggggcccaggaatcttcattatttgctgagctcctgataatttcgatgatgatcattttcagatcactggggaaggcgagagccgggaggagctggggcagaatcttttccagagccccaaggtggtttggttggatttcagaaagtggaagtgaggcttttgcttctgtttgtgggaaaagcaggtaaactgtccttagaatcagctggaggaggcaactgcatcagctctgatttgttaagcagttgtcatgtgcagactctgctaacgctcagagaatgctcacagccagccccatattacagattaggaaactgaggctctgagaagagaattcctcacccacacccatgtaggtgataacggggctagaatctggatcagccatctggccccgcagccctggtctgtacctctccatgctgcatgctgccttcatttttgttgttgttgttgttgtttttgagatggagtctcactctgttgcccaggctggagtgcagtggcatgatctcagctcactgcaacctccgcttcccaggttcaagcgatcctcctgcctcaacccccctagtagctgagattataggcacgtgccaccatgcctggctaatttttgtatttttagtagagatggggtttcaccatgttggccaagctggtctttaactcctgacctcaggtgatccacccgcctcggcctcccaaagtgctgggattacagatgtgagccactgcacctggcccatatttttttttttttaggagatggggtctagaactcctgggttcaagtgatcctctcgtctgttcctcccaaatgctgggattataggtgtgagccactgcacccagcccatgctgccttcaaagtgattgattaatattttcctctttatattttaattattatttagttattatttttttggacacaggatcttgctgtgttgcccaggctggccttgaactcctgggatcaagtgatcctcccaactcagactgagttgtgtgagtagctgggactgcccagctatgtttttctctttgaggtcgtacccagggactcttagcccaagatgaagccatcagtacctaagggaaaaggccaggcatggtggctcatgtctgtaatcccaacactttgggaggccgaggtggatgcatcacttgaggtcaggagtttgagaccagcctggccaacatggtgaaaccccatctctactaaaaacacaaaaattagccaggcatggtggcaggcacctgtagtcccagctactcaggaggctgaggcatgagaattgcttgaacccaataggcgaaggttgcagtgagccaggatcacgccactgcactctagcctgggcaacagagccagactctgtctcaaataaaaaaaaaaaataataaagtaactaaaggaaaagtcaaggacataagaaatctacccactggctcccaaaccactctacggtggggccattgtccatggtggttaaagttgtgggctttggagtcaacgtgctaaatatttaaatccaacttctacttcttactggctgtttcaccttggatgggttatttaacttctctgtgcctcggtttacttgtctttaaaaggtgatgtactgatcaggactctgcgtaccagcaacagaacagactgaaacatggcgccgcaaaagagagtcttcactggctcacgtagccgacaagactaggagatgggacagcatttaggcatagccatatccagggactcagacaccctcaccaggagtctctgtcccttgtttacctttccatgtttgctgtcattctcagtcagtctcttgcctccccctcccacagggggttttcgaaacagttccagaataggacgtggtgcctcatgcctgtaatcctagcactttgggaggccaaggtgggcggatcacctgaggtcaggagttcgagaccagcctggccaacatgatgaaaccccatctctactaaaaatacaaaagttagccaggcatggtggcacatgcctgtaatcccagctactcgggaggctgaggcaggagaatcgcttgaacctgggaggcagaggttgcagtgagccgagatcgcaccactgcactccagcctgggtgacagaacgagactctatctcaaaaaaaaaaaaaaaaaactgagtgtggtggctcacgcctgtaatcccaacactttgggaggccgaggaggacagattacttgaggtcaggcattcaagaccagcctgggcaacatggtgaaatgccatctctactaaaaatacaaaaattagctaggtgtggtggcacacacctgtagtcctagctactcaggaggctaaggcgcgagaatcgctgaaacctgggaggtggaggttgcagtgagccgagatctcaccattgcactccagcctgggtgacagagcaagactccatctcaaaaaaaacaaacaactgatgctcgttatctctcgttggccctgcttagagcacatgacaattctgtgctagtcatcgtgtcagggtgggtgcttggagaaagcttctaattggtcaggcctgggtcacatgctaatacctggagccaggaagtggggtcagccccacccagagcccatattaacaaagacctgttatcaggagagggggtgtggggagagacaccaggcaggcaggaatggcaggtgtgcactgcctggagacagtgatagtacctttccccacctctgcccgggcctggcatgtctacaggctctgatagacgttcatattgttattgttcctcacctggtgcctggtgagacattggcagctgccagtccaaagggacagccagaagacactgccaagtgtcagttccagccatggcgctaccgaggggtgcggtgtgtcgggccctgggtgccagagcgcatccacctctgtcttagtctgttttgtgctgctatgacagaatatatgagatcggataatggataaagaacagacatacatttctcacagttgtgggggctgcaggttcaagatccaggcactggcaggatagggcctggtctttctacttccatgatggggccttgaatgctgtgacctctggaggacaggaacgccacgtccaaatacagcagaagagaagaagagagagagtccactcccgcaagccctttctatagtggcattcatccattcatgagggctctgccctaagctcctcccactagtccccacctcccaacagtggcattgggggttaagtttccaacacgtgacttttgggggaacacacatccagaccatagcagcctctgaaccaccatatccaccagatcttttgctgggtggccatgaacggggtggctccagggaattcaggagacactcagaggatcagctcgatgggggtatgggcacttccaggctgaaggctcctctgagctcagctctcagctgccaggaggtggatttcatgagcatggctcggggacccctcccatgcagggctgcagtggcagtggagaatgccagcccagccggcggatctccccgcctcaagccaggagcaccatggtgcatgtgccagcctggtctagggggagtcacaggtctctctgcatctatttcaaggttgtagatttcatggcttttttttttttttttaaccaccccacaaagtaggtcacctgctcctcttccagctgcctttaagattctttggaacaaggcagttactgtcctttgattctgaggacatccgcctttctggccctgagtaccgctaaggggggccaggcaggtctgtcgaggacactggcggcctggcagccgtgtggcctgggtcaggtagaagcgaggggcgggaacagagaattcgagtgggaggagggaagaggagatgaggtggaaagggccaggcagtcggagtccctgtgttgggtcccgtcctggttgaagactctgagctggtaagtttcagaccattttaaggagtattcactcgacttttaaaataggccatccccagccgggcgcggtggctcactcctataatcccagcattttgggaggctgaggcgggtggataacctgaggtcaggagttcgagaccagcctggccaacatggtgaaactctttctctactaaaaatacaaaacttagccgggcgtagtggcgcttgcctgtagtcccagctactcaggaggctgaggcacgagaatcgcttgaacccaggaggcagaggttgcagtgagccaacatcatgccgctgtactccagcctgggcgacaaagcaagactctgtctcaaaaaaaaaaaaaaaaaaaaaaaaagccatcccggtttatattgggccaggaaaacccagcctagacagcaggcccacgtgttggtgggctggggcctttctgagtaatgcagtttttctccccaggggttggccggagacctacgacatgaatacctcggagcccaagacggagcaggaaagcatcactcctgggggccggcccccctaccgcagcaatgctccctggcagtggagcgggcccgcatcccataactctctaccagcctccaagtgggccactccaaccactcccggccatgcccagtccctgagccggcccctgaagcagacccccatagtccccttccgggagtcccagccactgcacagcaagaggtaagcacctgctggggggaccaatacttcccaacccccaccagcccacacccatcctccgcccctccctctcctcactatttcctccatcctcttcctcgcctcaagctttcgaccttccttcttatccttatgtctcccttgttcctccctccctccttcgtttcagctttcaccgttggcctcttgtctggggacccagtgctggggagctctgggttagaaatccattatactaagtagacgactgaagctctgctttttaggctgggcacggtggctcacgcctgtaatcccaacattttgggaggtcaaggcaggagcattgcttgaggccaggagttagagagcttgggcaacatagcagaaccctggctctataaaaaacatttattaaaaattagccaggtgtgatgcacacctgtggtcccagctgcccaagaggctgaggtgggaggatggcttgagcccagaagttggaggctgcagtgagctgtgattgcaccactgcactccagactgagcaataccttatctctgaaaaataaaataaaataaaactgttatttttaaggtgaagggactgataagcacaaaatttaggacagtgacttcttcctggaggaggcagggaaatgggaagtggggaagcccacaggtagatgttagcaccaccgttctagtcctggggttggctggtagcttcagggagtttgttttatgatgatgacaaatataacttaacagatactcttttgaagatattatatattaaaagataaaaagaaaattttccaaaaaatgaaggaatccaacttgcagagggacatcttgtccccagggggcagaggcgagaatggtcttgagcagcctgcagaagctgtgagttgcgggcagccgcagtggatccgggaagagggggcccaggagcatcccagcttctctcgccctgtgctcagcatcctccccttcatcctgagcagtgaatagcagaagggatgtggctgggcgggggaaagttcggttggtctgtctgtctgtccgtctgtccatccatctgtctgtccgtccatcctcccagggcaggggtaccctcctactcaccctctgcctccttcctcccctgtctccttctaggcctgtcagcttcccagaaaccccttacacagtatcaccagcaggggccgacagagtccctccctaccgacagccttctgggagcttctccacccccggttcggccacctacgtgagatacaagccatccccagaaaggtcagcctccctcaattcttttcatgttaagggatctgatgaaagctgtgcctccttcttccccagcaaatgcacacccccacaattctagttgccattttatggtgtttctggacccctgaaggtcctcagaggagccccatggggtggttatgtctcaagttttggagcaaaactgggccgggctgggcaggacccatcgttggctttccttgcagcagaattttgattgctgttctcttgacacctgtcaagcaagagcatccactatccagcacggccatgcatctaactctctccagccctaagcccctaggaccaggctgccagcattacccagttttcgagatctttcaggattcagttctgcccacttgcgtccatctgcaacctggcagcctgagagatctccccaaaccctccatggctccccaccagcctgagagatctccccaaaccctccatggctccccagtgccctcaggataaacttggcattcaaggcccttcaggctctggctccggctgagcttattccccagctgccttcagccctcgtgccctctgttcttcctctgcccccaggtccctgtctcaggggcagccacatcaatcctagtccttgggcctgagctgtggccctcatcctgtgaatgtccccttcctcctcctccttgcagtggtcctcctcctgagcatctctgtcacccaccctctcctcctttccctgttctcttgcccaggccaccacagtgggcttccagccttcatctcacctcccctggtctaccctccactcaacactcaacagccagagggatctttctgtgtcttttttttttttttttttttttgagaccactctgtcgccagactggagtgcagtggcgcaatctcagctcactgcaacctccacctcccgggttcaagtgattctcctgcctcagcctcccaagtagctgggactacaggctctcgccaccacgcccagctaatttttgtatttttagtagagacggattttcaccatgctggccagactggtctcaaactcctggcctcaagcgatccgcctgcctcagcttcccaaagtgctgggattacaagtgtgagcccgtgcacctggccagatctttctatacctgaacatgcctgtcccctgctccaaaccctcccaccactcccagagccctcaggacacagctttggcccctccctgtggccaccagggcccctgcgagtctcgtgcagtgccacactttagccacactggccactcccagcttcctagggggactgtctgtatttcagagccttgatggtgttccttccttggcctgaatatgcttcacactcctcgcccacactccccccatcctaccaactcaagcttctgtgcccctctccagaacccttctctggagctccctcttgaggcaaggcactgccccccaattcctgtgtatttcctgactgtggccttgagcactcttcatccttattagccagctaagagtgtgtgtgcttgcgcacgtgcatgtatgtgcacctgtaagagagcgagagagagacagagagggtaagcgtgctcttcaagacctcccatcacatagtacacagtccgacacatggctgatctttggtatatattggatgaaaggatggagtgagtgggtttgttaaaatgaaaccacctgccttaagaccagggatcaggccaccaaaccagtggttctcaatctttagcaggcattggaatcacccagaggaggacttgttaaaatacagattattgggcctgagccccaaatttctgacctggtaggttcggggtgctgcaccagggaccattctctgagagtcaccacagtcatccattgttagattctaagcctcttgttcaattggagaaacacgcccactgtttcttcttctagtagccaccattcagctttcattcagcaaagggtctcaagagctttctggcgtgccaggaggagtatttgagatactcaattacgagggggttctgtagtcagcccttgctgactgtgatggagaggatcgtaaaaaccatgtgcactctgatgagcactctaatagaggaagagggaacacagcccagcactggaggtctagactggctgcctggaggaggtgacatctgaacagaagtttgagggactaataggagtctgcgacagagaggagagaaaaagtcattccaaacagagtaaaggccacagatatgaacaagcaggatgctgtgaaacacaggagaatcagagaggaatcgggtgtgtgcgggacatggggtgtgggggcacccaggtgacagcaggggctgaggttggaaatggcagtcagagtgactcaccagtaacaaaggtggtggcagtggtgttaccgaaagctcttgggaactgttgttgttgttgttgttttctcctaaagtcttggtatctgcctttattattttaactttttattttgtaataattactgagtcacaggaagttgccaaaaaaaacatacaggtggccgggcacagtggttcacgcctgtaatccctgcactttgggaggccgagatcggtggatcatctgaggtcaggagttcgagaccagcctggccaacatgatgaaaccccgtctctactgaaaatacaaaaaattagctgggtgtggtggcacgcgcctgtaatcccagctactcaggaggctgaagcgagagaatcgtttgaacctggtaggtgcaggttgcagtgagccaagactgtggcactgcactccagcctgggcaacaggagcaaaaactccgtctcaaaaaaaaaaaaaaaaaaaagaatacagggaggtcttgtgaacctgaacccttcacgcagcctcccctattgttaacatcttgtatggttataacgcaatatcaaagcaagaggttgacatgggtacaggcctacagcttattcaaaattcaccagttatacatgcactcatttgtgtgtgtgtgtctgtagctctgtgcaattttatcacatgtgaagtgttgtgtaaccatcacgaggtgcctcatgctacccttttatagccacacccatctcttccccctgtgcctaacccctggcaaccattcaccattcatctgttctgaggctcttttttttttttggagacaaagtctcactctgtcagccaggctggagtgcaatggcacgatcatatagctcactgaagcctcactcttctgggcccaagcagtcctcccatctcagctttgcaattagctaggactgcaggcatgcaccgccacacccagccaatttttcttttctttcatagagacaaggtctcgctgtgttgctgagactgatcttgaagcccttgcctcaagccatcctcccacctggacatcccaaagtgctaggattacaggcgtgagccaccacacccaacctgtcttttaattattgttatttcatgatgaatgttagataaaaagaatcagatgtacgtatgcttcagaggttgtctttttcactcagcagaatgtccttaaggttcatccacgttgtcgcgagtctctagttcactcattatgctgtttattccgtggtctagatataccacagtttaaccactcacccatcaaaagacatttgggggagtgcatattcagggcactttgaatctatgctgctgggttgaaataaagttttttaaaatattaaaaatatattttaaaaagatttaaaaagacatttgggtagtttccgagttttggctattataaatattcatgcggtgaacatgtacattcaggcatacaggtttctgcatgaaaataagttttcatttctctgggataaatgcccaggagtacaattgcttaccgtatggtaagtccatttttagtttgaaaaggaactgccaaactgttttccagagtgtctgtatcattttacattcccaccagcagagcgtgagtgatccgggtctccacatcctcaccatttggcgttgtcactgtttttcattttagctacttttgataggtgtgcagtgatatctcactgtgattttaatttgcatgttcctaatggctaaggatattgaacaccttttcatgtcttatttgccacccctgtatcctcttcagtgaagtgcctgtgcgtgtcttttgtgcgtcttctaattgggtgtgatggtgttctgtgtctaagagttctttggacattctaaatacaagtcctttgtcagatatgcgatttgcaaatatttcctcccagcctttagtttgtcttttttacagggtctttcacagaacaaaagttttttattttattttttatttttatttatttatttattttgagacggagtcttgctctgttgcccaagccggagtgcagtggtgtcatctcggctccctgcaacttctgcctcccaggttcaagcgattctcatgcctcaacctcccatgaagctgggattacaggtacgcacaaccctcccagctaatttttgtatttttagtagagacagggtttcaccatgttggccaggctggtttcaaactcctgggctaaatcaagtgactctcctgccttggcctcccaaagtgctgggattataggcatgagccaccacacccagcctaagttttttattctgataaagcccaaattatcttttttttattattattttatggatcaggtttttggtgttgtctaagaactctgcttagtgctgggtcctgaagattttctcgtttttttttctggaagttttactcttttacatttaagtccatgatccattttgagatttgtttgttttaatttttgtgtaaggtgagaggtttaggttgaggttcctttattgcctatggttgtctgatttactccagtgctatttattgaaaaggttacccccactccactgtactgcttttgttccttaaggcaaaaatgggggagtgcagaattaattggatatccttgtgtggatctgtttctgggttccattgatctatacgtatgatctcagtgagtcctcccagcaactccttgaggtgggtagtttaattgccctcattttacagagggaaactacagctcagtgaggtgaatttgcttggctgaggtcactctgccaggacgtaacagagccaagatgagaacccgggactatggttccagagggctgaccctgacgtagaactttgggaggctgaggtgggaggattgcttgggcccgggctgtcaaggcttcagtgagccaggtgtgtgacattgcactccagcctgggtgacagagtgagactctgtcccaaaataattaattaattaagagggaaggggccgggctcggtggctcaagcctgtaatcccagcactttgggaggctgaggcgggtggatcatgaggtcaggagttcgagaccagcctggccaagatggtgaaaccccttctctactaaaaatacaaaagttagctgggtacggtggcaggcgcctgtagtcccagctactcgggaggctgaggcaggagaatcacttgaacccgggaggcggaggttgcagtgagctgagatcgcgccactgcactctagcctgggtgacagaacaagactccatctcaaaaaaaaaaaaaaagttgggggaaggaactggatcacttgcccacccctcaacccctggcaaggtcacattgcacctctgtggctgtgttaactgtgaggatttactcaagtcacgagacagagggctggctgccagagtggaatctgggcaagcaggaacggaggtgatggctgctggggtggcagccaacaaggctacatcatctgaccgtcattttgcccaggcatcctgtcattcacctgtctattgtttcatcggttgatgtgggagattgacagagcgggctggagctctctgcccggcgaggctcctgcccacagtcctgtctgttttggtgctttcctctgtggccaagagggaagctcaagccagcgtcccgtagcccaaccctgctccccgtaaggttcctccccagagtcagtacctccagcttctgcctggagacatctgaaaccatagctagtcagctcatcccaaaacaccaaaccctttataaagtgagttatcttccaagaagagataattactttaaaattactcagatgaggttaaagacagcaatttgatcttctcttctgccggggatgtttccccagagctgtgtgtgatgagatgctggaatgtcccgatttctaatcagtttgaccaaaattggacagtgatagacatggtctcaaatgggatatattcagcatcccaatgaatggtcaacataggtcagtttgcattgggataataaaaagtcttgttagttgggtggggcacagtggctcacacctgtaatcccagcactttgggaggccgaggtgggcaggtgcaagcagatcacttgaggccaggagtttgagaccagcctggccaatatggtgaaacctcatctctaataaaaatacaaaaattagcttggcaccttggcgtgtgcctgtcttcccttgggaggctgaggaaagagaatatcgcttgaaccctggaagtggaagttcgcgtcactgctgcactccagcctaagcaatagggcaagactccgtctcaaaaaaacaaaaaaagtcttgttaacaagagaagtacatggttggataaagtacgggttgtctgattggggaaagtagctgagagatgaaacaaggtaaaatatgcccaactaaagaggagggtctatgtattacgattaggtttagctgcatagtatacaaaatagtggttctgacaagattgtttctttccccacattgacgggaaaccaggccccccctccttgatgtattgctgtccttggccttttgcctcctggttcaaagtggctgttcaagctgtagccttgaggaggtggtgaggcaaaggcatccacagcacactcatgaggaagcttcgaggctggaagttatgtgtggcacctccacttttatctcattggccagagctgcaagggatcctgggacatgtagtctggtgatccagtctcattgctgccccagatacagttgggattctgttaccaaggaggaaggagaggctagtcatggggagcagcctgcagcatccgccactcagactttccgccctccccgggctcatcctagccatttttcctgagtgctgaggatttcacagcgactttttgggaaaactgagtaagtgcatcaacactccgaactccagcaaggatggagccacattttaccaggcagctagccaggtgtgaagtcagctagtaagatgaagattgcttatagtcaaagttgcttttgtaaaatccctttgattgctggaaactgggccctcagacattgagaaaagtaagaattcacgtttcgtacttcctgtgtttgggccctgttttcctttcctggaggtgtcagtggtcaaggtctggttgagggcagggaggatggtgtgttttttcctggcaagtgagtggagttgagttttcagagagtgcagtgccccttgaaacacctctctactgtgctcagggcattgaagccaggggattagggcagggtccctgtagagacagtcctggctttgagctggcagggtgaccctggataagtcagttacttcctctttggcatcttgggggatcctagtttatcacctcacctccccctaccagatcctcccaagttgaaaatacagatgccaggagccaaccagggaattgcaatatcaacactttttttttttttttttttttgaaatggagtcttgttctgttgtccaggctggagcgcagtggcacagtcttggctcactgcaaccgcaatctccgcctcccaggttcaattgattctcctgcctcagcctcccaagtagctgggatgtcacaggcacacaccaccacacctggctaatttttatatttttagtagagatggggttttgccatgttggccaggctggtctcgaactcctgagctctagtgatctgcctgcctcggcctcccaaagtgctgggattacaggcgtgagccaccacacctggctaatatcaacattattaatggaggctcagtaactcccccagagcacagggcctgtgtcagtgaggtgcttctggctgaagtaaccaaaatttggctcaaacattgtaggaatttgttatctcacagaaaaggaagctcaggagcagggcaggttccagggagggtgaacccagcatcttgaccacattatcaagggccagattccttctgcctcctctcttccaccatcagagtgggtcttacctgcagcctggtagcaacagggcagcagcagcttatgatgttaaatctggacccagcagcatctggagggcaaagagaggccatcttttcttgtcatccctcttaggagcaaggagatttcccagaagcctctgggcagacttaccccatttcagtcagacggtgctgggtaacagacacctgaaagtctccgtggcttaaatcagcaacgtttatttctcagcccctccgcagttccactgctggttggcagggacctctcaggacccaggctacccaggcagccagcaactccaagtcacttccctgacagctcagctatgagcgctggtcacatgactccattcagccagtctcaagggacctggaagtgtgtcctgccacctgcttggaagtggagaactggaatgttttgtgggcgtcttaataactcacctcccttcgtgtctcatcagccaaaattttgtcacaggcctgtctctgaaccaacctcagacagggagaagaccttctaccacaaccggctgtgatccaaggaggactggacgttaggaagtgtctacaagattcaccccatggttgtagacagggccactggggccgggcatggtggctcacatctgtagtcccagcgctttgggaagctgaagtaggcaaatcgcttgggcccaggagttcaagaccagcctgggcaacatggtgaaacccatctctacaaaaaaatactaaaaattagccgggcgtgtaacatgcagctatagtaccagctactcaggaggctgaagtgggaggatcgcttgagccgggaggcggaggttgcagtgagctgagattgtgccactgcactccagcctggttgacagagcaagaccccatctcaaaaaaaaaaaaaaaaaaaaaatagagaatgccactgggacaggagggcacagtgagagccttctaccaccacctcccttaaatcctagccttgcatgtgggtgtgcgaagctggcctccaggaggacctctgtctaggggataactttattccatccactccccaactctatgaggtagaaaatgttacctcgtgagctgggcgtggtagaacacacagagttctagcccatcagccaggtgtcccaagtcaccatgtgtcaggaatcaaacccctgcctaaacactggacatgacggggcatccttcagtcctgagaagaaggacctactgttatcgcctcttgacagctaaggaaactgaggctgtgggctaggaagtggctgcatctgtctaggcaagaggccatggtgagctttgaagccccagttgcccaactcagggcctgctgcacccatgaatgcttcccaacctgctgtctccatcagagcaaggcagcccgagagaggcctggggcagtagctgctggggacattcaccccatgtcacagccagaaaacaggacccctgagaggagcccaggggtagggctgtcggcccaagcggcctctgccccctccttcccttaggaacccgccttgccccgccgccaccagctccctggcaggcttcccaggcgagactctcatcccggacccgcagctaatagcacgtttccaggcttactcatccagccttcctaaccgctttctctcatccacagcggagcctcccgtgtgtctaaaacccactggcgagcaaggctcaggctcaggctcaggtggttttcgacataggctgatctttaaccctgggcacgttcttctcatcccctgcaggtacacggctgccccacaccccctgctatctcttgatccccacttcagccacgatgggacgtccagcggcgactcctcttccggcggcctgaccagccaggagagcaccatggaacgccagaagccaggtagggcccccaccagctgctgcgcccacccgcctgcctcactccgcaggacctcttacttagagcttgacaggcaacactccccctcttgtgagtgacggataaaacacaaaagaaagctgtaagcgccacatgtaagactagagagggcacctaggagagcagcggaaccagcaagcgagatccttatccgtccagacagggcatcggcaggtggcgtctgctcccgctgataaggccagagccggcgtgcagctgtgtgacatggagctgggagccaccagggaaggtagctgaaaaagattaagcattgagctctcaggagcaggactggctgcgtcccgtggcttttcattacataaaccctcctgtgttgttttcaacttttatggacatacggcacatgttaagagcccacatggccaggcggggtggctcacgcctataatcccagcactttgagaggccgaggtgggaggattacctgaggtcaggagtttaagaccagcctggccaacatgtggaaaccccatctctactaaaaatacaaaaattagccgggcatggtggcatgtacctgtaatcccggctacttgggaggctgaggcaggagaatcacttgaacctgggaggcagaggttgcagtgagctgaaatcgtgccactgcactccagcctgggtgacagagcaagattctgtctcaaaaaaaaaaaaaaaagaggccaggccaaggcgggcggataataatttgaggtcaggaattcaagaccagcctggccaacatggggaaaccctgtctctactaaaaatacaaaaattagccaggcgtggtggtacatgcctgtaatctcagctactcaggaggctgaggcaggagaattgcttgaacctgggaggcagaggttgcagtgagccgagatcgagtcactgcactccagcctgagcgacagagcaagactctgtctcagaaaaaaaaagaaaagagcctacatgatgaagacacagcctgataacctatcgcagagtggacacacccaggcaggaaatataacatggctagcctctccaaacccccattcccctcccagttagtacccccaaaggaaccctgtcctacttctcagcctgagctttgcctggttttgaatttcatagaatacagaatcacactgtgtctattttgtgtatgtgtgtctggtttctgtcactcagtgttacatttgtgacagccagccagtgaatgtacatggtatcgcagtatctgagtggtatcccccgttgtatgaataagccacaacttattgccacatcttggtgttgatagacatttgggttgtttgcagttgggctgcctagagcagtgttgctaggaacattcttgtgcctgtcttttgatgaacataggttcacatttctgtagggtatacacctaggagtgaaatttctaggtcatatttttaagttgattttattttatttatttatttatttattttttaaacggagtttcgctcttgtcacccaggctggagtgcaatggcacaatctcggctcaccgcaacctccaactcctgggttcaaacaattctcctgcttcagcctctcaagtagctgagactacagacatgcgccaccacacctggctaatttttgtatttttagtagagacggggtttcaccatcttggccaggctcgtctcgaactcctgaccttgtgatccacccgcctcagcctcccaaagtgatgggattacaggcgtgagccaccgcacccagctattttattttattattcattttttttttttttttgagacagagtcttactctgttgcccaagctggagtgcagtggcgtaatctcagctcgctgcaacctccgcctcccaggctcaagcgattctcctgcctcagcctcccaagtacctgggaccataggcatgagccaccactcctggctaattttgtatttttaatagagacagggtttcaacatgttgccaaggctggtcttgaactcctgacctcaagtgatccacccgcttcggcttcccaaagtgctgagattacaggtgtgagccaccacacagggctagtatgtttaactttataagaaggtgccaaactgtttcccaaaatgacaaagcatcttatactctgtctatcaacatgtgagagttctagttgctgcatgccctcaccagcctctgtgtttcattcattccggtgggcaggtggtgctaccacattatggttttattttatttattattttttaaaaacattttttacagagacaacgtcttgccatgttgcccaggctggtctcaaactcctgggctcaggtgatcctcctacctcagcctcccaaagtgctgggattacaggcgcgagccaccgcacccggctggctttgtaatttgaattctttatgtctgtaatttgcatttttctgaagactgctaagatttgagcatcttctcaatgtgtcttccccattattaatcatgttgtgaactactcagatgaatattttaaacataattccatagaacaaacttgtagcccctttgaagtctgagaaccagcagatgaatgggcgagatggattcagaaggaagcaaacaaatgagcaatgttagaaagcagtgacgtcagagtgggaggggtggagatgtcctcttagggagtgtctgagaatttccaggcagctgggagagctgaccccatcagcacaccagctcccccagatgctgtggggtacggaagaggctgcatgccccaagattcgtggcctggagaattcctcaatatctcagcccatggttctcttaaaccagagacagtgtcacgcctataatcccagcattttgggaggccgaggcaggccgatctcctgagatcaggagttcgagaccagcctggccaacttggcgaaaccccttctctactaaaaatacaaaaattaaccaggcgtgatggtgcatgcctataatcccagctactcaggaggctgaggcaggagaatcgcttgaacacgggaggcagaagttgcagtaagctgagatcgcgccgttccactccagcctgggtaacgagagagaaactctgtctcaaaaaaaacaaaaaccagagacagtggttgggcttcagggaagcaggtcgaactgctggggcctcagcctctttgctgtctccagggtgtgcgtggtttgctcctgtcctcagcacatttgatcatgtcactgcctgcaattctgtcatctttgctccaagacagatagatttggatcccttttttcctttttcctcagcaagttcagaaaaagagaaaagtgttgcttggctatttcattacacaccaaagtacaaaatggggaggaagtgtttcctgcatacaccatgggccccaaaaaagaaactcaccattgcccttcccttccctcttctgtcccctggagcttggctcccctctcacttccttgggaccttgttatagttgactcctaaaattgccgccgccatacacacacgcccacatggatcaggggaatctgtgtttagaaatcatcatgaggctgggcgcagtggctcacgcctgtaatcccagcactttgggaggccgaggcgggtggatcacttgaggtcaggagctcaagaccagcctgaccaacatgatgaaaccctatctgtaccaaaaatataaaaattagctgggtgtggtggcatgcacctgtaatcccagctactcaggaggctgaggcaggagaatcgcttgaacccgggagacagaggttgcagtgagctgagatcacgcattgcactcctgcctcggagacagagtgagactccatctaaaaaataaaaaaagaaatcattgtgaggtctacaatgtattcaagactcagaaaaaaggccagggacagtggctcacacctataattctagcactgtgggaggctgaggtgggaggattgcttgaggctaggagttcgaaaccagcgtgggcaacctagtgggactctgcctctacaaaaaataaaaaaatatagctaggtgtggcagtgcgcacctatggtcccagctgctcaagaggctgaggtggaaggatggcttgagcccgagagtttgaggctacagcaagccatgatccactacactccagcctggccgacagagcaacacctgtctcaataaaataaaaaaataaaaaaaagttggttcactaaagatggcaaggatcaggcttcgcagcagatgtgggggtttgcccagccccgatggagcgagccatcctaataacagctgtacagtttcgtggattgtccagtgtgcacactgcacatgccttcatgtttagtcgtctcaggaacacaacagggtgggcactgcgactgcccccggttagagaggaggacgatgaggcacagaaaggttgtcacttgtcccaggtcactgctggtgagcagcgtaatcaggatatgaacggagccctgttgggtcccagaacccctccataagctccacccacaacccctcacccacagagtgtgagcgtttcccaggcctcagagcacccaggttgggagggttgcctccatggtcaccggctgcccagagactgtgcctggcccagggttttagcatgctctcacgctgtcccctgcccagcatgtcaagtttggggtaggaaggccagcaggtcaccgagggctgatccagagaactaggggacaggatcagggcctgctgagggcagagctggggcaggagaatgcaggggcagccaggatggggaggaagctgccctttcacctgtgcatgcattcaactgatgatgccaccaggctgggcgccagggataccgggtgagccaggcaggcatgttttctgccttattggagctgaaagtctggtgggagaattggacaattacagggacacgatgatgataaaacattaacagtaatgccgagtatgaagtggaaactaggctgggcacggtgtctcatgtctgtaatcccagcactttcggaggccaaggcaggcggatcacttgaggtcaggagttcgagagcagcctggccaacatggtgaaaccccatctctactaaaaattagccaggcatagtggcgggcacctgtaatcccagcggctcgggaggctgaggcaggagaatcacttgaacccgggaggtggaggttgcagtgagccgagattgtgccactgcactccagcctgggcaacagagcagtctctgtctcaaaagaaaaaaaaagtggaaactgtcacagtgtgcagaaggagatttacagggtttggggggcatctctgagcaaatcacatttcaggtgaggttggaataatgcaaagaagtcagtggggatgagaacattccagggaaagtgaacagctagttggagaccctgaggtggtggcgatgaggcccatgtggtgagaactgagatcagggaggggacgggcagagtatgtggagcctcttgggccacggggaggcggttgtcctgtactgagagtgggacaggagccgcaggtctcagtcttctgtgcagaggaggggcaggatctgactcgggtgttcccaggagcccctggctacagattactgtcaggtggggtgggagcaggaccaggtggggacagaggtaggcggagatgcacgattctggatatagtattttaaaggcagcgttaaccaaatttcttgatgatgcctagttgtgggcatgagagaagtcaaggatgccacagggggtttggccacagcagctgaaaggagaagccatgaactgagcaggaaaactgtgggagatgcaggtttgggggaaggtacagcccttggcttggccttggccatgttcagtgagaggtgcctgatagatacccaagtggaggtgctgcagggcagccgagttcaagtgtcaagtcaggggcagaggtcagcccagaggtagagcactggagttgtccgttgtctgtggtttttgaggccggatgtgactgccatgggcttcgctctgtagaaatgtggtctcccagagtgactgcccacctcccggggagccagcaccttctgggtgtataaaaatgccccaaagaggaaaaccatcaatggaggcagagcaggtggacaaagaggccagcctccccactttctcgcatccatggttccccagtgaaagccacacacgcggtgacaccctcaactgagactagaccacatccagccaggccattctctgcagtggccctgagtgccctgcctggtcacccgggccaccttccccagcaggaacatgggcccaagagtaccctgggcttgcaccggaggtggcagtgtgattgcaagctcggggtcccacaggcctggtgggcagttctgagttgggcgtatgcttggtgtgtggcctcagcagtgacctcctccccctcagcctcaggtcccactcctgtagtggacatcctaggtgtctctccttccagggcagtttgtggggggtccagtgagataatgccggccaagcccacggcccatcattaggagaacaagagctcctgcccatcgggcactcactctccaccactgccagcattgccgttgttggtgaagccaagggaggaggcagggcttgacagcacaggtgctaaactaggccaatccgagccacacgtcctgcctggccctttcccactgtgcgaccttggaccagctgcttaacctctccgagtcttgttccacatctatcggagatgctcctgatacccacttcacagtggtactgggaggacgcagcagggtaatgtatgcagagtgcttaccatagcgcctgacacagaacacacgcttaatgggaattatcattatgttaatgatcttgaataccatagtgatcaaaagtcagctttggggttaaatcaccggcgttcagctcctcagttagtgcatttgtaatttccatagataatatctaaatgccctccactggggttggtcactttttatgtatgtctttatttattttattttttatttatttttttgagacggagtattgctctgttgcccaggatggagtgtaatggcgcgatctcggctcactgcagcctccacctcccaggttcaagcaattctcctacctcagcctcccgagtagctgggactacaggcatgtgccatcacacccagctaatttttttgtatttttaggagagacagggtttcaccatgttggtcaggctggtcctgaactcctgacctcaaatgatccccccatcttggcctcccaaagtgctgggattacaggcatgagccaccgcacctggccaatttttttttaaggtcagcaagatacttggtccaggcatactgactaggctggagaggttaaaccagttgacatccagagcagctgctactcttttttttttttttgagacggagtctcgcttagtctccaggctggagtgcaggggtgcgatctcggctcactgcagcctcctcctcccaggtccaagcgattcttctgcctcagcctcccaagtagctgggactacaggcgtgcaccaccacacccagctattttttgtattttttttagtagagacggggtttcaccatgttggacaggatggtctcaactcttgacctcgtgctctgcccgcctcggcctcccaaagtgctgggattacaggcgtgagccaccgcaccaggcctgacatccacagcagccactactcttaaacccgcttcacctttggaccagcaattccaccagtagcactctctgtcccacacacaatcccacgcttgctcaaagtcgcatgtagagggaaggccactgtagagggaagactgttcaagataacctaaatatccatcagtaggaaactggcaggtcattgatgtacattcacttagtgcaatactattagggtaacatcacattcaattatgtgaagacctatggtgaagatataaagagaaaagcaagtatagacatattacaaagtgaaaaattaagttgtaggacagtgtttattattattccatttttgttttttaaaaaagttgtgggccgggcacggtggctcacatctgtaatcccagcactttgggaggctgagatgggtggatcacgaggtcaggagttcgagaccagcctggccaagatggtgaaaccccgtctctactaaaaatacaaaaattagccgggcgtggtggccagtgcctgtaatcccagctactcaggaggctgaggcaggagaatcacttgacctgggaggcagaggttgcagtgagctgagatcacaccactgcgctctagcctgggtgacagagcaagactccgtctcaaaaaaaaaaaaaaaaaaaaactatgtacatacaaccaacaaaggattgctaccttgcatatgtaaagaactctactaaccaataagataaaagatagtttgggccgggtgcggtagctcacacctgtaatcccagcactttgggaggccgaggcaggtggatcacgaggtcaggagttcgagaccagcctggccaatatggtgaaaccctgtctccactaaaaatacaaaacaattagctgggcatggtggtgccacacctgtaatcccagctgcttgagaggctgagacaggagaatcacttgaaccctgggcagtggagggtgcagtgagctgagatcataccactgcactccagcctgagcgacagagcgagaccccatctcaaaaaagacagtcaagctcatagataaatgggtaaaggaggctaggcatggtggctcacgcctatcatcccagcactttgggaagctgaggcaggaggatcacttgaggccaggagttcaagaccaccctggatgctgtagcaagacctcaaaaaaaaaaaaaaaattagccaagcatggtgatgcacacctgtagtcctagctacttgggaggctgaggcgggaggatggcttcaacccaggagttcaaggttacagtgagctatgatcattccattgcactttagcctgggtgacagggagagagggaaatgggatattgcacggcttcagtgaggccctcagaacggtgtctggcacatagtatgtgctgagatgtattctctgttactgagtgttgcactccaaggtgtaaattgatggggtcatgccgtgggtgagcagacagtctggcaaagggtccagattcttcaggccctggcctgagtcactcctaaccactggtgtgtctcctgttttcctacagagcctttgtggcatgtgcctgcccaggccaggctctcagccatagccggaagcagcgggaacaagcacccgtccaggcaggatgcagcaggcaaagattcccccaacaggcattccaaagtgagtctgggccccaccctgccctaccgggggagccaggcctgcctgggtgtggcctctgagcttcacacttgagcacatcctcaacctctgccaccttccactcagcagaggggttgaatacttggtctgagttggaaccaaccaggttcacattctggctccagccctcatcagccaggtcatctagggcaaatccctttacctcctcgagccgcagtttcctcattgttccatcagtcatggtaaatcagctgctgtaacagacagccccgaatctcagtgacttcatacagtggaagtggatttccctctcctgtaacagcgcagtgcaggtattcagtgagcatctacccgccattcacgtggtgattcagagcccaggctccctccctcttgtggctctgctgtccctcagaggttccaagccctctgctgggtccctgcgtctttccagcagtggaggtgagtgggagaaaagatcacatgggaggtgttttttagcccaggcctggaaatggcatgaatcgcttccattccatcacgtggccacacctagctgcaagggaggctgggaaatgtagtcttgcatggcccaggaaggctggggatgtagtcctgtgtgtccaggaggaggagatggtttgcaggggctcttggcaatctctttgtatccattcgttcagtgggtgtttgacaagcgcttacaacactccaggcattgggaccatgatgatgaagaggacagaccagccctgtcctcaggaagctgacttcccatttggggcagcaagcagtaagcagataaacagatctgttgtataagaaaaagtgcgggctgggcgcggtggctcacgcctataatcccagtgctttaggaggccaaggcggacggatcacctgcagtcaggagttcgagaccagcctgggcaacctagtaaaaccccgtctctactaaaaatacaaaaattagccaggcgtggtggcaggaacctataatcccagctccttgggaggctgaggcacaagaattgcttgaacccaggaggcagaggctgcagtaagccaagattgcaccactgcactccagcctgagcgacagagtgagactctatctcaaaaaaaaaaaaaaaaaaaaaacagtccaggggagagagtgacaagcactgcagctcaaggatgatgtggtcagagagggcctttgagggggtgacctttgagcggaaaccttgagtgaaggaagggggaggcccacgaagatctctcagggaagagtattgcaggcagagggagcagcaggcgcagaggccctgacggggagtgcccagtatgttccgagaatagcaagggggccaccatggccacagcaacgtgatcgggagggaggggagatgaagttggagaccgggacccaagcatcaaagccccatgggccatgctgggaactctcacttgtgcctggagtaagatggagccacaggtgggggtcatcatctaactcaggtgttctcagccttctgctggctgcgtgtggggaataaacagggggatgagggtgcagagagaccagggaggaggctgctgcactggccccagggggaggacaggacaggcatggacaggaccacgcggagccgtggagcaggaagtgacaggtcccggatctgtgttgaggacgcgggcagcagggtttgctagtgggctggacatgagtgagagcaaaagcggggtcaaggtgagtccacggctcttggcaggggcagctgaaagcatggccggcgtcattgagatgaggaagacgctgccgaactcagtcttagattcgctgagtctgagatgtgggaagcatgttctgtgcctgatgtcatttgttcctctgagcagccccatgaggcaggcttactatcaccctccattttacagatgtggaaactgaggctgagggaaggtaaatcacttgcccaaggtaacacggccagtagatgagaagccaggatttgaagctgtctggtcccagggttcaggcccaggcagagggaggacccggcaagggaagatgcgcccctgccctggagtctgggaatgacacgcttctcttgcctctcagggagaacctcaatactcaagtcattccagcagcaacaccctctccagcaacgcatccagcagccacagcgacgaccgctggttcgaccccctggaccccctggagccagagcaagaccccctctccaagggtggctctagtgacagcggcatcgacaccaccctctacacctccagccctagctgcatgtccctggccaaggctccacggcccgccaagccacacaagccccctggaagtatgggcctttgtggcgggggtcgcgaggccgctgggaggtcccaccacgcagacaggcggcgggaggtctcccctgcccccgcagttgccggccaaagcaagggctaccgaccgaagctgtactcctccggctccagcacccccacgggactggcggggggcagccgagacccaccgaggcagcccaggtaagctgttgcacctagtctgggttctaaccaccttccacttcgccagttctacttttacggtcctgatggtggggttctcctccccagaaacacactcacggatgaatgcgcctagtcattggtttgctgacagaattgaggagctcgtggatctctgccttattgcccatccatcagcattcagggaccccaggtggagggaaagaaacccctggccttctgtctctgttttcatctgtctctggttctctctgaccctctgtctcttttttctttgctctctgctgataccaaaagtttttatgctttctaaagggtcacagactgtatctgatagagtgtatttggctggaggcaataggaaacctgaccctctgtggcttaaacaaatagaggtgtaacaaacagtcccctaacatgaagtccagagaaggcagagccaggctagtgctgtggcttgtggagagcctcaaggattggcactctgtgtctccctgctcggcatctttaccatgctggctcatgtctcacttgccttgagatggagctgtgctgcctggtgagtggcagttggggacagagaagaggggaaagttggaagcctctgagcacctttcccttcctatggagaaagcaaacactttcccagaacccctttcagcagctggcatcacggggccatcccagctacaaggaggtctggaaagttgtagtttggtcttccaggctctaccgtatacggcgatggtccccacagaagccctcaaaggcttgttcagcccagctgctggcccccacccagagtttctgattcaataggtcggagcgggagacctgagaacgtgcattggtgtttttttgtttgttttttagacggagtttcgttctattcaccaggccggagtgcagtggtgcggtctcaggctcactgcaccctctacctcccaggttcaagtgattctcctgcctcggcctcccgagtagctgagattacaggtgcccaccaccatgcccaactaatttttgtatttttagtagagacagggtttcaccatgtcggccaggctggtctcaaactcctgacctaaagggatcctcccacctcagcctcccaaattgctgggatcacaggtgtgagccaccatgcccggctgagaatatgcattaagttctcagtaaatgctgatgctgctggtcccaggaccacactttgagagccactggtagagaggcagacgggagtaagagagaaagagtaggcattggctggaaacggtggctcatacctgtaatcccagcactttgggaggccaaggcgggtggatcatgaggtcaggagatccagactgtcctggccaacatggtgaaaccccgtctctacttaaatacaaaaaaaaattagccaggcatggtagtgggcgcctgtagtcccagctacttgggaggctgaggcaggagaatcgcttgaacccaggaggcagaggttgcagtgagccgagatcgtgccactgcactccacccaggcgacagagcaagactctgtctcaaaaaaaaaaaaaagaaaagaaaagaaaagcaggaattggcgagccagcagcctagagtcccgaccacacacactgacgttcggatggaggcaatgagccaccttccagaaaagggcacagagatggaaagagtattctacacagacacagagctcagcctcatccttggacccccttagggttctgtgaccccagcagggcttgctgtgctgtagtgtccagtgccagcccctgagtccacagccccacatcccttcctgaccatgcctggggtgggctagcctgagtccccgatagccatcagggctcagaacctggttggcgcagggatcttcctctcctgtggcgccctaaagccttttccagtcctcaaaccccagcctctctccacacaggacacccacactcaggcagccaactcagacttctgaccacagtccacagtagaattgtgtccatctatacagaaatatctatgttaaaaaaaaaaaaaggtggctttgagcagtggctcacgcctgtaatcccagcactttgggaggccaaggcaagcggatcacaaggtcaagagctcgagaccgtcctggccaacatggtgaaaccccatctctactgaaaatacaaaaattagctgggcgtggtggtgggcacctgtagtcccagatactcgggaggctgaggcaggagaatcgcttgaatctgggaggcagaggttgcagtgagccaagatcatgccactgcactccagcctggcaacagagcgagattccatctcaaaaaaaaaaaaaaaaaggtgaagcagtggtttccaaaataattcttaacctgtgtgtgatatactttgatccagtctactctatttaaaaacttttaatgctgatcaatccccactcagatgatttcatggcttacagtgttctctgacagatatttgaaaaccactgtgtttgagtgattgtagtgtcagcacttccccgggcacactgtgatccaagggtctccttgagtcaaagagccaggagaagggctgaaggaggaaagaggagacagacagagagagacactgtctgagtgttttagacctctcagttcatctccctagacaagtggctgtttgttttttagaaacagggtcctgctctattgcccaggctggggtgcagtagtacgaccatagctcacgatagcctcgaactcctcagctcaagtgttcctcccacctcagccccctaagtagctgagactacaggtgtgtgcccccatgcccagctaattttttaagtttgttagtagagaaggggtctcactgtgttgccaaggttggtctcgaactcctgggctcaagcgatgctcccatctcggcctctcaaaatgctgggattacaggcatgagctaccacacctggtgacgagtacctcttaatcttttgaacatgtggactcttttgaatggctctttcattcatttattcattcactccattcataagtatttcttagggatttgctcggtcccagacactgtgctgggagctgagagaaatcaggagcacatttggatgaggcctccccaccgcccactgtcaaatgagggaagcagatgagaatcagataatcactgagacaaatgaatacgtgtgcgctcccaggccgggcacggtggctcacgcctataaacccagcactttgggaggccgaggtgggcggatcacctgaggtcaggagttcgagaccagcctggcccacatgatgaaactccgtctctactaaaaatacaaaaattagccaggcatggtggtgggcgcctgtaatcccagctactcgggaggctgaggcaggagaatcccttgaacctgggaggtggagggtacagtgagccaagactgcaccactacactccagcctggggaatagaatgagactccatcttaaaaaacaaaaacaaaaacaaaacaaaacaaaaatacattgcactccagcctgggtgacggagtgaaactctgtctcaaaaaaataaaaaataaaaataaaacactgtggaaaaaaaaacaaaaacctgtgccacgaagagggacatgaagccaagagagtctataccaggggcctcaggtctcgattgcagtagcccccattccaggcatgggaccaccaccttagcgaacccgaacaactgggaggatttgaaatccgagacataaagacagccaggcctggagtagactgtggctgagatgggagggtgggtatgaaataaccctgtgtctaaggaaaggatctgctgaacccagaaatgaaggcaatgaaatgggagaggagcccgctgcagaagagggccctgcggttgggagctttaatttgcatacagacaattgatgctaattgcaaatcattcttatctgctcattaaagctgcttcctgaagttttctcctaggcaaccaggcttgagtgtggcacagcatttcccaaaatggggtgcttgaggtgatttgggtggtgcggggaggaaaatgttttattttaaatggatatatgcttgctttcatgagtattaggaaaaagagtttgcaactcaccccctgattttacagataccaccttggacaagttaaggagaaaataaaatgagttgatttaaaaaaacatatccaggcccggcgcagtggctcacgcctgtaatcccaacactctgggaggccaaggcaggtggatcacttgaggccaggagttcgagaccagcctgaccaacacggtgaaaccccatctctactgaaaatacaaaaattagccaggcgtggtggtgcacgcctgtggtcccagctattctggaggctgaggcgggagaatcgcttgagtctgggaggcagaggttgcagtgagccgagatcacgccattgcacttcagccttggcaacagagtgagactcagtctcaaaaaaaaaaaaatccatgtggataagagtgtggcctttagtgtcagcccacctgcattcaatccctccctcagcgacttcttggctgtgtacccccaggcaagtaactgaacctctctgggcctcagtttcctcatctgtgaaactagggataaaccacatacctacatcatagggatgtggtaaagattgaatgtacccttagaacagtgctttgacttgaagactgcctgtcagaatcatggggtatgagggtgtatttgaaaaacacacagaaatgaggccttgcctcaaattcacgaaatcagaatatcccccctggtccaagacctgttacaggcagtgctggggacacagcggtgactgggggagccccagtcctgcctgactgacgcattcccagacagagacagcccagaggggtcaggtcaagatgggcgaggcccaggcagaggggtcagggtcagggtggggggcccaggctaaggggtcagggctgggatacaaggcagctgcgaagaggggtcagggtaagatgaggggcccaggtagaggggccagggtgagatgaggggcccaggtagaggggccagggtaagatgaggggcccaggtagaggggccagggtgggctggaggggggccaggcagaggggttggggccatgatggaggggtacagggatgtgagagcccaaagggggcccccctaacccagttgtgagaggggccagcccagttgtgggaggggctttcctggagaaagagtctgagctagccagggaagtcaggagggaaaagcagtccagacagagaatgagacggactcccactgtccatctcaccccacctcactccattggcctcccacagtcttcccatttcagtaggcacaagttccctggatggtcacagagccacctgcttggggccagaccttggttcaagtggccacacgtgcctctgcctcccatggcggccacactgcactgtgcaccgggcagcccagcagcccccctcatgtgctgtcgtcagaacgtgcccctgggctggagtgacagcctgctccccagcctctgctcctggaaggcaggcacctttgaacaggcccagcatgagcactcattgactgccctatgtctacctccacagcactctgtggcatagaacttggtatttattcacacagcgagcgcctgctgtgcaccggggcctctgcagggagctggaacaggcagaccagatccccaccgtcctggtacggacggaggcccatgggaaacagctagtgaataatgccaaaagtcatgaatgaattgtgccaggggacagcctgcagagacgggtggggtctgagggtggatgggatgcagagctggaggaggtgtctaatctagcctagggccagcgataatgttcctgaacgagggtcacatctgccaaggatgagggggacagggaggagggagcgggtgaaggaggagaggggttcagtggggctggagagacattcatctgggatgcagttatacaggtatttgctctgtttttgaaattgtgtgtatatatgcaacatatatatagacacacacactttctgggcctcaatatatgttgtgaacctcagtatgtatatatacaactatgtatatatacacacatatgtttttttttaagtctgttgaatttctcattcagaagaatgtatatatgactatttaccattaacaaaaaaacagaagggaaagatgaggcgtggagaaagtatgtctatgaattagagttgcgtgtgcaaagtccctgtggtagggaggagggtggtatcgtcaggccactgaacacaggcccttgggctcaagtatagaaattgtggctgggcacagtggctcatgcctgtaatcccagcactttgggaggccaaggcaggagcatcacttgaggccaggagtttgagaccagcctgggcaacatagacccatctctatccccctaccaaaacttttttttttttttttttttttttgagatggagtttcgctcttgttgcccaggctgcagtgcaatggcacagtctcagctcactgcaacctctgcctcccaggttcaagcgattctcctgcctcagcctcccgagtagctgggattacaggcacctgccaccacgcccggctaatttttgtatttatagtagagacagggtttcaccatgttggccaggctggtctcgaactcctgacctcgggtgacccacccaccttggcctcccaaagtgctgagattacaggcatgagccaccatgcctggccaaaaatttttttaaattagctgggtatggcagtaggctcctgcagtcccagctactcaagaggctgaggtgagaggatcacttgagcctggaagttcgagacagcagtgtgctgtgattgcaccactgcactccatcctgggtaactgattgacaccctgttgatcaatcaatcactccatcctgggtgacagagcaaggccctggaggtaggtaggtaggtaggcaggtagggcagccaatgggaggttggggaaatcagcagtggccagaacattcagggccctaccagctccattatggagtttggatctcatcttaagagcagccagggtaatgcgggtggatttgtgttccaaaatatggtgctggcagcgagacaggaggcaaagtctctgagggggctgaggcttggatctgcatgggaggacgtgggcctgagctggaggacaaagcaactgtggatgtggcagcaggcggcattgccaggaagtaagctgggagggagatgcaggcccagggcagagccagcaagccatgtgagagtccagggtggctgccacgtgtctggaggctgccgtggcctgggagcacctgaggtgcttgtgagaagaggaggcagagtggggcagccagcggggactgattcttccagtcactgacctttgcagcccctactctgtgccaggtgtcgcagcatccttcccttatggagctgtcattctcctggagacaggacaagacagacagacagccgaaccaccgtggagtgtgccaggaggtgataagtgctggggaggaaaggcaaaaacagcgggtctctgggaaggcttctcaggaggtgatgcgttgtaggaagccagggtgagatccaggcagtggaaacagtagatgactagaccctgagggtgaacttactctcaatgctccagaaatggtcaggtggccagaggggctgaagcaggtgggatggggggagagtggcaggaggtcagcatagtgaggtggcaggagcctggttctagcgggcatattgaccaaagtcagatgctgggatttggttccaagggacatgggagccatgggaggcatttgagcacatcatctgacttaatgtttttaaaaagattactgtgggctggacgtagtggctcacacctgtaatcccagcactttgggaggctaaggcaggtggatcacttgagcccaggagttcaagaccagcctgagcaacatggcaaaaccccatgtctacaaaaaattagctgggtgtggtggcacacgcatgttgtcccagctacttgggaggctgaggttggaggattgcttgaccccgggaagtggaggctgcagtgagccgagatcacatcactgcactcagcctgggtgacaaagtaagaccttatctcaaaaaatgataataataaaatgtaaaaatgaaaaaatagaaaagatcactgtgggctactctggagaggacggactatcttgggcagggggaggatggtggtcagcattcaaaggctgccaggagagggatgggtcctgacacgcccaagcggggagccccctaccctcccttccccgggctgcggcccttgccgtggaagcaggtgcagcctgtagcagcttgtgcccatcgatgacctcacagatgctccctccagacattcgtcatgggagcccagctgccaggcatgctgccaggcgccagtgcctgccatgggcaccgcagtgggctgagtgatcctgggcgggcagccacctggccctcgccctctcctgaggcagcacgcactccagagctttctgggcttccagagcaatttgtcagagctgttaggagcagtcataggctctcggctccacatggagctgacgcagccgggcgttcccaggcaggcaggaagcacgtggccttgcttccccaggctgcgccaggagtccctgggatgcccttctggggacacagccctgaaaggtaatctgagggcctgaagatccaccggggcccaccctgcctgtgagtgttgggaggctggggtcacctgagacagagacctcctcggagagtcacagcttgggaagaggaagcgaggccgtctcctggaactcaagggagtgcggaagccaggcagagatctgcagggcggggagcagtgcaaaggtcccaaggtagcagtgtttctgatgtgtttgaggaacagcttccgcatggctggagcagagtgaaggagagggagtgtggaggagctgggggcagagaagagaggggggcagatggggggccctgtcgggagggctctgggtcttacccagagtgaggtggaaccctgagagagtcctgatctgattcacatgttcccaggatctctctggctgtgtgctgaggctggggaaggatgcaggaggaagagggagccaggaggaggccgctctgacaatacaggtggcagtggttggtggaggtagcgagcagtggcttgattggtatctctgttgaatctcttgcctagaccctctctgtgtctgcttcctgaagacccgtcgcttctgccccacaggccacaggggcaatgtggctgcttacggctcctacactggagcacaattccagccgcatgcagggatgaattggttctccagcccatgacacacgtcagggagagaaagcaagattggtccagggtgaaggccaagtggctgggggccctcggggtatgtgggtgagcagtgtgacttcagggctcttcctctgactgcctatgtctacatcacagctccacctcttaccccaactgcgtgatctctctcaggccccttaggtgctctgaggctcaatgtcctcatctgtaaaatgggggtaataggatctgtcaaccagacacggtggctcgcctctcatcccagcactttgggaggccgaggcgggcggatcacctgaggtcaggagtttgagaccagcctggccaacatgatgaaaccccgcctctactaaaaatacaaaaattagccaggtgtggtggcgggtgccagtagtcccagagactcgagaggctgaggcgagagaatcacttgattgcagtgagctgagatggcaccactggactccagcctgggtgacagaactagactctttctcaaaaaaaaaaaaaaggatcctccatctaaagttgtgagggcgaactgagaccatgagtttaaagcacttatcacaggactggagacatagctgggctcaagtgtatcagctgctgctgtgttttattctcatgtattatgtattgatatttatcgttaacagttgttgtcactgggagtacagaatggtggttaaaatatcgtctctcaaaccagactacctatgtctacatcctggctcttatcccccactagctacatcatttcgggcaagttatttcatctccctgggcctcagtttcccccacctggaacatggaggtggtggtagttcctgtctcggggttgctacggcggctaagtgaggtgacgcctataagatgcttagaacaaggccaggcagcttccacaggctcagagtggtcagcactgtcactgccacctactgtgccactgctcctcctggaggcagggaccacagctcgctccctgagagcctgtcacccacccaggaccacccattggtccccttcagagtccccaggctgaacagaccaaaagcattgcacacacttatgcagctggtatgatttctctacccagcctctggtttttcagctttttttggaagcataaatcctttgactccaacaaaatgttaaatgctcccctaagatgtcaagcaggttaatgcatagctctctggttgaaggtgaggatggaagcacagagcacgttgcctgcccctcccccgctaccaccagtgctgtctgagcccagagcccagggacccaccacctccctggcacctgcagctccgcggttcctcctcaggactcagtgctgagcacttagcacataggatctcgtgaggcaggtgctgtcattgcctcatttctcagaggaggaaactgaggctcactgaggggaatagaccccacgcaagttggccactgtgttgatgggagccaggattggaactgggtcaggtggacagcaaagcccacactatgctgccccagttttcaagttgatattgagacttcaggaggacgcatgggcacactggcgctccagaaagaaagaacgttcaggctgggcgctgtggctcacgcctgtaatcccagcactttgggaggccgaggcgggcggatcatgaggtcagaagttcaagaccagcctgaccaacatgatgaaaccccgtctctactaaaaaatacaaaaattagccaggcataatggtgggtacctgtaatcccatctacttaggaggttgaggcaggagaatcacttgagcctcctgagtagctgggattacaggtgcacaccgtcacacttggctaattttttttttttttcaagtacagatggggtttcgccatgttggccaggctggtctcaaactcctgacctcgggtgatccattcgcctcagcctcccaaagtattgggattacaggcgtaagccactgcacccggctggccacttactttttaccctgtgccatttatgtagtttaattagactttttttagggttggttttttttttgttttttttatttgcttgttttttgttttttttgagtgatggggactctgtcacccaagctggaatccaatggtgcagtcatgcctcactgcagcctcaaactcctgggttcaagcgattctcccacctcagcgtcccaagtagctgggactacaggcatatgccactatgcccagcttaatttgacttttattccgtacatgttccccatcattactactttcagagagaatccattagtgtacactcctccagagatttttctctaaacctttaccaacccagttctttcaaacataccacttaggccaggcatggaggcttacacctgtaatcccagcactttgggaggtcaaggcaggtggatcacctgaggtcagcagttcaagaccagcctgaccaatatggagaaaccccatctctactaaaaatacaaaattagctgggtgtggtggcacatgcctgtaatcccagctactcgagaggctgaggcaggagaatcgcttgaacctgggaggcggaggttgcagtgagccaagatcatgccattgcactccagcctgggcgacaagagtgaaactccgtctcaaaaaaacaaacaaacaacaaaaaaacaaacaaacaaacaaaaaacatgccacttaacccttaccttgcaagaaatacagtgactttttaaaaattctagtttagctgggccgggcgcggtggctcactcctgtaatcctagcactttgggaggccaaggtgggcagatcatgaggtcaggagatcgagaccaccctggctaacacggtgaaaccccatctctaccaaaaatagaaaaaactagccaggtgtggtggtgggcgcctgtagtcccagctactcaggaggctgaggcaggagaatgacgtgaacctgggaagcggaggttgcagtgagctgagactgcgccactgcactccagcctgggtgacagagcaagactccatctcaaaaaaaaaaaaaaaaattctagtttattttgccaggcgcagtgactcatgcctgtaatcccagctctcagagaggcagaggcaggaggatagcttgagcacaggagttcgagacctgcctgggcaatttagtgagaccccattccccacaaaaagggggaaaaaaggacaaaaaaaagtataaaattctactttatttctttttttctctatacatatgtgtgtatatctatctatatattttttcccttaaatacacagaatcatgttttataccatgcatcgtttccatttactatagttcagaccatctgtcctcatacataaacagagattgacctttgcactggctgcatagtttttgatcataaggatatgcttgcggcagggcgcagtggctcatgcctgtgatcccagcaccttgggaggtcgaggcaggtggatcacttgaggccagaagttcaagaccagcctagccaacatggtgaaaccccgtctctactaaaaatacaaaaattatccaggcatggtggtgaatgcctataatcccagctactcaggaggctgaggcacaagaatcgcttgaaccccggaggcgcagaggttgcagcgagccgagatcacaccactgcactccagcctggccatttccaacttttcctgattataaacagtactacagagaccgtcctcatacctgcctgtgtgtgcttgtgcaggcttttggtgtgtgtgtgtgtgtgtgtgtgtgtgtgtgtgtgtgtgtgtgtgtgtgtgttttgtagctaagactatgggactatgggcatgtgctattattcctggctatttttatttttttgtggaggcagggtctctagggctgggcatggtgcctcacaactgtaatcctagcactttgggaggctggggtgggaggatcatttgagccccggagttcaagaccagcctgggcaacatagcaagaccccgtccctagatagagtctctacagcaactcctgggctccagcagttctcccacctaagcctcccagagtgctgggattacagcatgagccaccatgcccggccttgtgcaggcttttctattgcatggatttctgggaggccaaatgtcttgtttttgtttttgagatggagtctcactctgtcgcccaggctggagtgcaatggtgcgatctcggctcactgcaacctccgcctcccagattcatgccattctcctgcttcagcctcccgagtagctgggactacaggcgcccaccaccatgcccagctaatttttttgtatttttagtagagacagggtttcactgtgttagccaggatggtctcgatctcctgacctcatgatctgcccgtcttggcctcccaaagtgccgggattacaggcatgagctaccacacccagccaggccaaatgttaagctgaagccagtcatccttcagttctcagttctgatgctcttgtctcctggggaaagcattcctgaccattcttggtgttacatgcttcagtagttccctggacatctcctcaccaatgcctactctttgctccattgatagatgttgctaaattgtggaaagcattacatagttgctgtttcaatccagtcggacaatccctgccttttgatgggagtgttcagaccattcacgttaaatgtaattattactgctaatggttggatttgcattagccattttgctattgtttctgtatgtctactatctttcttgctcctctgttcttccttactgccttatactgtagtaaataaatacagtttcaggccggatgtggtggcttacacctgtaaaatcccagcactttgggaggcccaggcgggcagatcacctgaagtcaggagttcgagaccagcctggccagcatggcaaaaccctgtctctactaaaaatacaaaaattagctgggcgtggtggcatgcacccgtaatcccagctactcaggaggctgaggcaggagaatcgcttgagccagggaggcggaggttgcagtgggccaaggttgcaccactgccctccagcctaagtgacagagtaagactctgtctcaaaagttaaaaataaaaaatatatataatttagtataacatttggattctactcttgtgtaactatctttttagttattataatgtgcgtctatcactgcaattcaggttaatactaaattccaataaaatataaaacttttctccaatattgtcctatttccttctcccttttttgtgctctgtttatcataaacatccatatgtgttttaacccagcagtatagtattgtcattattgccttatacagtcttatgtctttaaggaagttaagagaagaaataagaaagcatatacttttatagaatcttattttaaaccacagtttgccatcttgggctattcatttctgtctactgactcaggtcattgtctagagtcatttctttcagcctgaggactttttttttctttttttttagatggagtctcactctgtcacccaggctagagtgcagtggcgcaatctcagctcactgcaacctctgcctcctgggtttaagcagttctcctgcctcagcctcctgagtagctgagattacaggtgcccgccaccactcagttaatttttgtatttttagtagagatggggtttcaccatattggccaggctgcgagctctcctgacaggcgatccacctgccttggcttctcaaagtgctgggattaacccgaggagttttaaaattattttgtatcaggcaggtgtgctagcaacaaattctctccatctctgtttatataggaacatctttctgttgccttcatttttcaaggatggttttgctgggtatagaattcctggttaacagttgttttctttcagcactttaaaagttacattttatttcattcttttaaatgagaagtcagcaattaattgtgtttttttttcttttttatagaagtggggtctcactgtgtttcccaggctggtttccaactcctgggcttgagtgatcttcccgtcttggcctcccaaagtgctgggattataggcctgctaattgtattgatgctcctctatatgcgatgcatcatctttttcttgatgctttcaagatgtttatcttagcatttttctttttttcttttctttttttttttttttttgagacaatttcactctttttgcccaggttggagtgcaacggcataatggcgtgatctcggctcaccgcgacctccgcctcccgggttcaagcgattctcctgcttcagcctcccaagtaactgggattatatggatgcgccaccacacctggctaatttttttgtattttagtagagatgtagtttctccatgttggtcaggctggtctcgaacttctgagctcaggttatctgcccgccttggcctcccaaagtgctggaattacaggcgtgagccaccgcgcccggccagcatttaactttcaactccttttctaggtgtgaatctctttgtatttttcctacttggtgtttgttgagcttcttggatgtgtaaggttttcatcagatttaagaagtttccaaccattatttcttcaaatattttttctgccccttctctcctctccttccaaagttcctgatgcacatatgttggtacccttgataccgtcccaaaggttctgctctggaagaacttcttcactcactgagctgggaagaggtggggggaggacaaaatgcgacaaatttcctctgttcttccctaaagttcagtttctcaagcatacatgcttctcaaattgttgtatgtgtttggtcaattttcggagtactgaaatggtcatttgtggtcaatgttgtcatctctggggagatgtgccagtcttctcatttgactgtagtcaaagtaccatcctgtgatactgctaaattgaccctcaaaagggatttattaacttatatatataatcctagctgggtgtgctggcacatgccgtgttcccaggtacttaggaagctgaggtgggaggatcgcctgagcccaggagttcgaggccagcctgggcaacatagcgagaccttgtctctttaaataaacaaaaaaccaataatcctcccacccatcccccacaaaatgcccccttttatatacacatgcgtatgtttttgcatagaaaaaggttgaccgggtgcggtggctcacacctgtaatcccaacactttgggaggctgaggtaggcggatcatctgaggttaggagtttgagaccagcctggccaacatggtgaaacgctgtctctactaaaaatacaaaaaacttagctgggcgtggtggcacacatctgtaatcccagctactggggaggttgaagcaggagaatcgcttgaacccgagagactgaggatggagtgagctgagattgcaccactgcactccagcctgggcaacagagtgagactctgtctcaaaaaaaaaaaaaaaaaaggttaagggccaggcccagtggctcatcctgtaatcccaacactttgggaggccaaggcaggcggattgcttgagcccaggagctcaagaccagcctgggaacatagtgaaaccccatctctacaaaaattagctaagcatagtggtgcatgcctgtagtcccagctactcggaggctgaggtgggatgatcacttgaggctgggaggtcgagcctgcagtgagctgagatcgcgccactgcattccagcctgggtgactgagaccctgtctcaaaaaaaaaaaaagaaaggttaggaaggaaatagagcaaactgtaagccatagttccctgtcgagatgggcaggaggtaagatccccacctttagctgcgtaggttgtaccaaggagacgggagtgaatttttcagattcctatagaggaaccaaatgtgctagaaggccatccttgggtgggattaggcgctgtgcaggcagtcttcccttttctacagataggcgtctatactgttggaattttccacagcggtaatatatttgtgtctgtcttgtgcaaatgaacttttttgattcccaagagtaaacttcaatagctctgtcttgccaaatgtggaatggatttggttttttttatctctttcatttttgctttgcagtgacatgggctcgagggttggctaccccgctcaggtttacaaaactgccagtgcagagactcctcggccctcccagctggcccagcccagcccctttcagctctccgcctccgtccccaagtccttcttctccaagcagcctgtacgcaataagcacccaacagggtggaagagaacggaggagcccccaccacggccactccccttcagtgacccaaagaagtaagtgcctggacgtccagcgaggcgcccgccagatccacaccagggcgtctccggggcggaaagagggtgatgccacatgctgtcattgcacagacgactgtgggccagtgtaccagtgtacacactggggctgcagctgcaagcaggacaggcgagaacccctcttggggagctggcattccatttggggtgaccaacaataagtagaataagagaagcacgcaataggtcaatggtggttatccttgtgccatatccgggtgtggaacattccagggagaaggcatagcagctgcagaggtcctgaggcagtgagtgacacggttgcctgtgggcaggccggggtggctggaacagtttgggccaggggagggtgtgggaacatgaggtcagggagggatggggacagaccatggagggtcttgagggccacgtggaagggacttggcatcttccctgactgagatggagccacgggagggcatggagcagagagggggcaggatctaaattgggcattccagggtcgctgtggctgcgtgtggggaacagcctgcgaggagcagggaggagctgctgtcatggtccaggcgcagacgaaggggcgggagcagggtgggggcggagagggtgagaagggggcggttccggatagattatctgaaatggagcagaccgggcttgctggcagggtggatgtggtgtgagagaaagagaggggttgaggatggtgcgtcgtcttgaagcccggaggacagacttgccttgagtggggagcaggcttggggaaggcacagtagctcaatcctggatgcttcggtgcgagattcgcaggagacatccagacggaggcgtgaggggggcccttgagtaaggaatcccgaattcagtggagaggtcaggctggagggagaactttgggtgttatcagcctagagctgcgaggctggaagagcccctaaggcagggtgtggagagaggagaaatgtgggactgagactgaaaccccttgatgttgagccaaagtgagaagccggggaaggcggggaggtgcggaggcggagaggtgcggaggcggggccagggccaggagaggcggagctcgggcgaggaggctgggcccaggccagggtgatgagactgagaaccgactatatagggttaatcctcccagaggtcgccggagggttcaggagaaaagggtgaggcagaattgaggagctgcgtgagcagttcatttggggcattttgctttaaagtgaaagaggagaggggtgtgcagttgagaaagggttttgtttttcagtcggaggatacaggagctaacattgcctgagcactcaccacatcgaggttcagttctaagtggtttgatgcgaatgaatttactggatcccacaacagctccatgggggtggacctgtcctccccccaccccacccctttttttttgagacggagtttcattcttgttgcccaggctggagtacaatgacgtgatctcggctcactgccacctccgcctcccgggttcaagcgattctcctgcctcagcctcccgagaagctgggattacaggcatgcgccaccaagcccggctaatttcgtatttttagtagagacggggtttcaccatgttagtcaggctggtcttgaactcctggtatcaagtgatctgcccgcctgagcctcccaaagtgctgggattacaggcgtgagccactgcgcccggcccctgtcctcccccttttacagatgaggcagctgaggcccagagtcacagggctggtgaggaacacagcctggatcagagcccaggaagcctgggtcaaggctcacgtctcttgagtgaggggctctgccctcctccatcctgttctttgtagtgtcatctttcatgacctacatggagacattcaaatccggggatgacacagagcttggagggagagacgtgtcaggagacagaaacagtgtccctggagatatcagcaggcaagtgtgctgagctcacactgagagccagaggggattctgaaaactagactgatgattaaaactgcttaaaaactcagcagcctccccatgctcccgggattaatgatgcaggctcacattgactacacacgtttataccaggcgccatgttctttgccgaaactcccgctcagagcctggatgatctgcccctcacctctgccctcgttcccatccactctcccctccttgctctgttccagccacactggcctcttgctgttcctcacactctccacgtccaggcacaccccagggcctttgcactggctctcactgctgcctccagtgagctccctccagatcttcttgggtgcagctcatgaggactcgctctaatgccaccccctcaaacaggtcctcctggccttcagtagcccaggctgtcattctgtgtcactgtactctgttccacatcccgtgtcccccatgggaaacaggtgccaccgtcttagtcacaaggcacttgtaacgtgcctggcacacagggcatgctccatcctgaacataagacgtgtggatcttgtttgattctcacgtgaccccaataagtagatactataaggcccccacttttcagtgtggcccaagttgggccctgctgaaccctgttaccctcctcaacaatcacccgtacacactgcttcctctgcctggaacccaccccccaacccgcacccccactctaggcccactcctgcccacccatgttaatttgctggggcagccgcaacaaactaccacacactgagtggcttaaactgcagaaatgtatcatctcacagttgcggaggccagaagtccaagttccaggcgtcaacagggtggttccctccaagggcggtgagggagaacctgttcctggcctccctcttagcagccggtgggtgtcagcacgtagattcatcacccccgtctctacctcctcttcgcatgatgttctccctgcatctgtgcccacatttcctctttctgcaaggacgccaatctaacgggattaggggtctaccctaatgacctcattttcacttgattgcctctgtaaagactctgtctccaaatgaggtcacatttggagatgctggggcttaggacttcaatgtagctttttgtggggccccagttcaacccataacaccactccttgggtatcaacacagacacgcctttcttgcagaagttgtctgaacccccacaccaggctcagcccacccccagcacctgtcccagggcacagcgaccgccactcccttggcaacttgcttcctctctgtcacccccatggggcccagaacagagacatcctgaacctcacccagaccacacacttagtaggtgctcagaagatgtacctggagagacaacaaccctatccaacaacagctttcccagtgatgaaatccagagatggcttgtatatgtgtgtgttggtgtaaacatatgtaaactaagcatataaaatatcagcaggagacacaaatgaaatcgcttcatagttccttttaatatttatttatttattaatctatttattttatttatttatttttgagatggagtgttgctctgttgcccaggttggagtgcagtggcgtgatctcggctcactgcaacctccacctcctgggttcaagcacttcttctgcctcagcctaccaagtagctgggactacatgcgcataccaccatgtctggctaatttttgttttgttttgttttgttttgttttgttcttcttaatttttgtatttttaatagagacggggtttcaccatgttggtcaggctggtctcgaactcttgacctcaggcaatccgcccccccttggcctcccaaagtgctgggattacagttgtgagccaccgcacccggccccttttcatatgtatttagttgcagatacattttaaaaatcacaaccaaggccgagtgtggcgcggtggctcatgcctgtaatcccagcactttgggaggctgaggcaggtggatcacctgaggtcaggagttcgagaccagcctgaccaacatggagaaaccctgtctctactaaaaatacaaaattagccaggcgtggtgtcgcatgcctgtaatctgttccacatcccatgtacagctactcgggaggctgaggcaggagaattgcttgaacccaggaggcggaggttgtggtgagccaagatcgtgccattacactccagcctgggcaacaagagctaaactctgtctcaaaaaaaaaaaaaaaaaaaaatcacaaccagatgcagtgtctcacatctgtaatcccagcactctggaaggccgaggcgggggaattacttgaggctgggagttggaagccagcctgggcaacaacatagtgaggtcccacctgcataaaaaaatttttttcagccaggcgtggtagctcacgcctataatcccagcactttgggagtccaggatgggtggatcacctgaggtcaggagtttgagaccagcctggccaacatggtgaaaccccatctctactaaaaatacaaaaattagccaggtgtggtggcaggcacctgtaatcccagctactagggaggctgaggcaggagaatcgctagaacctgggaggcagaggttgcagtgagacaagattgtgccactgcactacagcctgggcaacaagagtgaaactctttctcaaaaaaaagacaaaaggcactttgggaggccgaggcgggtggatcacgaggtcaggagatcgagtccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccaagattgcgccactgcactccagcctgggcgacagcgagactccgtctcaaaaaaaaaaaaaaaaaaaaaagacaaaaggaaaaaaaaacttttttcaaggcgagtggatcacctgaggtcaggagttcaagaccagcctgaccaacatagtgaaaccccgtctctacgaaaatacaaaaattagccgagtatgatggcaggtgcctgtagtctcagctattgggaggctgaggcaggagaatcacttgtacccaggaagcggaggttgcagtgagccgagatcgtgccactgcagtctagcctgggcgacagagtgagactctgtctcaaaaaaaaaaaaattgcatatataaaatattaacttagaattattatttttgttcatacattccccttgtatgtgctgtagctcactgagcattttggagacagtgtctttgttatcgtgagaggcacttttgagtcacttcacttctaactcaattattttagattaaacatgttttgttgttgtggtggtggtggtggtggtggtggtgacagggtttcactctgttgcccaagctggagcacagtggcatgatcacagctcactgcagcctctgcctcctggtacaagtgattctcgtgcctcagcctcccgagtagctgggactataggtgcccgccagcatgcccggctaatttttgtatttttagtagagaaggggttttaccatgttggccagtctggtctcgaactcctgacctcaagtgttccacctgccttggcctccaaagtgctgggattacaggcgtgaaccaccatgccaggcccaaaatttagacaacagaggcaactcagagatgatgtccagtcctgtcagtcagaacctggaggatgttttcttcactgaggttttgaaagataaaacatgcacaaggtaaaaaataaaatactacaaaagggtttgcaatagaaagtaagcctctcggccaggcgcggtggcgcatgcctgtaatcccagcactttgggaggccgaggcgggcggatcacgaggtcaggagatcgagaccatcctggctaacatggtgaaaccccgtctctactaaaaattaaaaaaaattagccgggcgtggtggcgggcacctgtagtcccagctactctggaggctgaggcaggagaatggcgtgaacctcggaggcggagcttgcagtgagccaagattgcgccactgcactccagcctgggagacagcgagactccgtctcaaaaaaaaaaaaaaagtaagcctctctcccttccctggccctcagccatcctgctccctccccaaaagcagccattgtttcatttctgcatccttccagaaatgttccaaacgtgactgcacacacatgattgtgtgggcttcccttgcacctgttttattaatgtggtcacctcctgcatatgaactacttcctcacttgctcttgctcttcaagtcttttttttttttttttgagacaggctctcactgtcacccaggctggagtgcagtggtgccatcatagctcactgcagcctcaacctcccgatctcaagcagtctcctatcttagtagctgggcccataggagtacacaaccacacccacctagttttttactttttgtagaggtgagatctcactgtgttacccaggctggtctcacactccgcactcctgggctcaagtgatcctcccacttacgcctcccaaagtgctgggattacaggcatgagccaccatgcctgacctaagtttcttggcaatagttccgtatcagtgtgtagaaagtgatgtcatttttggccaggcgcggtggcccatgcctgtaatcctagcactttgggaggccgagatgggcggaccacctgaggtcgggagttcaagaccagcctggccaacgtggtgaaaccctgtctctactaaaaatacaaaaattagccaggcgtggtggcaggcgcctgtaatcccagctactcgggaagctgaggcaggagaattgcttgaacctgggaggcggaggttgcagtgaggcaagatcgtgccattgggctccagtctgggcaacagagcaagaccctgtctcaaaaaaaatagaaaaagaaagtgaatcccacacgtgtccagtattagaaacgagagtttggtaaactccagtataccaagctgagctgtgtgtgagttttctaaaaatggtttcgcgctatacatgctgcttttttcacatgacgtcgtatctgggattgcctctgcacgccatgtggatctgccatgcgtctctggagggtgtgattctgggtggtgggcctggccctttcctggctgggggctgctgtctgctccacagacaggaccctgggagtgtccgtgcacatgtggcactgtggactcatgtgagcctttctgaaggacgcgtttccagaagtaggactgctagtgcagagagcaagcacattttattcatgcttccaggaggtcttggcacgcccctctcgaggggagcctgtgggcagtgcactggctggggggcgtgctgaaggccaggcctgcttcctcactgccgggagatgggcaccatgagccctgcactgagtcacactcccctgtgcagggcattctgggaaatattgaaatcaaaaggggtgggggagtccccttttgatttgtgtctgtctctctgtctctctatttctctcttttgaatctaaagcttttaatttgcccaaagaatacacatccctgataactgacagacccagcattaccctagacctggaattccaatttggggaggaatatgacctgaccaggaaaaaacctggccttgctctcgcccttcctttgttaaaatcccaaggctggcagctgagaaacagaaaaaggaaatccagtctttaaaaccctcgggaacccaagacatcttatttcttccccaggttcaaagcctctttttctttcttgcattacagaatgaagaagtccaggcaaaagcttttattaagctagtttttattatttttattgttataaccatgattatggttaagtaaattcagacacttcagaagaatatcagttgaaaagtaaaagtcccatttttccacctcctaataagattcctacctcccagaggttatcatggttcataatttcttccagaaattgttatctgcagacagaagcatatttttaaatccaatgtggctgttccccacaccatacgtgtttcctgccatctctgatatacacgtgacagtcaagcttggcagtggcgtgggtaggcactgcagcctggcggccttgatttgaaacctgactccttcacaggctgtgtgacttgggacaagtggctaaactcctctgtaccttaacagcctcatccatgagatgggataccaatagtctttaacatatatggctgtggtggggatcaaatgaatttataagctgggcatggtggctcatacctgtaatcccagcactttgggaggctgaggcggaaggatcgcttgagcccaggagtttgggactagcctgggcaacctagtaggaccccatctttacaaaaaaattagctgggtgtagtggcatgcgcctgtagtcctagctacttgggaggccagggtaggagggtcacttgagcccaggaggttgaggctgcagtgagctgtgatcacactgctgcattccagcctgggcaacggaggaggctctgtctcaaaaaaaaaaaaaaccaaaaagcaaaaaacacacacacacaaatgactacatatatgttccaagggaaacccaggccttgctctggtatggttcacgttctgctgggtagactgacaataggcaaagacacaggtcgggcacggtggctcacacctgtaatcccagcactttggggggccgaggcgggtggatcacctgaggtcaggagttcaagaccagcctggccaacatggagaaaccctgtctctactaaaagtacaaaaattagctgggcatggtggtgggtgccccaatccttgctactccagaggctgaggcaggagagtagcttgaacccaggggcagaggttccagtgagccgatatcacaccactgcactccagcctgggtgacagggcaagactccatctcaaacaacaaaaaaaagcctctcccctcacacagggggtctgtctctgtgcatgtgttcagcgtgggcctcccccactggctgccagctcggtgctcacggccgtgtccccagcacctgggacaggacagcacagccagctctgtgtggttcccggaaaacgtttgtggaagaagggaatggagccaagcccctctctgccacgcgtttgctgggtgaaggagagaaggctgtggccatgcgtcccgtggtggccggccctcttgaatccaaacagctttgaaaagtggcttgagcctccctgacacccctctgaccctgacgctgtcattccaggcaggtggacacgaacaccaaaaatgtctttgggcaaccgaggttgagggcatccctccgagacctccggtcaccacggaagaactacaaatccaccatcgaggatgacctgaagaaactcatcatcatggacaacctggggccagagcaggagagagacacgggagtacgtagggccctgtcccccgctcccgacccccagctcccaaggggatcccagatctgggcaggcaaggagaagggctgtgctccccacggtcacgccagctccttcccgtcgtgtccccagcctttggcatctgccagtcctgttgggggctatgggctcatggctgggagtgagggcagcgcattggtctgggatggaatcacaggataagcccaggcaggcactcgggaatctaccccataccgagaacctcgcacaactggagggcctcgtgccctcctcctccagcccaggatagaaacagccacatccacccaaaccacagggactgagagtggagcaggggctcccagaggaagttcagactcttgttactcagggacacgggtggaaagaacagtgggtgccagggaacctccacagcatccacttcccttcccctcccagccaggcctgccctactcgtcctcactgccaggcaggagctgttttgtggggactgaggtggaccccagcctccccagggttgggtcccaccagcctacagctgggggaagagagcacatcagcccagcgctacccactggggtcccagcactgactctggtgggtccagcttggctcacaccaccttccccaacccatcaggctttgatcgccagccttacccggagctggagggtggggttggggagtgggagtccctgggggaaaactggagcgctttgatcagaaaggaggcagaaggccaggggtggtggctcacacctgtaatcccagcactttgggtggctaaggtgagaggatcacttgagcccaggagttcaagaccatcctgggcaatgtaatgagaccctcatctctataaaaaaaatgtaaaaattagccaagggtggtggcatgcacctgtggtcccagctacctacctgggaagctgagataggaggatcgcttaagcccaggaggtcaaggttgtagtaagctgagatcgccccattatactccagattgggcgacagagtgagaccctgtctcaaaaaaggaaggaaggagggaggggggagggaggaagggagggagggaggaaggaaggaaatggggcagaaatggatgctgggtaggtaaggactcgccaccaatgtcctagaggggaagatgcctctgaggaccctggctatgagccagtctgtgacctcccccaacatcccacccacgccccacagcagtcaccgcagaagggcctgcagcggacgctgtcggacgagagcctgtgcagcgggcgccgggagcccagcttcgccagccccgctggcctagagccagggctgcccagcgacgtgctcttcaccagcacctgcgccttcccgtccagcacgctgcctgcacgccgccagcaccagcacccccacccgcccgtcggccccggtgccacccctgccgccggcagcggctttcccgagaagaaatgtgagcctgggccccctgggactggcgcggtagttaccccaaggttgggaggtggggatgcccgagcaggggctcacctggaggtcaaaggctagaggtcatcagtgtcggggccatctcagggaggaatggggttcacaggaacttcggggggcctgatggtggggcactgggtgtcacccaaggagcaagggatcattggccaagcatcagagggtcacctaggagtcagaagcacccaaggattggagtcacctgagaccagagaagaagtccaccctcagggtacaggcctagggaatggggctgcccagctgttgccctagcaccccccaaccctcccacccattccagctctaagcggtttgcttcctgagcattttatttgctttcctgactgctcccatgtttgccacacttgggggtggtgcatggtatgacttgttcactgcttaatcacccagaaaatatttactgagcactccccgtaaacaggtactgcgcacaccacccgcatcaaaagccacgagccagctggagttggccgtgccccagatgcaccctgtaaccccccttacccacctcctaacccccccacaactgaaagacagtacgtaagtttgcaccatgctcactgggtggcgaaacctggcctggaggggcgtgaggctgtttagggtccatagtccccctacttagtgctagcaatgaggagcttggggcagagcgctggcgtgccactgcgcgtggggtgcccctgacctttttgagtttgttacataatacacagcatctgcacacttactctctcaaatccaagcacatctcaaattcagaggcatgttctaccccaagggtctcagctgaggggctgtgcctgcctgtgccatctgtacagagcctcttgtgagctgtgggggatggggtggaggagactctgggaattttatgaagggcagtctgtctcccctattaaaactcccctgcaggccgggcgcggtggctcacgcctgtaatcccagcactttgggaggccgaggcgggtggatcacctgaggtcaggagttcgagaccagcctggccaatgtggtgaaaccccgtctctactaaaaatacaaaaattagctgggcatggtggcaggtgcctgtaatgccagctcctcaggaggctgaggcaggagaatcacttgaacctgggaggcagaggttgcagtgagctgagatcaagccactgcactccagcctgggtgacagagccagactccatctcaaaaaaaaaaaaacttcccctgcagctccgttgccttggcatttgcatctgcactccttgccctggtggtgtggggtgcccacctctgctcctccacctcacagagccttccttttgatcactcagcacaccagaccctccctgctcagggcatcctgcacggctgttctctccgcccgccatgctcttccctcagtcctcttctgggtcactcttgtccttcagggctggctccattcctgctttttcctggaaggctcctctaagccctggactgggtcccagcccccatctcaactccagagcttctgggccctcccctgcgctcccttcctgttcctgcagcgcctgctgtgggcggggctctgccctcggtgccaggatgtggccctgagcaagcagagcacacccctgccctcacagggctgccactttagtggaaatttccctgctccccaggcttccctccacgtctccttcctcggcctctcctccctgctgctctgtctctctgcccaaggcagggctggtcacgaagtagatgttcagtcactgcaaaggacggggacagcggccaccacggagaggtggtgacagagaacacaggcatagactccacaggccgatccgaattcctccagcttgctgtacctcattctttcagtcttggctcagatgccccctcctccaggaagccctcccttcccctaccaggctgagtcaggcaccaccacaggccccgtccccccccgcccccccgggtttctctcacccccctccgtccctactcaccgccttgtatccccatcaccatcctgagctgtcactagatgagaatgtgtctgtctccaccaccataccgggggccccccaaagacggggcctggggttttctctgtcactgctgtgaccccagctcaggtccctctgcatcacacagcacacacacacccttctctgtccatctgactcccccacacccctgagctggggagagtcccgtctggcctcagtgtggccagggaccctgggcctctccatttcttgtgtgcctgctccagagcccttcccgggccccatcccagatgaagagacatggtcatccctggcctgggcttcactaaccaagtgccctccacaccaaggagcctgtcacacggtgctcctgatgccctgctcagcaatggcagccactcccgtggctcccaccagctgagcagtgagacgccagcaggctagaggcacagaacaaggaggccaggggaagagcaaggaggcccagggtggagcatggaggtcaagggtggagcaaggaggccaagggcggagcatggaggtcaagggcagagcaaggaggtcaagggcagagcatggaggtcaagggcagagcaaggaggtcaagggcggagtgtggaggtcaagggcagagtgtggatgtcaaggcggagcaaggaggtcaagggaggagcatggaggtcaagggcagagcaaggaggtcaagggcggagcgtggaggtcaagggcagagcgtggaggtcaagggaggagcatggaggtcaagggcagagcatggaggtcaagggtggagcatggaggtcaagggaagagcaaggaggccaagggtggagcgtggaggtcaagagtggagcaaggaggtcaagggaggaacatagagtcaagggcagagcatggaggccgaggggggagccaggaggccgaggggggagcaaggaggctgagggacgagccaggaggccaaggactcgttcattcagccagcacttactgcacaccacatatcacagagctgaacggcctgagtttatgtcccacgtcttccactcacagatataacctctctgtgcctcagtttctttgactgtaaaatgtaaaaaatagtgcccacatccctgggttaaaagaatcaaacaagtgaatatgtggaaagcacgtagtgtatacctcatatgtagtcagcactgagtagtactagctggaagccatgtgagcccaggcaaggcagcgcctcgctcgggtctcagttttcctcttccatgagcagagatcatgtcaccccccgcctccgccagcctcacagtgaggctgtgagatgatctcccttggccctgcacagaggaggtgccgggaatgcagagcgggctgggcccacggtcaggctctgccgattcccagctaagggccctgaggtgtgtcttctggtctctctgtacctggctgtcctctgtccccttccctcaggggcttcaaggagtcacagagccccaggccagagcccgagcctggtgcctgggactctctcaatagccgcagcaggtgcgagtgcagtgctggcgccgttgcttctcacttccaactcctgagatgtcacaggcctctcctctgctcagcgtgtcatacctgaacctgcccccccacggcaaccccaccccgtgtaaacactgtccatacactggcgattccaatcacaggtgcagctgggactctcctcgtcgccagctcctgtggccagcctccgtcccaccatctccttggaatgtccagggccatctccaccgagcacctccagaaacagatttctgatcccccaccccagccttcccgatcagagccgcaatcctggcccttctctttgtttcacagccatatccaaccctcaggaaatcctattggctgcccctgaaaagtaggcccagaatctgcccctgtgtcctatcacggccccaccctggtcctgcccagcatcaccgtctccattgtgggttatggttacagctcctacctgctccctgtctccccccaaatccccccccaaacacacagtccgtcccccacatgcacccagagggagtcttccagggcactcagggtgagaacacagtcgtcactgggacccacaggccccacacggtccggccgtgttgcctctgttctcgcctcctgctgcttcctcccttgctcaccctctcccagccataggggccgcctctgtgttccttaaaccttccaggcacactcctgcctcagggatttagcactggctgttccgtctgcctggaatgttcctcccccaggtaatccgcctggtgcactccctcctccccttcagagttttgtccagatggcatctctgccaggcctggcccagcaccctgtttgaagtcaggcctctgtaggctccagcactcccagaccccttaccctgctggaggttttcctgggcatgtagcatctctgcataagcaatgggatgtcttcatgtatttgtgtctcccgcattgtcacactcaaccactgccatctccaccctccccatccagccaccatctcagcctcggagctctcgctggctgatgggcgggaccgccccctgcggcgcctggaccctgggctgatgcccctgcctgacacagctgctggcctcgagtggtccagcctggtgaacgcagccaaggcatacgaaggtaggcgccttccacccagtcccgccaggcccccaccccgtcctctgttctagagggattcatggagggcctcatggctttgcagggatacccactcaggttccagaatcagggagcagggttcaagtcctgccccgtcacttgcttaccatgcagccccgggcaagcgtcgtcatctctttgatgccagcgaaccacgttgaccaacaagcggaagtgaccatgcctgaggctgccatgacgattacacaaaacaccacgtgtaaaacacgtgaggccaagcacagtggttcacacctgtaatcccagcactctgagagtccaaggcaggaggatcgcttgagcccaggaggtggaggctgtgtggtgagctgtgatcacaccactgcactcactgcactccagcctgggcgacagtgcaagaccccgtgtctgggggaaaaaaaaaatctgtccctgaggacatttgggttttcagcgccagatctgggagccagggagcggaagacttttagtgccctgagggtcctgccaagaccttgcatcctgggttgggggttccccataccaggcctgcagggatcctcactccctgggttccctggagcagtggacagggtttgctctgccacccagggccctttatgtgctggaagtccgtgctgacggggccaggcagctgtggcatctcctctctcatgtgggtctccaagcatcctggggccaggacagccagttccaggacagtgggaagtgaggaaggcctcaggtctctccctggagacccagatgccatcagcggttgtagtgttgtttgcggaagacagagctgcccagacactgaccactcccccgcaaccgtgggccacaggaaagggctaggatagccagagccccttacccactcccagccgctccgtgtgcctggcatgcctgggagctgtgcgccccatgtgagaaagctgagggagcctggctggtggcactgatttctcccccaggctgtgcgtcacagtcgcctagggagctttttgcttccttataaaattaatagatgaaacacagaaggttacgggggagaggggggagtagcagaaagacctgggaggaagcacaccagcaccaccatggaggtgcctccccgggagccggaaaggggctggcagggagtgcaggtcagggtggtttcagcttgcctggaggtgtggtttttaatgaagatatatgtgggttttcccttgcaattcacataagtggaaaagactaaaggaattctcattaactttggtagatgtgttcatagcatagtaattttcttaaatatatatatatatattttatccactagagctacttagtgaagtttctacagatgaaatacaaagacatctagaatttgatttaaaatattccaggttgggtgcagtggttcgcacctgtaaccccaacactttgggaggtcaaggtaggaggatggcttgaggccaagaattcgagaccagcctgggcatcgtagcgacaccctgtcactacaaaaaaatttattttacttatttattttttagagtctcactctttcacccaggctggagttcagtggcgtgatcttggctcactgcagcctccacctctcaggttcaagcaattctcctgcctcagcctcctgagtagctgagattataggtactaattttaaaattagccaggcatggtatcacacacctgtagtccaagctcctcgggaggctgaagcaggaggatcgctggagcccagtagttctaggctggagtatgctgttctgatgcggtgtcttcactaaactcaacatcaatatggtgacctccagggagccagggaccaccaggtttcctaaggacaggtgtactggcccaggtcagaaatggagcaggtcagaactcccatgctgatcagtaatggactcgggtttgtgaatagccactgcactccagcgtgggcaacacagcaagaccctgtctcttaaaaaacagatgtcattatacattaaattcaagatagaaaaaaatagctataaagggtattattcagagaatcggagaacatttgcagatgactgtatattagataatatcatggccaggtgtggtggtgcatgcctataatccagcactttgggaggctgaggcaggcagatcacctgaggtcgggagttcgagaccagcctgaccaacatggaaaaatcccgtctctactaaaaatacaaaattagctgggcatggtggtgcatgcctataatcccagctacttgggaggctgaggcaggagaatcacttgaacccgggaggcggaagttgcagtgagccgagatggcgccatcgcactccagcctgggcaacaagagcgaaactccatttcaaaaaaaaaaaaaaagtaaatgggcaaagtattaacaatgagtggtgccagggaaagagtgctggggtttttactgtgctattcttgaggcacagaaatgaaagttggacccaaggagctgcttgcctctggggctggccctctgccctgccctgccctgcccctgatggtgccgccctcaacacacggcacacagggacgccttggtgtttttaacacctccgaggattccattgtctggctgttcatagctcactgaaccagccactgttggagggcactagggcggtggccagctgttgccattacaggaagaaaatctaagtcacgtttgaaaacgcaaacagctcaggtgcccccagtgccagtcacgtgtccaaggcgggacccaggaatcttcactttcactggcagccccgtgcgatttcttttctgtcttcaatatgcatgatgtgatctgtctcacttctctttttgcttttgaaatcttcccagcttcctccgaaggagagcgaattgtataacgaatccccgtggacctggcgccagcccgtccactttgtaacccttttttcctaccttttacttgtggaccaagtcaagtcacttatgttgagagcacgccaggttcggaatccggtcggttgctagctcgcactctcatctaactggcttcttcagcccttgcgttttgtatgaactggtcgttggatcgaaagcctcgatcggaatcaggatgggattttgattgtgttcttgttttgtgtgttcatttggttggttttttggcaagaatctatctaagtgccgatgcagtctgtcccaagtgtgataggaggcatcatggaggtttgcagggagaggcgtggtccgtctgttgcgggagaagccgggagccttgctgacccctctcctcctcctccctccctggcagtgcaaagagccgtctcactcttctctctgaacgacccggccctgagcccggacatcccgcctgcacacagtcctgtccacagccacctgagcctggagaggggacccccgacccccaggaccacccctaccatgaggtgaggtttccctgggaacacccgggttcataccagcggcaggcctgtgcagtggaagaggcttacccagagagaggcagccatgtgggtcacccccaccactctccgggcggaagctgatatagcagctactcccccctcctaacagacttggaagtcattacactgcacctgtctgtgcactggggatccacagtgaccaagacagactctgcccagtcccaacagatctcccagtccagcagagacgacacttgaatcaatacacacacagttgtttcgcttccaactttgaacactgctaagcaggccgggcgcggtggctcacgcctgtaaacccagcactttgggaggccaaggtgggtggatcacttgaggtcaggagttcaagaccagcctgaccaacatggtgaaaccccatctctactaaaaatacaaaaattagccgggcgtggtggtgcgtgcctgtaatcccagctactcgagaggctgtggcaggagaattgcttgaacccgggaggcgaagcttgcagtgagccaagatcgagccactgcactccagcctgggccacagagggagactccatctcaaaaaaaagaaaaaaagaaaggaaagctgctaggcagtgtctcccaatcccccagccctgtgcctctcgtcagccccgtcgctgccaatctcccgcctgtctgctccttcgtctcctcctctgcagattcctaaacctcacagacttctgcctcacgctcacccttcccagcctccctgccaggtgccgtgctgggctgtctgaggacctagtggcaactgaggccaggcctggccctcaggaagcttcacgggggaaggaagaggacggggacagatctctcacatttgtcatctcacgcgtggcttctcacattcagcgcagcatatttgactgcactcacttggcagaaaacaaaattaaaaagaggcagagagaatgtaaatggcacattctgcctgtacatggatttaaatagtgcatttcacactcgtctgcacacctcacggttcagggttctatatacaaccatccgtgcactgtacttcatgggcagtgggagcaatttttgagggtaattttgacttcttgcttttcacactctggcttcagaactcaacctccaccacgaacgtaggccccactgtaattacaagaaatcagcagttccagatggtgctgctgggctgaggggcaggagcagcatgggctgtgggaagcagcgggacctgtggcccctgggcggcgctcctggagtccatttgcccccatctccctctgcagctgcagatccccaagactcagcagcaaggttgtaggaaagggtgggcgaggcaggagggccagcccccgaccgccaccgcctctgtgcctgtgcacgcacggcatccagtggagcctccttcagccccaactccaagcaggaaagggctgcgcgttctctgcagcggccaggcaggcccagggctgggaggatctgcagaggggcagctactggccatgggcccctgattcaaatcctagcaccagcacgtggtagccatgcagcacctccaaaggccacagtgggcagaggagctctgtgagatgagccgggcagtctggggcttgttgcggggtggctctcagtgacggccacgtggtcagcatcactgccaggaccattgttggtcctgcccacaagggcaggtccttttgaccatctgtccattctcgtgcttcctgtgcctggacccgccaggtgctcagcaggtgtctgtagagtgggctctttgtatcctggaggtacgaagaaggggtcctccctgaagtcacatgcacggcccagcctcagggaaaacgcacacttaagggtgggcagccacccttcccctggcctggtgctcctaacaccccgtccacatccacagaggtgcccttggtgggtggagtgtgccgggtggagggctggcttcctgcttcccctcagagcttctcctcaggctttgctagaatgtcagggataagggggcctgtacccccaggctcctcagatgtgggccagaagccttccccaggggctttagggcctcaggctgaccttgtccctggtttttccagcgaggagccacccctggatctgacaggcaaggtgtaccagctggaggtgatgctgaaacagctgcacactgacctgcagaaggtaaggccgggggccacgccctctccatcccacttcccagacactgggcagggcagtcagcagggatcaggcacctgcccccgccatgcaggacccaccccacccccacacctcctgtgtttgagtgtagtcatgggtgaagagtaaacagtgataacaccccaggctaccaagcgctcagagaaactcatccattcttggggggagaataatcagcccaggcttttcggaaggcaattggataacatttatcaaaaaaacacaaaaaaactgtggctgggcgcggtggctcatacctgtaatcccagcactttgggaggccaaggtggtgggtcacctgaggtcaggagttcgagaccagcctggtcaacatggtgaaaccccatctctattaaaaagtacaataattagtcgggtgtggtggcgggtgcctgtaatcccaggtactcaggatgctgaggcaagagaatcgcttgaacccaggaaggtggaggttgcagtgagccgagatcatgccactgggctccagcctgggcaacagagcgagactccatctcaaaaaaaaagaaaaaaaaatgttgatccagtaattccacttgtgggaatttatccgtgacagcatgggtacaaagagattgtgaacaaggacgttcgttgccacactattggcaataaaaaattggagccagcgtggctgtcactcaacatgagaatggctgtgtaaattatagggtgtccatgcagcggaacagcttgcagccaattaaagtaataacaaatctatatatttactaacacgcaaaagaagtccagtaacttacataaaaaccaaagcgagctgcagcagtgttgtctagaatatcaccatacttatttatttattgtttaaccaccatggttgagagggccatctagaaggtgacagtcaatttgttctttggacttgtctccatggggcggaaggatgaggaggagactggctgggtacgttggctcacacctgtaatcccagcactttgggaggccgaggtgggtgaggtcaggagttcaagaccagcctggccaatatggtgaaaccccgtctctactaaaatacaaaattagccgggtgtggtggtgcacgcctgtaatcccagctacttgggaagctggggaggagaattgcttgaacccaggaggcggagattgcagtgagccgagatcatgcctctgcactccagcttgggcgacaagagcaaaacccagtctcaaaaaaaaaaaaaaaaaaatgaggaggagacttttatctattgtttctatacttctgggtaaaagccagaaaggtggcagagtatataatgcgtaagtcttcgagccgtggaatcaaaggggcccaggttctgacccccgccccactgcataatgctgcgcaacctgaaacaggtccctgcctttcgggggctacgtcctcctggaagaagggggtctgctcaggccaccctgcatccatgtcccagctccccacttgctgtgtgaggctggggtcctcttccaggaaactagggacagcgacagtccccaagtcctcgggtagtgtgaaggtgggatgcggtgacaatagtgatgtttgtcaagcgatgactccacatgtggttgcgttccgggagctctacatagatgagctccagacacccctcagcctcctggtagagttgcgggaaccaagtgacttgcccagggtccctcggttgtggagaggcagagtgggatgtgtgccccggcctggcctggctctagtggttggctccaaagcacagccgggccagggctcacaggcctcagggagccatcggctgttccaggagcggccaagcccacccgcctgatgccagcttcccaccctgtgcaggagaagcaggacaaggtggtgctccagtcagaggtggccagcctgcggcagaacaaccagcggctgcaggaggagtcgcaggccgccagcgagcagctgcgcaagtttgcggagatcttctgcagggagaagaaggagctctgaggtgggaggccgccgcccgccttcgctccttcccctcaggccgtggccctgctgcctctctccctccactcagctcccagctgccggtgtgaccaagatgacccatccagggccctccccatggacacggaaactccgatggcctcactagggctgtgagtcagggtcagcgcgcacagccctcatgccccagagggcgaagtggtctcaggcctccctccaagctgcccagctgtggtcccggtgagctgggctgtgcttacaccgctcccgggcctgccccgctgtccccatctagcctcttcctgggaccagcccttcgaagctgatggggacggagagaggagccagtctccagacgcctcggctccaggaggtcacacagcaggtttctgcaccacgcacaacaaagttgcggcttgtggggccgaggcccctgcatgaaaagtacagcgtgaaagcaaccctttcttccccacacccagagaggtgaggcccgcgtggacacagaccagggcgcctcggtccctagcacgtgagctccaaaaagcacgaacatgatcccctccctaaccccctcctcccaaaaagcagccaggagcactttcttagagtttaaattattttcttgggggcctgaggatagagagaggcaaggctagcctccagagccgatttatttgagagagaaactctatttggatctccaggacggtttatacgatctttttctatcagctcctcttccgccagaggccactgcacctgggctaggggtccacaggcccctccaccttccagctaaccaggccaggccggggcggtggagccaccacacagccgactctctcctcctcctcccggcacgacctggccctgaccagcagcctcggcctcttctgggttccaggaggggctcccgaagccctcaggacagggctggaggagaacagccttcatctcctcctctggtttttttttcctttgcaagtctcccagcccatctctccgagcagcggccaccagaccccctcaccatgctccccggggagcactgcaccccgcgaaccccactggacgctggttctctaaaggcaataaggggcggccatgccggtgtggtaccacgctgttcctccaggaaaccgtttctttttttccttctttaaaagcaaacagaaaaagatatatatatatatatatatatatttattttttcatgtagagttggcgccagaacaagcctgtatggccacagtctgtggattcatccccccaacctcaagctgaggaccaaggcgtgtcccctgtgggctgggggtcagtgggaggaccagagggatgaagtcagggcaggccggtgccctttttgggaggcaccaggcggggaggagttggcggagcaggtctggctgtgagccagcaccaggcaacccggcccttgtccagggacctctgctgccttctctctggggtcaggaacctcagaggagggggctctggggactgcataggacgcaggcactcggaggtgccggtgtggatgggtgggggtgagagaagagggttcttatcgcgtctcctgtgatcagcctctggccccctggaggaggaaacctcagcgctgcccctgcccccaccctcacccccaacaccaagagtgaggtgggcgtgccccaggcagcgtcctcagccctggccagctactgtgatgccatcttctcccccatccccttctctggggggcccacccgtcccccacccccaccccttagaccctcatcgggtccctttttttttttttttttcagttgtctcctcccatcttcagatcattcgaatcattttggggacttaatcatgtacatggacaagtgtaaattatgatttttggttttgttttctgttattttttaaggatttctgcaaaaacagatctatttaatttgaggttgatgttctatccaatggccgaagatagcagcaggttttttttttcatatgttgatttgtttcatttggattttttttttattattctttattgtcttttttttttccccatccctgtcttgagattttctggcatgtttctggaggtttcaaaggaaataaaggtttcatag

SEQ ID NO: 37920 - DNA, 28836 bp, Homo sapiens; identical to SEQ ID NO: 37100

SEQ ID NO: 37921 - DNA, 32907 bp, Homo sapiens
gtgcggtgtggggcaccgggcggggccgcgggaaccggcgccccacggagctgctgctgtcagaccaaccccgggcccccatcatcactgcgccgcgctttcaggcgccgagaactaccgttcccggcatgccatgaaattggcctcggcgctgaggcggggtccggccctccacccgctcccgccgcgcgcgaatcgcggtcgcgagccatggaggaggaggcatcgtccccggggctgggctgcagcaagccgcacctggagaagctgaccctgggcatcacgcgcatcctaggtgaggaaagggggcacggtgccgagagggtgtggaggagaaggaaggaggagcggagggatgaggtgcggggtgagcggtgcgacgctggccccagaacaggagtggacatcgctgctgggacttccgttgttacagaggaaagtgggggacctgggtttgtgattaggccttgaaagtgtttgccaggagtgttcggaggcagagctgggaagcctgaagtttcccccactcaccgccaaccaaggtcccacccaggaaggacgggcagagacgtgcaaagggaacacagcaagcacctgacggttgggaagttggatctccccctaggaggcattctcagccagggcattatccccgaaacccaagacctttctctgggggaagtaatgcacccgacctcccagggcgacaactacgtcgggtctgaaaggaatccaaccttgcaccactgaatgactcagagtttttcttttatcgaacatttctttgtttgcttgcttgtttgtattttgagacagagttttgctcttgttgcccaggctggagtgcaatggcgcgatctcggctcactgcaacctgcgcctcctgggttcaagcaattctcctgcctcgcccagctatttttttgtatttttagtagagacagggttccaccatgttggccaggctggtctcgaactcctgacctcaggtgatccacccgcctcgacctcccaaagtgctggaattacaggcgtgagccaccgcgcctggcctatcaaacgtttctttagtactcaccactatgttagacgtgaggttaaaaatatgaaaaagacacagttctgtgaaaaaaataaacaaatgaggtcactaggagtgtgaaaagaggtcagtaatctgttactcagagatgtcacagaggaggggactgatcttaccagggaagttaaagaacatgtcacagaggagatgatgctagattttgaaagacatataggagttagccagaaaactaaggaggagaaaggtcttttaagaaggctgaaaagcatgcttcagtgccttcccatcacaattataataaaatccaaatgtctgtaccatgacccacaagtccctgtaagatctgctctcatctctttctgactttgtttccactcttgcccacatggccttctagctgtaccttaaacacactaagcgggttcctgcttcagggcttttgcagtttgctagtccttgcacctggaattatctttctctgaatgtctcgcttcttcaggtcattcagatctctgatcaaatgtcattatttcagagaaaccttccctgaatatagttcgaataaccgccgtctttcttgctctctctttccttaccctgctttttcttttattcttatagcactttcactacttgaaattatgtatttgtttggttgatttttaaaatttgtgtctcttttaatagaagtccaagaccaagtgtgatttaggaatgagtggttttaacatatgaaaatcaattaatagctgggcatggtggcccatgtctttagttccagctactggggaggctgtggtgggagggttattagagcccagttcaagtccagctggacaacatagcaagaccctgtcactaaaaaaaaagaaacttaaaaaaaatcaattaatataatacaacttactaatagaataagacaaaaactgcataatcatcttaataaaaaaagcatttgacaaaatctaacctttcttgattaaaaaaaactcaacaaactagaaataggatgggatagagatagaatttcctcaacctgatgaaggacatctatgaaaaacccacatctaacatcatatgtaatggtgaaagactggcagctttccccttaaaatcaggaacaaaaattgtattagggttccccaagatcacaccagattcaatgatttgacgcaaggattacaggactcaggagatagtcctactcatggctatgattcattacaacaaaaggattttggcagcccgattggcagacctttctgaggattattgtctcgggcctgctatgttcactcttttctgcatggcaagaattccacttttatcacttctcttcaacattgtactggagtttctagctagggcaattaggcaagaaaatgaaataaagacatccaattgaaaaggaagaaggtaagctatctgtttgcagatgacatgatcttgtatataaaaaatcctaaggaatccacacacacacacacacacacacacacacacacacacagcctatacaccagcaatgaacaatccaaaaataaaactaagaacaattcaatttacaatagtattgaaaagaataaaatgtagctggcacagtggctcacacctgtaatcccaacactgggaggccaaggtgagaggattgcttgagaccaggagttgcagaccagcctgggcaacatagcctttatgaaatattttaaaattagccatgtgtggtggtgcatgccttagtcctagctactcaggaggctgagataggaggattgcttgagcccaggagttcgaggctacagtgacctgtgatcacaccacagcactccagcccgggcaacaagagtgagaccctatctcaaaaaaaataaaagaataaaataggaataaattaacacaagatgtccatgacttatgtactgaaaattacataagactgtggaaagaaattaaagaagaccaaaataaatgagaagacataccatgtttatggattggaagagttaatattgttaaaatctgttactccccaaattgatctacaaatctcacatctccagttcccatcaaaatctcaactgtctcttttgtagaaatcaggaagctaatttaatcctaaaatataatatagaaatgcaagagacccagagtagccaagataaacttttctttccaaaacaggaaaaaagttcctcttactcacatttccctatactatatttgagatgatggaaaagttctggtgatggttgtacaacagtgtgaatgtactttatgccacttaactgtacacttaaaattgactaaaatgatgattttatgttatgtgtattttaatacaatttaaaaaatttaaagccacagttgtcttcagagtggtagtggcataaaactagaaatgtagatcaatgaaataagattgagagtccaaaaataaacatcatatttatgattcattgattttttttttttttttttttttggagacggagtctcgctctgtcgcccaggctggagtgcagtggtgtgctcttcactcgctgcaagctccgcctcccgggttctagccattctcctgcctcatcctcccgggcagctgggactccaggcgcccaccaccacgcctggctaattttttgtatttttagtagagacagggtttcaccatgttagccaggatggtctcgatctcctgacctcatgatccacctgcctcggcctcccaaagtgctgggattacaggtgtgagccaccgtgcccggcctgattcattgatttttgacaaatatgttaagacttctcaatgggaaaaaatagtttttcaacaaatggttctggatttccacatgtaaaataatgaaattggacctctacctcaaattatatacaaaaattaactccaaaagtatcttagacctaaatgtaagagccaaaaccataagactcttggaagaaaacaggccttaggttccttttttaagtgacattgagttaggcactggattcttacatatcacaaaagcataagcaacaaaagaaaaatagataaattgggtttaatcaaaatttaaaatgtttgtgcttttaaggatatagtcaagaaagtgacaaaacaatccaaaaaataggagaggatatttgtaaatcatatatatgaaaaggaacttacagatctgcaaagaactcttacaactcaaaaaaagacaaataattcaattttaaaggatcagggtagacatttctccagagatacacaaatggccagtgagcacacataaagatgattatcaccattagccattagggaaatacaaatcaaaaccataatgagatttcacttcacacccactaggatggctatagtcaaaaagacagatacagcaattgttggtgaggatatgaagatatcatacactgctggtggggatgtaaaatgtaaaatggtacggcagctttgaaaactagtctggcacttcctcaaaagattggagttactgtatggcccagcaattccatttctggattccctttctggatttcatttctccaagagaaatgaaaagatatttacatgaaaacacttgcatacaaatgttcatagctgcattattcataattgtcaaaagtgcaaacaagccaacatccatcagttgatgaacgtgatatataaaatgtgatatatccatataacaaaaaaattcatccataaaaaggagtgaagtactgatcctacaacatggatgatcttgaaatgaaagtgagagaagccagttgcaaaagccacatgtatgattccatttatatgaaatgtccagaagagaccaatctatagaaactgaaagtagattagtggttgccagaggctggtaggagaggggactgctaatataataggtatgggtttcttttgggggaaaggatgcataactctgaatataaaaatcactttataaattatggtatgcgaattatgtctcagtaaagctatttttaaaaaggaattctaaacacggtactattagaattcctactctaatccacaggactgtgaagatgatgagataccacaccttgattatgttacattaaatggcaaaagcaagattatccaggtaggcccaatctaatcacataagccctttaaaacaagctgttggccgggcgcggtggctcacgcctgtaatcccagcactttgggaggccgaggcgggcagatcacgaggtcaggagatcgagaccatcctggctaacacggtgaagccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaacaagctgttaacaaggaagtcagagagatttgaggtaggaaaagaatctgttacgctgttgctgacttgaagatgcatgggaccttttaacaaggaatgtaggtggcctctgcaagccgagagtggccccagctgacagcaagcaaggaaatggaagcttcagtcctgcaaccaaaaggaattgaattctgtcagtaacaggaatgagtttccaagatgaccccaagctccagatgaaaatagaacagctaaaatacctatcagcacacctggtgtaaggaaagaccagtgatttcagcctaagtagagaagccagtcatgccgtgccaggcttgtgagctacagaaccatgacttaataaaagggtgttgtttaaagctgctaattcatggtaatttattactcagcaatataaaacattcccccaaatgtttgaaagaaaagagcaaatgctatgcacgtcaaaaagaaacacaagtgtaatatagcacatgtaattatggactattattatagagtttagaccaaacataactgtcataacataaatataaatggtcatggctgggcactgcggctcatgcctgtaatcacagtgctttgggaggccatggtgggaaaatcacttgaggccaggagttcaagacaagcctgggcaacatagtgagacccctgtctctacaaaaaaaaattttttaattagtccagtgtggtggtgtgcacctgtagtcccagctacttgggaggctaagatgggaggatcacttgagcccagaagttcgaggctgaagtgagctatgattacaccactgcactccagcctgggtgacagcaagaccctgtctcttaagtatatacacataggtttatgtcacctattaatagaaaaagatttaaacctgactcacaaaaccgttatttgctattttcaaaaacatacctaaatcaaactaaatcaaatgttaaatataaaaagatggatgcatgtttctgggatcccacaaccacccacacttttagatccaccagatccactgcaaggactcacaggactcagaaacagttttagtcccaagtataatttattacactgattagcagggggaaaagacatagttagaatctagaggaatccatgcacaggcttctgaagtgttccctcttgtcagtggtcacatagaatacacttcttccttaaatagtgaaattcaacaatatatttgcagtgtttcttccccggaaagcctatttaagcctcaacttccaggggtttattgaatgctggtcacgttggcaaaacaaccagtcacagctctcaaaatttcagcctcctagaaggatagctgtggaatcaaaaattgttactgcttttgctgctgccgccaccactacaacttccagccctctgagaccaaaacacctgtgaaactatgcgagaagacctggtctccccatttgttctctcctcatctgctgattcccttcttccaggctttatgaaagtatgtttccatgcaggcatcccagtcaccagagggagtctaactgcactggaatgtaggaaatgaggtctttagctaaccagtctaaaataaaggaaagcacgccagcggggaacaggaggaggtgttaattgagccagtctgcagtaactgccacatcatccttcaaggcccagatcagctgtgtgcagtttctgatgttttctatcactcactcagtctttgtcaacctccctctgccttcaactcctgtggctctgacagtcaatgtcacctagtttaacacataattacatattatcttgagttttcacttttgtttcatgtttgtcttatatatctaactaagcaataagtttcttgaaacagtgtctcctacttaaattcctaatctctagcattaatttcccaaagcttaggacatagcaggtcctcattaaatacctcagagagactgtttttcactagaaaatatattccagttatcaatcactggataacaaatcatctcaaaacatagtttgcttgaaacaacaattaactgtctctcccagttctgtggattgactggaccagctggggtagttctcatttggggtctctcaagtggtcgcagttagatagcagctgggactggaatcatcaaatggcttctacacgctaatgtctgcccccctcagtacttctcagtatgccctctctctccaaaagagtagcttggatttagtatgtgatggctcaggaatcaaagaaaggcaaagagagactgccagttctcttaaattttaagtccaaaactggtacaccattttttcacaatattttatagggcaaggcactcacaggccaactccaaactcaagaagttggagaaatagactcacctctcaatgagaagtgctatgggcatgcagggaaggaaggaattgacagcacccacctttggagtaagctaccacagagagttttaatccacggcatatctaaagatgtgagtttcatctctcttactctgccatgcaggttattccagccaggtggctgacaaatgcttgtcattggtcacaaaggcaggacagggagaatggctatgcctattcagatattgcttctcatatatggcatcttgataggccaagaacaatgtataatttctattgctttccaaacatccgcaaaatgtttttagttatctcaccaaaatgataggctactaagacaacatgataaaaacagcattaggtttggtgtccacagctttggtcagagatttcattttatgaattacttaacatctttgaacctcggtttccttatccttaaaacgagggtaaggatacctgctttacaagattgttgaaagattaaataggataatttatgcccatttcctgtaacagagaattatacaaatggaatttattgcatgcccttctcttccatatccccaacaccacctcctcaccaattctgaagtactgtgtcggatataggagtctctacaatggatacttcctaagcaacttactatctgaaagttattaaagtcaacatgttggccaattaccttgccatgggagtattccaagcttaagtatgacatgaccacatctgcagtagcatcacagtagttttgtctgaacctataacccttccatggaggcctgttataaacagtaaataattgtatgtgtcctctttcaaacccaaggtctatttttacttactgaaggtaaagggaagtgaagacccatctaaggtcatacaactagtaaatgtataaagcaagactagaataggtagagtctagaattcttagttcctatattgggctattgctgcatcccaagatttgagtttctggcaacttggaggaaattttataatgcataaaaaggacactggcttaattataggatcagtgaaccacataaaatgattagaagtttctgccatattcctagagattttaaaaactgaagctaccctcctgtgtcagcctcccaagtagtggggacaacatgtatgcactgccatacctggctacatgttgttctttttatgaggagggcaccaatcattggactagggatctactctacttcagtatgacctcatctaaactaattatgtctgcagtaactctattcccaaataaggtcatattctgaggtactgggggttaggacttcaatatctatttttgtgggggtggggacagaattcaagtcataacagcttttatgacaaattttaagtcttggattaaggacttcagaatcttgagtctgcatggccacagacaagtggagaatgttggaggaggtattgaactctgtagtattcccaggtggcttctgctctccctcagagtgaatgatagaacacagctccacaaagagaagcagaccagattatttggagaccttttcccgcttcaaggatttagaaatatgacttaacttttttcttagtatatttttggatggaatccattttttatgttaacccagctttgaaatcctagacctcacagagtagaaggttatgttcaagatgagttttatttagaagaaaagttaataagcaagttttatgtcttataaaagttaatgggttgctattctttatttcttttcactttatcctgagtatatagatttagctcactgagaatttctgtgtgaaatcattaggaatctacaatctctgttttttgttcaataagattaatgactgagcaatgacagtatagagcacagtctgtggatatcctttctatcaggtagactacattgtcctaggttatgggaccatgcctttcagaggccaaccagttctctgctttcattacaggggtaataagtgttcatgagaaggattggatgttcttaagagcagtcatcaacagttagtcaacaactagcgtagaaatgtatgacagcggaccaattgcaactctacagactcttttttctcttccagaatcttccccaggtgtgactgaggtgaccatcatagaaaagcctcctgctgaacgtcatatgatttcttcctgggaacaagtaagtgttgccacatgaactctacctcccatcaaagagaggtcagtgtaaatgtccctgagaaggaaagattaggggaggaagaatatttactcagaccacagctgctttcaaggtagagtttaccttttctatgttcctgttcagcccacttaacagttcctttcattctatgccacttacccagcatggagtgtttcccctgagccccactctcctacagaagcagtggacattcaaagttgtgtacaacaaagctaaaaatcaattaaggaaaagaaaggatatgtgttaataagtgtcatgctgtccagaacatgattaagtgttgcacataactactaagcagattaaaagctaatgctttccaactttcctctgaacttcaattcgtttattcaataaaagttttaagcttctacagtgggccagacattgtgcttggtgttgagccctggggattaaatggtaatattttttttttttttttgagacagagtcttgctctgtctcccagattaaatggtaattttttaaaaggcactgtttttgcctcttgatcttactgcctaagacatagtatagattgttatgaatgtaattactaactggcctgagtactgtgaaagagaggtaaagggagcattgtctggagacctgccctagtctagaggttgagaaaagttttcccaaagaagcaataagaaattgttaaccaggtagatgggatctaggaagatgggactttcagcctctatgaaagcttcaagatgggaaggattacattgttctgagatcacaaagaaggagcacaggagagcaaggtagagagagctcagcaaggaccaggacatttagggcttcataggtcttcagcagtttactccttatcctggaagcaaaggggagtcattgaaatgttttaagtagggaactttgaagttagatttatacttgaaaggaccactgtggctgtagagtaacaaatggatttgactggggcaagtggcaacaaattgccctaccatttaataaatacctgctaacacttaccccataagtcattccatactaaatgaataataaccctgcaaggtgggtattggtatctccattttatagatgaagaaacagaggctgaaagagtttaaagaatttggccggcacagtggctcatgcttgtaatctcagtgttttggaaggccagggcagaggattgcttgaggccaggagttcaagacaagcctggacaacatggcaatactccagctctacaaaacaataatgttaattagccaggtatggtagcacacacctgtcctcccagctattggggaggctggggtgggaggatcctgtgaccccaggaggttgaggctgcagtgagctatgatcacaccgctgcactctagcctgagcaacagggcaagaccttgtttcatttaaaaaaaaaaaaaaaagaaagaaagaaaaatttgttctgagtcacatagctaccaagtggcagagcctcaatttgaacttacagttgcctgcctctaagaacatgtcctttctgctctaccagcgtgcccctctgacagaggacaacaccatgggagtcttgccctcagcaggcaagcagtcctgccagcctgactcccctccctgggctgagccagcagcagcttttctggcagctcagtaactgggagttgatccaggacctcagctcagcagcatcccaactcttctcactcagcccccacctccatttccactcatagcccatcataggaaaagaaaattccagaacagtggctatgaaactcttattggctgatcctgtcaacacctgttcctggtacttctgtgactatgccagtctggcctcattgatgttgttttgtttgttatgaataacagtaacagaaaagatatgatggaggacatttctcttgattctttttgggcttaggtcagccctttaggtattagtagaactgccaggctggcgtggtggctcatgcctgtaatcccagcacttcaggaagccgaggcaggcagatcacgaggtcaggagttcgagaccagcctggccaatatggtgaaaccccgtctctactaaaaatacaaaaattagccgggcgtgatggtgcacgcctgtagtcccagctacttgggaggttgaggcagaagaatcgcttgaacctgggaggcggaggttgtagtgaactgagatcgcacaactgcactccagcctgggcaacagagcaagactctgtccccacccccaaaaaaaagaactgcctcagggctcttttgtgagagtcagatcctcgtgttttcctgtctgctgaggacctggattggaaggtgagaggacaggaatgccttgtctagggtggaacactattatgttgctttggaataaagtgatttctgaggcatattcttccttgtgtcttgtaccatacagtccttagagctctttaaggagaagactttacccatttatcccagttttacttatactgtagtttcttcatttggagctgccttccatagctgagtttcagggatagagtctgcaggggatctcttgggatctaatctgcctcctggacaatgcaactttattaggttcccttttagcttagactgacacttagggaaatgcagttgtagtgctagataaatagccatcagaggtctaaaaggattaaggggtaagcatgagagaaagagatttttaactaactgagacaattaatggaacattttcttcagacatattcatttgggagaatacttgtgaaggtacctaaaataatcagatacgtagatttggaattttcctttgagttctttagttaaaatatctcagatctaagttcaaatatgccaaatctaatatacaaacaaacaaggtgtggtcgtgcacaccagtagtcccagctacttgagaggccaaagtgggaggattgcttgaggccaggagttcaagaacagcctggacaacataatgagacaactcctcaacccctgtctcttaaaaaataagtaagtaataaaaattttaaaaataagatactaacagtattaggatcagtaatataaaaatgtttctttcacctgagtttggcatgtcggggcttgtaaaggcctgggatgcttggaagataagatagcctttggggtgtgtaccttttgttttaagattccatttttatgtaacactttttttctgattatgctaaacaaaacagtcaaaaaggtgtattgaaaatacaaaaaaaaagtctcctaggattttcctacctagacataaccacagctggtgtatttttggttatgtgtgtgggtggagggtaggcattgggatcccttacaagtccatgaatgggaagttgtccgtggactccttgaagtgtatgtcagatatgttttttttgggaggtgggggaaaaggctttttcagattctcaaagggactcataaccccaaaaagtttaaaacaggtttttgtataattttttcattcaaaatggggcaatactcaacatgctattttcttacctacttttgtctcctaagcagtggagggtagaagttttggactgctctgtaactcgcttgtctcactttctcaccctagaggttactgaagagcatgttgacacaggagcaggcttgataagccacccctgctgtgtgcctgcttccagaaatgcctgtaccagagaagcaggaggatcccaaggggctgataattcctacttctctagagaactgaccctagaggcctgtctccttggagacacctcatttagagcccagcctccatctggtgtacctggtgatcacagctgcataaatacattcagataaggcccctaagaaggggccctttgcccttttgggctatatttgcccaaatatatccagagctttggaatagcttccaaatagagatcccctgcagactctatccctgaaactcagctatggaaggcagctccaaatgaagaaactacagtataagtaaaactgggataaatgggtaaagtcttctccttaaagagctctaaggactgtatggtacaagacataaggaagaatatgcctcagaaatcactttattccaaagcaacatcggaataaagtggaagctatttccagagcttcctctgggaagctcactgagatatgttatactagtaaggatatggaagcattttgatgtgggaaaaacacactggagtagaagtcttatgccagctctggacccttggctaagtaatgtaacttctctggatctcatgttcatcatgtataaaataagtaatttgaaatcagtgttattgaaggactcgtccaggtgtaatctagtcttttgtgattctatactgcaaatccaggaagaaagattgacaaccgaaacctaaatgatcatatacctgcttcagtcccctgaggttggagggaaatatgaacaacctttttccatgtttatatatttgaccattttttcttcttaaatacacaatttcagtttgtctgcctctgtgcagttgtatgattcatgttcattgtgcctgctacctgccttttgtcatgatggtccatagtaaggcccagtgtctacactgagcttttcatctttcaagcaccaggaaagcatctgcctcttagttctcataacatcctggtgccagaagagttatgttattattaagcatttcagtgacatttcatagttgcagacggctttacaattcttgattggttacaccctccaatccccagataaaaattcagtttactgatggtgaaaccatggcccacagaaaccaaatgatttggcagaatatctccttttttttcagactcagtttttctacagtctacagagtgggttctgaaccttcttgaagatctgtttgttacacgccccactgtgaatttatgataagcatttccagtagaagaaatcatcctgcgacaccatgtgactagtgaccccctcacttcatgctcttactctgcctgggagattctctgtgttctccaccagtcaacccttctctctagcacttcacttctttctcctggcagcttccccataggggcttcccatctctttaaaattaaaaacaaaaaaccttcaacgtatatctccttctagctatttagctatttgttgcttttcatgccaagtgtgtagaaaagttgtctacaccaggggttgggaaatgttttcgttagaggaccagatagtttatgctctggcgttacagtctctgtcacaactactcatttctgccattgtagctgtgaaagcagccatcaaaagtactgaaatgcatgtgtgtgactgtgttcaaatgaaacatttttacaaaaacaggtgacagggtggatccagtggccatagtttacaaattaccatccttccttcatttctcagttattcatcctgccacagcctctctttagccatcaccattcttggataccattctgtcaaaatcactaggacctcttcatggctaaagacttacttcatctcacttggtgtggctcctgcatgccccacagttagccactcccttctctgctagcctctcctcccttggatgcagaagcagaactctcttgatcttttccttcctcgcagactcttccctcctagttctctttgccccttcagctccacaacacttacctattaaacatttatctctatttaaattaggaatatgtttggcttaaggaaagataaactagcaatagcttaagcaaataggaattaatatttttcatgtatcaagtcctgaggtagacagttgcagttggttcatcagtcctgacaatgttaagccgttatctctgtaattattttgtcctttttctttatggtgcctctgagtagaaaaaacacacactgtttttcctctcctgttactccgcaacaatcaacacagaaaatttccatgaccaaatgtgtgtgtgttgcaagggggagttcccaaacacatcaacaagctatcagttctgcagtgaataccagctgggtgtcctccaattcagttccgacactgtctccctggagatagcatcagatcccataggttaagggctcagtctcacaagactgccctcacttccaatgccaattgcaagtcccaggttgttttacctgtgcttctgacccaccagctataaattggggttcccatgaccccctcctcaggttcaattaatttgctagagtggctcacagaactcagaggaacacttacttaacatttacaggtttattacaaaggatacagatgaagagatgcacagagcaaggtgtggtgggaggggcgtggaacttccctgccatccgagagcacgccacactacaggaacttccatgtgctcagctgtccggaagctcttcaaactctgtcttttgggtttttatggaggcttcattatgtagacatgattgattaaaccatgggccattgataatcaacttacccttcagcccctcttccctccctgaggtcagggggtggggctgaaagttccaacccactgcctgccttggttgttctggtgatcatcccccatcctgcagctaccttggagatgccagtcatttgtcaactctttagcacacaaaaagatgtcactttggagattccaaggattttagaaattgtatgccaggaatctgggacagagaccaaatatttatttcacaatatcatagtggcaaaataactgctacagtctgagctatcatttccaagctcaaaaaacaaaaaagaggtaagggatgtggccaggcatatctgtcaccttttaacaggacagtgaaagttttcttagaaaccttctgttttggacttgtgtttacattttaatgtccagcagtaattgcaggaggttctgaaaacaagtatttaataggacacattgccatctcagacaaaatgaaggttctgccaaggagaaaaaggaaggtggatttgaataagcaatccatgtgtctgacacagccttctctgccccttccctcatttctctttctgtttctagtgccccacacagtatttatcccataatagatacttaataaatgtgaaatgagtaagtgaattagataaaacgcaaaagtcagaaagagtgtcgagccttcccaaggttgcctaacttcttttccacaagcaatccttaattgcattcctgagactcaggctaccacacccaccatctctgaagcagagcagctgtagatgcaaaggcttcccccactaattcccccagtggtagaattttgatgattatataaacttgagggtattactcttctgaaggttgcctcatatgagctctgtcagacacacagcttcaccaagacttgtggtgcctctagacaggccaatatttatatatttttttcttcacgtatttttagagggagactaatggttctgtggagaaaggattttggaaaaagtatgctacctttcctttggctgttaagcaatgcagctctggccccaaactctcataccctactcaacaaaacaaaagggttcagttaaccaagccctccacctctcctaaggtgggagtttgagaatatatttgggaattctcttggggatctcacaccatccctccacagctcatccaggttttcctccacttcatggaatgtcctccctgagaagagtttcaggagatgccgttgtgctcattgccacaatttccagcaatgttctcatgctccttgatggacgtcctgggcagctcttcacctggccatggttgcagaccagccagagagccagctcagcatggaccagcacctacagagacattgatttctgtcctttgggccctatgctgacctgatcctgcatctgctccctagttgggaagtggcctctaaaagtgaggggaataatggggtgcaggattgtccaggagtagaaaaggtgagtagaaggcaatggacagcccctagcccttcccttgaggcccagtgctattggttttctggaatcttgttgatagctcccaaaacaaaaaagtggctcaggtccttcatctgatgaagtagtaacagagcttgtgatggactctttctaaagtagcttaaataaaccattgtagattatctcaggagaagaaaagaaagattaaaaattaggaactatgtgacagaatcaccactgggctagagattgcagataccatcttgatgcaatcagctgttagttcagataccagtcgttgttactctcccttgttggctttctccccagaccctctctccaatcctgatattaccctcctccattcactttctgccgatcttcctcctccctgccctcctatcacaccccccaaaatatagcctgggcatggatctgtgtgggaagaagccctctgatgtgggcagattgctccctgtggaaaagcaaactcttttcaggttggttagaacagaaattttaaaacggcagtaactgagtcactggccagaaaaaaaaaatggtgagatacgttaaaattaggagaggttgtttacttttctctccaaccttaaaggactgaagcaagtatgtggtcatttaaattttggttgtgaacctttcttcctggatttgccccactcagaagagctacatgcagtaggaaggctggagaactgcaggcccagcaactgccccaggggtgcttggggcagaagggtctgcagcaaaaagcagcagagtcagggccgctagtcgtttaaattagaatgacagtgagggattgatgtttttcatgaatttggtttacttgaatatttttatgtatattagtatttgaaatgtgtgttaaatatttgatttcacagatttttttctatttgtatgaattttgaataattgtaaaaaatattggtataaaataataccaaaacttatttcttgggtgaaataaataccataacaaatgttataattactattaattactggaattattcagcctgtcttacatatgaacaatgccaaatagtccacctgccctcagcctggatctcatggaatccccattaagaaaggcggatagacagtagtttccttgtcttcaccactagatggcactagtgatcaaaatgtcagagcaatgctgtccttttggggcgacgagaggagcaaggaccttgcagaacactggtaactgtaggcttcctgtaccagggttttaggagtgggagaaaggcattctgcaagtgcattttttcttctgaaagcacagataatgtggccacacaggaggcactaggagcaagcccattactcctaataataggaaaacaaattagtccaaggagtctgagtctcttaaatttcacatttatgagactgggtactaaataatggacacagaaaaaacaaaacttgatcagaacatacattttagttcataaataaaagaaatttaaaacctgtttcattaaaatgacagctgttgtccatttaataatctaaaaacatgcttaaaatctccggcaagcttgaagctttctctttatctatagttcctgaagatgctgtggctgtgaataataataatttcctagtctcctctcttcctgtcaaactcacaccccctcgtactgccagtgttctgtatattaagtcttagagtttattcttgaacctagattcacagagtgatgtgttcgtcactcagctactggcagagttgggaagtgaactcaaatcgtccttctacatgatgctttcccatgcattgggtacctagaactgactgacaggatgacctaatgcagtcctgacataagcagttgtcggtatcacatctcagaagggtccagtaagccacaagcttggatagttattaacatgttgcctctttgcctctgtaactacatcaagaagtcactctagggggcccaggaaatgaattggagaactcatcctttgcacattccagggatttgagttggctagggaagactggtcatacacacacacagatgtgagttacttagaatgtagggcttgttcctggtatctcctgaagggatactaagtttcttctttgttctctccagcaacggtttggatgatttcatatccatggatatgtgaaatatttgagtatatatggttaccttctaagagctgtcagaacttagacattgcataagttttctggaaatgatatactcttcactttgttttttttttgagatggagtctctctttgtcacccaggctggagtacagtggcacaatctcggctcactgcaagctccgcctcccaggttcatgccattctcctgcctcagcctcccgagtagctgggactacaggcgcccgccaccacaccctgctaattttttgtatttttagtagagatggggtttcaccatgttagccaagatggtctccatctcctgatctcgtgacccgcccacctcggcctcccaaagtgctgggattacaggcactcttcacttttaagatgctctcatttgtccaataatttgtttcagaaaataatatatgaccatgggtctgatatgtacggcagtgattgctttgcttgaacattgtcagactttacctaggacttcccctcttgccatgttcccctgtctcctcttcagcttgttccctttgagctcctttgccaggtggctgcccattgaggcattatcatggcagagcaggtacctggtttgcattagctgctgaagaaaaaaaaggcaaactggaactctgcttgcaagaccccagtgcctctctaatagagttttgtaggtgactatcagagccttcctatttcagggacgtataacatgctaaacgtgtccccagtgccttaagccatagccctgtaccctctttcccagcccttacctaacacttagctgctttgtgattctagaagaataactgtgtgatgcctgaagatgtgaagaacttttacctgatgaccaatggcttccacatgacatggagtgtgaagctggatggtgagtcagcctccttgtaggagaacatttccctggctgagagattgaatgggacaactctgagggcccttcgacttttgagtctttgaatctggatggttttcatgggtgcccctcaagtgccatgtccagaagctgtgattatgtcccaaaactaacagatgccatcattgcttcacccaccacaaatcccacgacagtctagcagtatggaactggaagttcaatttagaggattcctgtaggaatagggtagagaaaaccattaattactacataaaaaaccctagccacctcaaacttaaagcctcagagggctctacctccaagcaaacccctcagggtaggcggcagtgacagtctctagtgttgatgagggggccacttatctctttcaggctcttcctttattcccaccatcataaagaccttagggccctaatcctcaaaccagagtcttcgcttctctccttcacatcacctcagcctaagtcaccagctacctcaattcacaggctgccatcttttgtctaggacaaaacatttttgtgtggatgtgggaactcacaagtttgtacatgtcagattgtaggtactatgtaggcataaaaggcagtgctgaacatttaggtgaagactcttgaaaacatttcatagtctagaaaaccctgtccagccacaggagcccagcccgttcgtggcacagattccccagcccctcccctccagttcctcccctccagtccattattgtctctgactccaaccagatctactttggccttgggaagtaccctacatttccccactgctgtccctaaaaatgcagtgacttctgttgtactgcaaatctacagagcagacttctcccctttgttgcctcggccttctacctacacacctgagttctgtttgggtgatttccaaagccttcctgtctatcttgcactgctggtcagaggtactttttttttttttttttttttttttttttttaagatggagtctcactctgttgcccaagctggagtacagtggcgcgatctctgctcactgcaacctccgcctcccaggttcaagagattcttctgcctcagcctcctgagtagctgggattacaggcatgtgccaccacacccggctaatttttgtatttttagtagagacagggtttcaccatgttggtcaggctggtcttgaactcctgacctcatgatccgcccaccttggcctcccaaagtgctgggattacaggtgtgaggcaccgcacccagccagaggtacttttttatagcttgctagtgaatattgaacattagcttttatcttagaatcatttcctcctttggcttagaaaccatccttgtcaccagcatcagaaccttcttttatagcatggccgtggcttttggtgtctggagcaacagagaggggacagagactaaaccaactgacagactttccctggcccacatccttgcaacaggctagcccctttatatgcctgcttcagagaataaaattttatgaatgagtcccagttcattattgcaataccctctctaatttaatctccccaagcccagtcttcttatccccatttccatacccatgatatactgaacagcctaagtcagagacagaaaaggcagcagaggcatcttctgatgtttgcctctttagtggtcttttattcttagacattccatggtctttacacaggttgttttattgctttaaaccattccagttttttcagcaaataaagaaaacatggagcttcctagtctgtatttacaccctaatcacagaagactagaaccaagcaagaagactgccaaattctcatcactgagtaagggaaaatgataaagagaaggggggaattttttttttaatcatgaaagcttataacaagaagaatagaaggggtccattatataatcaaagctattactccttcagaaaatgtttatgcagaatacttgctaaacaaaggaaagagggagcaaaaacattttaatgtcctttacccttcaaatgtcccaaagcccagatttcccagttctttgttggtattccctttgaaatttttcttccactctaccctaatacatacaatgggggctcttcatcacccgtggcccccagttcctttttttgtatgaaaggttggtactttggaatatgcagtgagtaatcctcttcttcccaccttccatcagattcgtcagccatggggcgaaacaatacctgggcttaggttattcaagcagaatctcatgataaccattgtaactaggctgttactccatgtaattctccttaacgcatgttcccctagagcacatcattccactgggaagcatggcaattaacagcatctcaaaactgactcagctcacccagtcttccatgtattcacttcctaatgcacccactctggcagacctggaggacgatacacatgaaggtaggaagataccaaggttggtatctttgtttccagcatccagctccatgcctggcgcatagtaggtacttaatgaatcttggtgcatgaatgaatgttaaagattaaacctcactcaacatttcagtatcaagaggattcagggaacatgacaatctaaatacagctcctttcctctccatttttacctccaagctctttgccacttctgagtgaaatggctcataagtcaagtggctgctaaaacctaggagcaactgggtataagtgaggacttagtcagagttgtgtttggtcgcatataacagatgtagttacaatgtttaaatagcaatttatttttctcataacaagaaatctggaactaggctgatgtcgctgcttgagaaagtcaatgataaagtctccctctggcattgtgctgcaccaggctttggatatggttttcatccttatggttgaggaaggtgggcttttcctgtcaggaaaaaagatgagtaaacggcaaagggcaaaatacctggctgtttgcagaatctctcccttttgatcaagaaaacaatggttttctcagcagcacctcctaatagctattagaagagtcaaatggcaacccaggttgccaggggtctgagaaggtaaatacttttagttgtgcagtatggcttccttgaacagaactgggctttcattaagaaagaaaggaagaacaaatagtgaataggcaactaatgtctccaatactaagaccttggggttcactaagccctggcagagaaaactgatgtaaggctttctcctccgattggatgagcaattgaagaatagtaccagagaagttcgggggcagaggctagacagtgatgggccctggaaagagcctgtcacacaaagacttgtggaatttccaggggtaggaaaaaggtctcactgtctttatatgtatggggtgggcttctctaaaaggtgaagtagtcaaataggtgggctaagtcttccctgctcttgaggctggaagagaagaggtagagtaggtaacagagaggcttcatgggatcacattgttccacatacaaatggggataaaaaccacttggccttccgacacctgctagattcatgcattttaggatagtacaacaagtatacctaagtctcattaaacctaaatggaaaaacagtgacttctgtcaggggactcagcagtcagagagaggatcatcagcaaaaaatagaatacacagtaagccgggagcagtggcatgagcctgtattcctagctacttgtgaggctgaggcaagaggatcactggatcccaggagattgaggctgtagtgtgctatcatcacctctgtaaatcgccactgatcacctgagcccacgagtttgaggctgtagcatgctgtgatcacacctgtgaatagccaccacactctagcctgggcaaaatagtgagatcccgtcactatttaaaaaaaaaacacaaccagagaaataaaactgctagaggacacagataaaaatctaagaacaagaatacttaaggagatttaagacaacataaagactttctatggataaaaacaaagattctcaaacaattgactacatgaattgaagaggagtatatgtattttattgagacctgagttagcctgaaaaatcaagtgcaagaaatatcttaaagcatagatgaataaatttaaaagaggggaattatgagggaaaaggtaggaattaagagaagtggaaaatagattcaggacactttccattggaattatgggtgctcaaaaaagagaaaatagatggaaaggcagtaaatacatactaataaaagacacctctctgcagatggaaagggcccacctagacccaagttgaacagatgagaaaacacagacactgatgcatatactgatgtggagaaaattacaagcttctaggcaaaaataacaaattacttgtgagggaataataagcacactgacattaactcagcagatgaggacacaaaaccccatgaatgagaaccagcacagataacaggtaacagatcagcagtggttaccagaggcttggggtggggaggctggacagggaaaggggaaacgttggtcaacaggcacagtttcagtgagacaggaggaataagttctggtgatctattgcacagcataatgactatagctaataatgtatatttcaaaatagctaaaagaaaggattttaaatgttctcaccgcaaagaaatgataaatactagtggtagatatgctaattagcctgatttgatctttccacaatgcatatacatcttaaaatagcgtgttgttctccatcaatatataaatatatacaattattatttgtcaaataaaacaattaaaaataattgtcaattaaaaaaataaaactttaaaaaaattttaatcaagaaaaaagagggccgggtgcggtagctcacacctgtaataccagcactttgggaggccgaggggggcgaatcatgaggtcaggagatcaagaccattctggccaacatggtgaaaccccgtctctactaaaagtacaaaaattagccaggcgtggtggcgggcacctgtaattccagctactcgggaggctgaggcaagagagtcacttgaacccaggaggcagaggttgcagtaagccaagatcatgccactgcactccggcccagcaacagagcaagactccatctcaaaaaagtagcaaaagagatccattggtacagctaagagtgacgttattagatacagagtacaaaacgatatgcttatatgcccctgtggaggtaaaaccaaactaaaatttcagggaggaactgaaaacggtgacattgtagatttgaaaaaaaaaaaattcgtatattgacattgtgtttataatatggcagaatctcttttaccagagcaagactctgcaggtaatactctgtactctggaagaattttaaaaacgtgtcttaaaggactggagagtagtcaaaagcaggcagaagctggaatggtgtctacagttggcagaagggagccacattgagttttctgttcttacaacttttcaactgagggcagacctcagtcagcaccaggcagggctgccaaaacttggtgggaacatatcaactggactttttatttcatccaagatggagtaacagaccagatttatctacccacctggagcaacaatgacaaacaacagacaaaatatataaaacagtgattttcaagcactgatatgaaaaatgcagtggtttggattattggtggctaagacattgcagaagaagagactagagaacttcaacacataatagaagctatctaaagttacacagaacaaaaattatttataatgaaaacagcatcagtgacctgagggacaacatatggtataatgtatgtgtaattggagtctgagaagaggggtcaggggctagcaaatatttgaagaaataacggctcaaaagtttaccaatcatgggaactataaatccacgtatccaataagcttaataagccaggaacaagaaacacaaatgataacaagaaacaccataatcagattgttcaaaatcaaagataaagagaaaatcataaatgcagccaaagggaaaagacaaattacatacaagagaacaaagataaggataacagcatatttctccttaaaagcaattcaagtgagataaaatactcaaaggaaaaaataggttgttcagtcattcacacctgtaatcccagcactttaggaggctgaggccagaggatcactagagcccaggagtttgagatcagcctaggcaacatagcgaaactccatctctacaaaaaatttaaaaattacctgggtatggtggccacacctatggaccccagctacttgggagtctgaggcaggaggattgcttgaacccaggaggtcaaggctacaatgaaccatgttcacatgtcactgcactccagcccaggtgatagagtggagaccctgtctgtctcaaaaaaataaaataaaataaacctagaattctatacccattaaaatatctttcaaaaacaaaggacttccagtctgtctccctggatcttaaaaagtcctttttgaagagcaatctggcaacatctattctattgcagggaatctgtcgcatataatgaaagcaccagaatataagggcatgtacagagaagattattgtagcattcacaaccaagtaatggtaggcaaatgcctatccatagaggaatggtggaataaatgagggtacgtcactcccacagactatgaaatagtcatttaaaaagaatgaattagagttatgccacatgacttagagggcttttacatggttctgaccgggcgcggtggctcgtgcctgtaatcccagcattttgggaggccaagatgggcagatcacttgaggtcaggagttcgagagcagtctggccaatgtggtgaaactccgtccctactaaaaatacaaaaattagccaggcgtggtggcacatgccggtagtcccagctactcgggaggctgaagtaggagaattgcttcaacccgggaggtggaggttgcagtgagccgagattatgccattgcactccagcctaggcaacagagtgagactccatctcaaaaaaaaaaaaaagaaagaaagattcagataatgtgtttgctatcccacttttatagaataaacaatctcaggaaaggaaatgaagttatgtcagcatcaagccattcagattgctctgtggtcccacttccaagaagtttgctttctcatgcctccttttcccagattccctgacattgtctgttgctgatagagaaacccagacagaaggcctagtccatgaatgagattagggctttaattcaaatacagaatttatttgtaaatactacttaagtatatgtctgagataaggctttttccttctgttttttccacctagcaaagttggatatataggtatgtgtttgagttgagtttgtttgaacattaccattaacttctgggtttgcagccagtgatgatcagccagagaagcctcactttgactctcgcagtgtgatatttgagctggattcatgcaatggcagtgggaaagtttgccttgtctacaaaagtgggaaaccaggtaagaattgtttacaagcgtggtcccgtagtttggctagggtcttgcctgaccttgcttgtcagccatggctcaggagacacatacctccttggcctcttgagatgctcccaggttccttgtgtgtcccaaacccaaaaacccctttggttctctctgagcatcaccctttgggctaattattagtccttttatccatcttcatttgtgagttattgccaaatagttgatgagattagaatatgggagtaaaaactaaaagaaataggcattttgttaatagactcctacagcaagttcatgtactagataagcatccagaaaacacattatcttttatacttctatatctaggccaattaacagcaataaaaacctgaattactagaccaaagacccctgatgggaaattaaaagcctctctgccctcaagcagcagctgccacctagccccctaacagcacttcagaccccagcctagggactgtgaaactacagagctggacaatggcagccctcttcagctagctgtctggtaggggtgagaggatacagacaccaggatttacctctggggcaaggagaaatcatccagccagaggaattgttgcaaagtagtcatggagctgcatcttgaactgtggggtaggaattagataccgggtggggaggaggatttggtggagtaaaagagacaagggagcatccaagcaaagggacaaatgggtaaaagccaagccatgggaaagtacaattgatttgtggggaatgacaattccaattcagtgggccacatggttcatgtagggggtgaggaggagattaagctagaaggctaattgctgtctctgatgcagagctttgaaagcaagcaaaggagtttggacataatgtggaagacagtggggagctaatgaaggttgtttagtaaaatggcagggatcatgactaccagcagttttggcaaagaaagagactggatggataatggagggcacttagggagatattatagctatctagacagcagaggaagtaagataggcttgaagtagtaagaatggaaagtcacaaactgggaggcaggacatcacagtataggcaagactcccaggagtgaactgggctaagctccttcatggtggttttttgtggcactttttgtttttcatggcaccgatagagacttcttcaaaaaaacctaagccattcagtgtttttctctctcaggaaagctgagaccacagtattccgcccccctaccgggggaggggaatgctatgacacacagaaaaggagtagctgcctagatagcctgactggacttccagatggtcagagaccagcagatagatcaatctactgatctagcaaaaatttgtaagagtatcaaaggaactagtaaagtggccactagagaaggagactggagggttagaagtggggcagaaggggaacttttactttacattttccattctctctgttgggatttttttttaaggccatgagtataaccttttacagttaaaaagaaaaaactgttaagctattctttatcttttacttcctttgtcttctacttcagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaaggtaagggaggaacacctgccattgtaaactatggtatattccaaaatctactgaggaaatggttacattgcaggttcccaacttccctatctgattcaggagatctagggtggggcccaggaacctgcattttcaataagcaagacagatgattccaatggacagcctcactttactcatctagttaagtggttcccaaacttgactgattctcagaattaactggggagttttatttttaatgaaattctgttggatagtttatgtcccatgacttgttctgggttggcagtacatgcacccaggaagagtgaaaagtcagattctcactcccctgttctccaagtgtgcatccccagtggcagctgctattacgagtttcctgtacgcccttcccaagatactcattgcacataaagcatgcatgcacacttttggtgttccttttttctaaatctcaagtgtaatgtactgtcaacatgattctgcatcttgttcttttcacataacactccatcttggggcttattccctttcagtacatttagggcacttgtcctcttcagtggctacagagtattccattgtgtgggtgtgcctcatttatattacaggtctggtcaccatttcaggcatacagatgccaggtatacaacctggtttgaaaacaccaagtgtggctggaaaaacttttgactagaatgagctcatctgggctccttcgtggtggtttcttgcagctataaattagcagcaaattaggaactcagctccagctcaccttactgtgtatgtattcatctagtaggcttcattttcttcaaatgtcacataattataacatttatctggtcaacattgagaggcggctgtgatttaaaaggtaaataaatgtggatgccctttgccctcagctgccaaaaaaaaaaaacagtaggaaacagaacaccaacaagatacagcatccctcagcagaggcccacactagcctctgtctcctgcctttcctgggggaatggtgctgccagaatccacctgatggggagtagctggtttgagggcagaacaatagacgctgtcctctagtgctttgggatctagcatcccaggctcaggactcactaaatcagaaggaggtgtgctcagattcttagttttcatactgcatttatcttaaaggtcctgagacctcataaagcaatgtgtctatcttaccagaggttgatgggatctgttatcacctccacttaaaggaagagcaaatagatttttaggcagtttttcatgaaaatgtacctctgcctcctgttcccaactctcctgcatcccacaaaaagagcacacagaatggcatttttcctttgaattgtgaccttgtcttccaattctgccttacagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatca

SEQ ID NO: 37922 - DNA, 4152 bp, Homo sapiens
atctccctccaggcagcccttggctggtccctgcgagcccgtggagactgccagagatgtcctctttcggttacaggaccctgactgtggccctcttcaccctgatctgctgtccaggtaagccagtttcctggggttcctgatttggcacatgccagccgagagggtgggggtgccctgttccctgtggcttcaggtggaagagaagtcccaaaagttgctgaggttcttaggtttttttgttttgttttaagacagggtctcggtctatcacccaggctggagtacagtggcatgatcatggctcactgcacctccctgggctcgggtgatcctcccacctcagcctcctgagtagctgggatcacaggtgagagccaccatgcccagctaatttttgtattttttgtagagatggcaggggctggtctcgaactcctggactcaagtgatccacccgccttggtctcccaaagtgctgggattacaggcatgagccaccatgcccagcctgctgaagctttttaaattttttatttttattataggcaggttcctgttctgttgcccaggctggagtgcagggtgtgatcatagctcactgcagcctccaactcctgggctcaacaatcctcctgccccagcctttgcactgctggcccccttcccctggatcactgcccccaagtatctgcagggcgtgccacgcccctgcatgcctttgcccacagagtcaccatctgggtgaggccttcattgagcacagtatttaaagtggcctcacccccactccctgctccctttctcggcgctttcctgccatctgaccgctgggtgctctgcctgtcactgtttactggagctccgccagggcagtgtttggtctactgtgatcactgctgtatccccagagcctgatgctttggacatagcaggtgttcaaaaagtgtttgtgcaagaaaggaagggagggagggctacagagggccctctgtgggagggctttatgggggaggggacatttgggctgaccttaaagactgagtcggatcccactccatggagttggagcacagcctgaggaagactaatctggagctgatgggcagatgggctggaggaaggagagccagaggcagggtgtcagctagggggctggaggaaggacagccagaggcagggagccagctggggggtggcctcctggtctagccggggccatgacacctgacaaggggaaagtagcagcggggtccccaatgacctttcctcttcagtccctgacccaggagccagactgcctcaatggacagctccactggagggcagggggtggggggatgacacgactgcccagtgtttctggttttccaggatcggatgagaaggtattcgaggtacacgtgaggccaaagaagctggcggttgagcccaaagggtccctcgaggtcaactgcagcaccacctgtaaccagcctgaagtgggtggtctggagacctctctagataagattctgctggacgaacaggctcagtggaaacattacttggtctcaaacatctcccatgacacggtcctccaatgccacttcacctgctccgggaagcaggagtcaatgaattccaacgtcagcgtgtaccgtgagtggctgtgctgcggggccctcctctcccctgggacagaggctgtgtctactgaatgcacacagagcccctctgtgcctgctcctgggcactgtcatcgtggggccctgcctccctgagctcctggggtgacaaggggcaggaccaggccagcccttggttggatgccttgagcccgctggcatctcaagacgcagacaacccacattttgagtcttgcttaggggaggacaatctaaccaacatttagccaaatccagaagtcatttcccaacatagctgagtcaccagagcaccccatgtcccatgccaagtagtggggtcaccatcaggggagctgagcctgtccatctcatggcaagaaggttgaagtgtcgcccagggtttttatcttcccctcagggcccacagcaaatgtgtggccatcacactccacctgcacatgagccatgaaaaccttccagatgggctgggataggacatcttggcgctaagggtatcacctgggtccattccatcaccagtttcagtggatcaatgaacagaaaaacatcttaaatccaacatattttctcggggtgggaggtggggtgagtggaagtgaagtattctaattcaaaagagaatccagggcaccccctcgggtggttgaatacgtgaggaatcgtggtggccatggccctgaccctggagaacctgggcaggtctggctctggcctctgcctcctaagtgatgaacttcacagctcagttcctccagtgcccagttccagtgagcaatgcccatctaagtctctctcaacgtgatcacccaactgtttaatgtttgaaatttatatttcatttctgaaggagaggagacagacccaaacttttatatctttccagttggctgtacaatttctgaaccttgtccttgtagacacctggtcaccggaaaccatcatgtctgtaaaactaccacacagtccagcctccatcctcaactgctgccctcttcctctctgcactggagccggccaggccacctcctccccaaccgtggaacaccatggtgacaggagatggccctggccagggggaggctgctgggactgcacccccatcctgaccagacctccctcctttgtcccctgcagagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatggtgaggggggatccgtggatggagttgggagtgataagtcactttcagcccctcgggggaagaaaaatcttgagtcccacttgggaagcaaacacccaggagcccacccttcatcctgaggcttccctcttactctccctcttccctgaagttctttccaagtccccagcttggacctcaactgctccagaggtcgggagaggtcaactagttcctcggccaccatcaagccccatgaccttgacggctctccctggccttggctcccctccacaatgagaagtttggcctgactgcccccactgaggtccccagagctctgctgcttggtgaccctggacggccggcacacagggagcctggcatgaagttcactcagctctgcccaagaaggggcttggctgggaccatgccaccctccaggccacggtgtccagcagctacacactggtcccatggctgctgacaaggggacatctgccctcacagccacacagaagtccagctggtagcctgagccctgggccaccttttttccagataataattttaatgcagacaccattcaccactcatctctgcaactggggtgactgctggatgcatgagcgggcggcggggtctgggggtctgggttgggggtggacttccactcccttttggtccctggtaactgggatcacaggacgtctaagacccttgccccctccctccccagagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 37923 - DNA, 20442 bp, Homo sapiens
accctcaggcctgacggtccgagtggagctgcgggacagcccgaacctccaggtcagccccgcggccctccatggcgctggtgcgcgcactcgtctgctgcctgctgactgcctggcactgccgctccggcctcgggctgcccgtggcgcccgcaggcggcaggaatcctcctccggcgataggtgagttgtccgcgacccttctcttcccagccggcaaagagcgcggagcggcggcgcctgcgcacagcaggagaaagtgcgtgggggcagctgcccccggcagaggctcgggctagcggggcccctgacgcgtccggcgttgaccacggctggtgggcgcggggagggcgaccaagggactacagcgttagggcgtccagccgggaggccggggctgggcgggggaaatgccctcgccggtgggggcgctccaagggcgcgtcggccggatttcgccagcctggcttttgtttacatcctgcatctcagttgttttgttccttggggaaggaaggaaaagctgcgggactcaagggaagaggaagctgggagtccgatgtccagcacagcaagaggcccctaatcggtcctgaatggagggggactgcagtttccccaccagctcagggaagtaaatttcagcgtgactcacactatcttctgtcttgctcgaccgagatcagtggctttttctgccactcacccagccagagcgcgaaagcaccctcgggtagactcaccccttagtctaccgtggaactcacggggacttcatttcacctggatgtccactaggtttcctgcgggcgggacccattttattcactcccagcacttaacacagtgcccgttacagtagtgattctcttaagtgtgccctggaccggtggcagcagccgccgcacttaaaattgttagcattgcaaatttccagcccatcccagacctactgaatctgaaacgccggcgttgggcttccacagtatgctgtttaacccaccctccgcatgattcctttcggctaagtttgagactcactggtccagaatagatacattttggtgggagattgtacaatgccatccgagcctccagttccaaaaatcaaggtgccctcacctcctcaactccctttaaaaataattgcactgttaagaggaaaaacaaaattagagaagtggggttctgttttcttttaggggagagttgtccctgagactcggtagcagcacctagtgctgaaacctctttcgctccctctgtgctttctcaggacttgggagcgctctagggcaaatatcttctctttgaaggccaagtcctcacgactcagctgtcaggtctgaagcaaaaactgtaaatctggtttccgaactgtggcaaatgtcagtcattacaagaaatttccccaaaatgtttatgtatactggtttctgcttttattacggcttagcttgtgttcctttaattatgtgaccggttagggttttgaaataaaatgtctcacgttgcttgaggccacacaatggcaaattcacctgtgttttaaagaggcctgaatgagcgctttctggggactctgtgagtcttcacacctcctgtttgggaaactgcaaggttgaatcccctcctactaaaggggaaggaagaggggttactggagttcagtggtctgaagtgttactggagtcactggagttcgaaagtctgaagtgttactggagttcaaaggtctgaagtgttcactcagcagtttcacaattctccttgtttgtaatattttgcgtattttccacttgatgtgacaactctcctgcctcctctcagccccacatgcttggacttcctttcagcatccaccctgcctggctactgctttcttgttttgtgtttttgcgtttaaattcccagtcttagttttctgccctgtcaagtcctggtggtcggacgacagaagttctaggaagcttcacctgtgtgtttttggctacagttctttagattgagtaggctgggactggcttgtgtattggtactgttaaagcaaactaaatacggcctgagaaggactccttacttctatatttgaatccttgtgaatgaactgtaacctagcttaatagtcagatgagactgaaaacctaacttaagagtatgcactggtaacaatagctaagtttggccaatcccagcagccatacttcaaccattcatatactgctgagtgttcaaactatgttcaaataaggcataaggcgagctgaattatgtctgaactatggttcattggattcttgagaagttataaaatattttggattaaaagattttctggtataattttgagagtttttctagatttgctgaacacacacacatatttttggaagtctttttaaaaatttattttattattttattttattttttattttgagacagtctcgccctgtcacccaggctggactgcagtggcgcaatctcggctcactgcaaactccgcctcccgggttcacgccattctcctgcctcagcctcccgagtagctgggactacaggcgcccgccaccatgcctggctaattttttgtacttttagtagagacggggtttcaccgtgttagccaggatggtctcaatttcctgacctcgtgatctgcccatctcagcctcccaaagtgctgggattacaggcatgagccaccgcgcccgacttggaaatctttttaaagatagtctgcagaacaggaaaacgtgctgtagtaaacagaactttggactttgaactaggaaacatggattggagtgtgggctctgccacaggccaggccttggaaacacacataggcacacagtttcgttaggagagggacatgaggcttccagatgttcattattcatgagtcccaggttaagaacctgtcagagctctgttcttggcttctgtttaaagacatctttcagtgaatttaaatgattatcccctaatttatctgtctggaatgccatgcagtagaaagatcactagactagaagtctggagagactggttccagttaagctttcattactgagtcatctgtgatcttgaggatatcatgaaatttgcctttgcctaaatgtcatcatatataaattaaagaatgtttgttgaagggctactataagtcatgcatattctagatgctggcgatataaatctaggtactaaattatatcagaggggtgtactcttaatgcatttcaggtttgggtttactgaaacagatgctgaatatgtttatagtctcttttcccctaatcttcacagtatctcgagtgtagatattgtcgttatctgttttctttcttcttcttccccttttttttttttttttagagacagggtctctgtcacccagggtggagtgccttggcccaatcttggctcactgcagcctcaagctccctggctcaagagatccttcctaagttttgtattttttgtaggcatggggtttcaccatgttgcccaggctggtctcaaaatcctgagctcaagcgatcttcctgcctcagcctcccaaagtgctgagattacaggcatgagtacccgttttcattatctgttttcatgtgaggcaagtgagattggagatatttgaatgtgaaaacacagagaggaattgtatgtggataagggcaatgtggactctggagtcagatttcctgaattcatagtttagccctgttgcagatgatagtttagatctgttgcagatgatgcatgtaacttgaatttaatctctgtgtgcttcagtttcttatctgtaaaatggagtatacataataatgagctcatacatgtgaagcataaaaaatagtactaaacatgtaataagtacttgaattttaagtattacttggaaatggggtttgaagttaaaaaaataacagtaaaactaacattgagcttacttggttccatacaccttctaagggctttacttctactaagtcacttaactctcacagtaggcactattattattcccatttcatcaatgaaataggccaagatcacatagcaagattagtgggtggtggagcttgggttggaagtcaaacagtctgactctggcctccactcttaaccacgacactgtattgtttcatgttcatttactatacccttacattctcgaaataatacaaatacatgttcacgttaaaatgattctctgggatgactctgagctatttgccatctttactttttgtgctgggtaaagtatatctaagatggaaataaagattggggtattttctgcattatggaataaaataaaattgcttttgtcagatgttttcaaatagtgactaagtgccaagtaattgaccatactactactttcttctggatcttttgtctaccatttcttagttgtgaacataaatatgtcatggaattataatgacaactatgttgggaagaaacaaccaccaaaagataactcacccctttcaccttaacgtatcaactgtttcaccttattatcccagctttgggttttattcagttgtaacatattggtagagtttaaagtttgcatcctacctgtttactctgtgcttctggtgtagtacatgctactttgtcacttctgatgtgtttctagtcataatcagagtaaactcaaaaacccaaaagtgtggaaaaaaatctctttattaaaacaatttgaacatggtttataaggatcattgaatatatatatatataaatgatgtataaacaaacttggaagcccttcagtatgggagttcagatttattagctgtgtatactttaacaaattttctatttgacccagcactggtttttcaattctaaaatgaggaccataattcccagttcggagagcagttttgagaatcaaatgacatagtatatttaaattgcttatcacagtgcctggcacatagaaaatacttaataaagagagataccactgtgattatttgttctagtattaccttcaataaaggaaactttcttggccgggtgtggtggctcacgcctgtaatcccagcactttaggaggctggggcgggcacatcacgaggtcaggaaatcgagaccatcctggctaacatggtgaaaccccgtctctactaaaaatacaaaaaattagctgggtgtggtggcgtgcacctgtaatcccagctactcagaaggctgaggcagaagaatcgcttgaacccgggaggtggaggtggcagtgagccaagatcacgccattgcactccagcactggagacagtgtgagactccatctcaaaaaaaacacacacaaaaaaaaactttcttaagatgatttccaagtaagggtgctatcaaatgggcttggctgcttcctaaaaacccaatggaagcatcctttttaacaactgcttcccttaattttattaacattttatatgagtatatgatagaagatgtacctctattaaatagcttttaagaagctttgggaattcctatttttggcttaaagcttgtattagagatttatgttctttgaattaatgttgagaggcaaggtttataagaaagtaagagtgatatatagttcctggttctgcagtctacctactcactgtgtaaccctaacaaacgacatcatatttatacgtcaatttttctacaagaagaatgtaaataatttgtaaaatcttaaactcttaaaggagacatgctattaagacacaagatgatgtcatcattggcctctccgaagggtattttcatacattttattatggaaacatagctttgctaaatattctttgttaggttatcatgctgatactaatactgagctcatcggttctttttttttgagacggagtcttgctctgtcgcccaggctggagtacagtggcacgatctcagcttaccacaacctccacctcccgggtttaagtgattctcctgcgtcagcttcccaaatagctgggattacaggcgtgtgccaccacacttggctaattttttatatttttggtagagatggggtttcaccatgttggccaggttggtctcgaactcctgacctcaagggatccacctgcttcagcctcccaaattgctgagattacaggcatgagccaccgcgcccggcctgagctcatcagttctgacacacttaagtagtaaattgttcctacagttccttgaagctcatcttctcacagagaaggactgtatttaacttcgaggcttatgaacatttaaattaccaaggctttcctccatcacagggaggaacaaccgtctctagtcttaatataaatatttttatgagaattccaaaagagaacaagtagatttatctgcattttttgtgtaatcaacaggacagttttggcatgtgactgacttacacttagaccctacttaccacatcacagatgaccacacaaaagtgtgtgcttcatctaaaggtgcaaatgcctccaaccctggcccttttggagatgttctgtgtgattctccatatcaacttattttgtcagcatttgattttattaaaaattctggacaagaagcatctttcatgatatggacagggtaagtgattatacaagtaccattaattactcaatatttatttacagtgtcctaagcttcataagagtgctgaattccataataagattagttacattttaagagttatttgagttaaaaaaacactaggtcaaactaatcaacattattagaggtaagaacaattttagaagtgtttttttttggaatacagatttcagaaatatgtcagtgttaactaagagatgaatccataaacagcacacttgcatcaatatcttgaggtgttgatattaggtcttcatgaaattatcaaagacaaaaggcaataatggaagtttacctgtcatgacaattttgtaaagcatcatcttctggcagtataactaactggttcccttcatcattatagggtgaagaggcccatatttctttacctggaataatgaccatggctaatacttgtagaatatttacttggggcttggcactgttttaattaacttatacattgtaacttatttaatttttacaatggatattattattcccattttacagatgaggaaatgaaggcactgaacatctaagtaacttacgagtatacacaactagtaattggcaaagctgggatttgaaataggcatttgggctctggttcaattggcatctgcttttaattattgcagtttttagcctcttataaatcttcagtcaggtagtgaaataggctgggatttccagcttattttttgtattatattttgttaattttcttttataggattatctgtagggtagaggtaagtgaagagtagtctatcaactctttagctgtaatctgctgttttaaaatggaagtctgcagtgataggtatagcaacgcatcatgcataagtctagtaactctttatgaaactgattttgttctttacaatctctctcttttttcagggatagcccacctcatgttcctgtacctgaactctcaacagacactgttataaatgtgatcactaatatgacaaccaccatccagagtctctttccaaatctccaggttttccctgcgctgggtaatcatgactattggccacaggtaaatttgatagactttcagaaatgcttaaagaatttttcctattagtagtgtcaaaattgtgacaataactagctagtgatagggcatgggaatgggtcttatagagggagaatatggtcttaatcctaaccatcaagaaaggcaaagacaagtacttcggggactgtaaaagtaatcttttaatacttcatgagaagttgtatcaatagtgagttttcagaataaaattatccagtttgtggatgattaatttatgttttccttcataatcttcttcaatttctcttttcttttgagtaatgttctggttcatttgcatgtccatgacaaggttagcaagtaaggttaatattgataaatatttactttttccagaattcttattagacctacaaggatgtgcataccctgatgtaagctagactgtaaataaaaacaaaaacttacaaattgccataagaagcaaagaggaaggaggtccatgttcaagtcatagtttatctaattaagacatgattcaaggcagaaaccatgttcagagcatttaatgcctgagatacccccggctcaacaggtttttatttgagaaccaacctgtgcataacagcaagatggccgtccggtttacagcatcctattgtagtagtgtaaaatcttagatttgtacccagagatttttgtttaagtccagggctgggcaattgtctcctgtggtacaaattcagcctgttgcttgtttttgtaaataaagttttattggaacacagctatgtttccattcattctacattgcttttgattgtttcatgtttcagaatagagcagttgaaatggatagaaaaagtttgctgacccctggtctagacctacccttcattttgtaggtgagaaaatgaaggctcagaaatgtgaattacttgtccaagtgctccacatcccttgggagcagagcccatacgctagatctttttacctcagatctgtgttcgcttaaaccaacatccttttgcacatcccttgccttgcctgattaacatactcaatatttcccaaacatatctactttcacgcctctctgtgtccacatttttctctttgcttagaatatcttccatctcatgtcaaatgaatgctgaacgggggttttgattatttttagttaatcgaacctgaatacagtaattttgatgagttgtattctagaataagcttaagtttccagtgacttcttgtccctggcctactatcttgagatgagtaatatgtgagtccttttgagtcagcctgtcaacgagcatttgttcctgttgatatgttagaccacacagtgaagaggcttgggaacaaatgagctccagcagcccaaggtcacacacattgtgtttatatgccttaggtggcaggaagactggaatattggaaaacacaggtgttcatagtcactagaatgtaaatctttaaccagccctgctttccactccctccctctccgccaccacacctccctcccagccctgcttttaatagcttggccaactcgggtgattcacttaacctcgctgatgcagagatcactcatttgtacatagaagctagaaatacctaccttgcaaagcttttgtgagcattggtgatatgaaaaaggcatagcttactatctggcacagcatcagccctcagtaagtgggctggtggtgattgtcacattaagtggtgacaggggatacatgtttgtaactcctttgaggatttgtttgattttatttttatctctgtcctctttttgtcaagtcagatcttacaattcaaagacagaaatgctacctaacttctataacatatcctattatattaatatatacagctagggtaaattgggcagcctacatacctttaacagttaattttttttctctttctagcttatgatcttatatctaaaaatgttctttctgttattctactaccatctttccacctcacagtttcggaaatgtcaaatgtaacatgaaagctccacaacaaaatttcttagaggctgatgtctgagatctaactctggagaatgttagaaacaaataaatttcataagtgctatttttccactgaaattctatgttcatgcagcatagctacataaatatacatatacagatgcatgtccccacccatgacatcagaagtaggtatcagtgtggacatcctggagaattcttcctgttgccacccaaggaagggtccccatttactcctacactggcaagactggtgccaccgaatttgtgggtaggtcactttccattaggcttcatttctcagcagtggttatgtcacagccaaaaaggactgggaaggaaacatggtgcaatagacaattgactgtgagagtaatcatgggatttagaccagccctgagactgacacctatccctggataagccatctaacttctctggtgcttgtgtttctcatgtttaaaatagagaagaaagtctaagtgatttttacataattctaagcttctccatcaccacaccatacttggcatccatcccaaagtaaataaatggccaagactttatggctttttattatatgatgataacgatgcgtaccaattttcaatcagaatctagattggcctaagctgttgtgtaattctcagacaggcgaccctgatcttggacacaaactgaaaatacatgtttagtccaattaaaacaagtcatttggttattacttgccctatatgtatctatatgttcatcatgtattagacgcatgtatcaagaactactaggacttgggcatcttcttgaaaaataacttttgataaactcctctcagaaataggtctattttaccaatgtacagaagtaaatgaagagagtgaagaaggggtttcagtcatttaacataattttttaaaacaaaattaaaaacaattatccaattcacaaatgatttatgggtttttattcagtatttacttttttttttttttttttttgaaacagggtctttttctgttgcccaggctggagtgcagtgcagtggcacaatcatagataaatgcagcctcgccctctggggctcaagctgtcctcctggcttagcctttcaaagtgctgagattacaggcatgaatcaccatgccctgcttcagtatttaactttcttaaagttttgtttgtttgttttcctccaggcgaggctccccatttacttctacactagagcttatgtcatcctgaagatactttatgataataaaaatgttttgtacttaaaatgtgttatttaaaaaatcaaaatattttgatataatttatgctgccctaaagagacttctccaaatcaaaagcatgtggttgtaaatctttattcaaagagttaagaagcttataatagtttgaacagttcagaagactttgttaaattctaaaacatgatgttttcccgttccctcggcatgctgcatcgggcagtgcatgtgcaggctcaaacctgcctttggcatctctttaatgagcacactcccacatccttcccatatcctagccatgctaaaacatgagcttttctctgtacatggtacacacctatggaactctgtgcttttgcctgtgcctatgcctatgcctatgtttgtatctgggccattgcatttgctttgatgcccttttgttaagttgataaagtccttatttaaggcctggcttaaatagtctcttcactctctaattccctgggctacaccttttttgtttgtttgtttgtttgtttttttgttttttgagccagagcctcactcagttgcccaggctgaagtgcagtggtgcgatcttggctcactgcaaccttcgcctcacggattccagtgattttcctgcctcagcctcccaagtagctatgattatgggtgctcaccaccatgcctgggtaatttttgtgtttgtagtagagatggggtttcaccatattggccagacacttcttgaacttctgacctcaagtgatccgcctgccttggcctcccaaagtgctgggattataggcatgagccactgcacctggcccttggctacacttgattgttcttgcttctaggctccccggacctctgggtagtgcccagcacattgtcttatagttaattggttacattttatcccccagtctccaactaagttataattccttgaagatgaagtctatctaataatcatccttgcatctctagatgcctaacgtagtagtcagtgctcaagtagtgtttacattaattcagctgtgtatctttaaatttcaatggtggattatattgtttgtggccaggatcaactgcctgtagtcaccagtaaagtgtacaatgcagtagcaaacctctggaaaccatggctagatgaagaagctattagtactttaaggaaaggtaagtgaaagacttagttattcctattttgcctcaatttttattcatgttatttagacttaaatttttaatgtttgcttgagtgtgccacttctggagcacagcccccagtttttgtggaggacagtgagtagtaatgctgcctgtgacacaggtcgtgaacctgtttatcttgcagggagctcttcctgtttttcttctattcttttttcttcttctactcttaattaggtaggtatgttccccatggagcaaaagctgaactttggatttgaatgtaaataaaagtgtatgtttctaattggaaaattgattgagaagagagaatggacactaacttctaaccaagcagcacaattttataaaacaaagagctggtaaagtgaggataactaagcttttaacatggactttgaggtgcttgggaaagtaatgcataattagtgcatagtaaggccttccctgggtcatgtctaaaggccctctgctccactggctcttgacacatcattatgtaaatccctgacattttgtgagcttaactgaggtgtgcagctgttaaactaagactttggtgttttcagaatgttgagacaaatattaagttaatggctagacttctctcagttaaaatacttctttcggtatttttgttaaccctttggcttttgccactattttgttattgtttttgctagcatgcagcaaatcatagtatatatgaatttgagacatgatagcttagaattagactatggttctgattaatctagggaactatatctagtcttttttttttttttttttttattaagatggagttccactcttgttgcccaggctggagtgcaatggcatggtcttggctcacagcaacctctgcctcctggtttcaagcgattctcctgctgcagcctcctgagtagctgggattacaggcacctgccaccacacctggctaatttttgtatttttagtagagatagggtttcactatgttggtcaggctggtctcgggcttctgacctcaggagatccacctgcctcagcctcccaaagtgctgggattacaggcatgagccaccgtgcccggcctatgtctagtcttacacttcacatcctacaagacacgtggagagcttatgcaggttgaagggagagccataaagaatgatcaagatccctaaagaaatgctctgccttctaaggagactcagcataaagcaggggaggcagaaaaaagctgagaagtggaatgcaggccctaagaaaaagccatatgagtttcataatgatatccattccaatgatagccctcaaagatccagttaaacactggagtataatattaagttaaaaatcatagaagccatcctgagaaagtcttaaaggcaaaagtgatttggggcagagatgtcttgcatgaggggcctcaaactttgtcatcccagaggccctagtgagacctgttgtcattttctactacttggacatgaaagcagcttctcaaaaataacttctgacaaattcaaacccaactgacctgctagtaccataataaaaataataaggtgttgtgactacaagaaagaatagagaaaattaaaggggcagtgatccatcatgattgaaagctagggaaagccgtgcatagtgagtaggctcagggcaaagaaagctgggccagatcttagtgcccagctctgaaagtgccattgcaacagacccttgggtgtcccaccaccagtggttcagaggcgtgggtggaatgatgcctttaaacctcctctcccctgagattgtagcagctgtggtttgtctgacctttttttccgagtagtctctagcaagatccatatgtgttaccattttttggattttatatttcacaatgtctctcatcttaagcccctaatcataaaagtagaagttgatgtgtaaatctttctttcataaaactcaatctcattgcttactgccgaaacacttatttatcttttcatgtgaatattggatacagctgttgttatctcaatatgttggaagcgatagcacggggcctggcaccatagcaggtttgcagtaaatgcttgctaaatctgattcttatctaatgacagcctatctatgtgcaaactaaacaatgagaaataagcaccaacctcctgactggattgtaaacctcaggaatttgctttcacaatgtttgtgtgtatgtgtatgttttcctaaatgtgttttaaaattgtttttataggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtagatcccatagaccaaaaccatctgggaataaacggaaggcaaaatttgtatgtttattaaactcggggtagactccagtatcaataaaagtattataatttgaagattttttttgcataaacactttacaactcatggattttctttcttttttttttttttaaatttcgagatggagtcttactctgttgcccaggctggagtgcaatggcgtggtctcggctcactgcaacctctacctcctaggctgaagcgattctcctgcctctgcctccccagttgctgggattacaggcacccaccaccacgcctggctaatttttgtatttttagcagagacggggttttaccatgttggccaggttggtcttgaactactgacctaggtgatccacccacctcggccttccaaagtgctgggattacaggtgtgagccactatgcctggccaactcattttagttttaaatttttttttttttcagagacaggggtctcactctgttgcccaggctagagtgcagtggtgtgatcatggctcactgcagcttcagcctcctgggctcaagtgattctcccacctcagactcctaagtaagtgggactacaggtgtgcgccaccactcctggctaatttttttttctattattttttgtagagacaagatttcaccatgatgcccaggttggtctcgaactctggggggctcgaactctgctttggcatcccaaagtgctgggattacaggcctgagccaccttgcgtagcaagttttattttgttttgcttttactgcttttaggattagtggacatctattggtataaaaagaggccaattcaaaaaattgtgactgaagtcacagttgccttatatcatcaacagtgtacaaatatagtgaccctaatagttttataatttcatctctttttcttataaatagaagagatgatatatttgctttctaaattttaattaatatactttcaatcttgggtatccaaatgtcatttagttatgatgaatgtgcagaaagattctcatgaggcctttttgtgtttctttttccaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggtaatgtaatgctgtgtttgcatctccccagtctaagagtctagagcaaagcggtgaatatccagtaaatttgctgatttagtaaattaaacgttttatttaaaaatctgccagcattagccttttctgaattatcctcaatggttgtatgatgagtgtccaaatcacaacattaggcctgcagctggatttcttcaacgtaagctcctattagctccacagggccagcgttacttatttgctgtcaacacaaaagcctcagaaaccctcagctcactcaaatgttcttttaaatcttcgagtttaaagaaatatcactctattttaactgctacactcaagtttcttttgatgctacatgttttatttctcagaatttagaaagcaaagcacaatttacacaacggcttaaaataaaatatattaagctcttacttgcaagttcttattgatacatatataagcagagagaatgatacaaacaaacctcctatgtactcaacactcacattcaacatctatcaagatttttcagtttttttgttttgttgttgagacggagcctcgctctgttgccaggctggagcgcaccctgcgatctcggctcactgcaacctctgcctccctggttcaagtgattatcctgcctcagcctcccgagtagctgggactacatgtgtgtcaccacgcccagctaatttcaccatgttggccaggaaggtctcgatctcttgacctagtgatctgcccgcctcggcctcccaaagtgctgggattacaggcatgagccactgcacctggccttatattcttttaattttttgctggagtatttgaaagtgaatctcaaacactggatccattttggcactacatattctatattcattgctaaaatatatggataatttacataaccacaaacttagttaacaaaatcaacaataattatctggtatcaataacaaaaatgtccctattttctccaaattgtctctttacagttgtttcaagtcagtatccattagtgatcacatatcacttggttatgtctgttaatctcttaatctggaaactttatatttttaatatagttaaactcttatttaaaaatgtatgtttatgtgcatacgttttgttcaggaagtccagtaaattctttgtttgtggctcctgctgttacaccagtgaagagtgttttagaaaaacagaccaacaatcctggtatcagactgtttcagtatgatcctcgtgattataaattattggtaagttggcagatttcagagctgaccccatatttatgcatatctttgcagttttcattaatttagttgaatttttctcaggacagtcatgtgagatgtattttatgttgaaatctcctggcatccttcttcttttttatacttgcaatgttatcaggacttactaagtgtgagctgatgaagttagtctttggaaggctgtttctgttctgttcttctaaggacttcacatttatttagatgctttcattggttagtgccatgtttgtggacttgtatacgtactgaaatgtttcactaagccatgttcattcttcttctccagaatataagtatcaagaagagtgtaggctctgttaccattccctctcatgagccattatttctaaacttttctgtgtcccagtctatttctccatgaaatgggaattaaaatattatttaattcactgagttgctatgaggattgcatgaacaaatctatgtaaagcacttagaaaaacgcttggctcatactaaatgcttaataaatgttaacaaacaagattttattttcaagttcttgttctgttactcaggctggagtgtagtggtgcgatcatagcttacagcagcctcaaactcctgggctcaagtgatcctcccacctcagcttcccatgtaggcgggactacaggcatgtaccaccaagcccagctaatttttataatcctattgtagagatggggggggggggtctccctatgttgcccaggctggtcttgaactcttgggctcaagtgatcctcccacattggccttccaaattgctggtattacagatgtgagccactgggcacacccaaaaaatttttttaaaggaaaaaaatggtagctcacgcctgtaatcccagcactttgggaggccgagttgggtggatcacgaggtcaggaaatcgagaccatattggctgacacggtgaaaccccgtctccactaaaaatacaaaaaagttagctcggcgtggcggcgggtgcctgtagtcccagctactcgggaggctgaggcaggagaatggcgtgaacctgggaggcagagcttgcagtgagccgagattgcgccactgcactccagcctgggcgacagagcgagactccgtctcaaaataaaataaaataaagggaaaaaaattgaattggatatttgggacaaaagttctttggagcagcttcatggctccttgctttagaacaatttagcacaaaagactggccatttagcttatgggtacttcagtttgggtaacttcccctttctacaaacataatttgaaaataattcacttcaattaaagccattattggtataactgcttttttttttctggatgaatttaaataggagatggttctgttattccccagaataacagggaggaggtatggtggcagaaatctggttttattcataaatatttgattaaatgggaaaatgaaacaattgtgtgataaattagtccaaaagaattttttctacaactttcagttgcctaattttggatctgaacctcagatatatacatccacacacacacgtatatatccatctatatatgtgtttatgtatctaatacacagcatctgaggttcagactccaatgtatatttacgtgtgtacatatgtactgatgtaggaagattctcctgatatagcactaaataatttctaaaaatataaaaataatttcttatataatttctaaataatttcttaaaacacaacaacatatatagtaagactccatttttttgaaaaagccaaaaatgtaaataagtatgcacattccaaatatttatctttgttttgatctaaagcctagatcaccacgcatacaatggagtactgacaaatgtttaacaactattcactgaggggaaatgtgccttaattggtagtgtttgccaatttccatgacagaaatactcacatcatggacaatttcaagctaccaaagtgccacagattgactagcaacattcttaaaaatttgacagtcggcttttgtgagctggtacgagctgccttcagcacaccactgatacacacaaccattagtgatggttacctctgaggatgtgtgaattgaaggttttttattttgttcacctctctttatagtttggattacatgctattatgttctttcatcatttttaaaattgaaaaagtgatacaggttttttattgagcctcccttcctccctccctccctcccttccttccttccttccttccttccttccttccccccctcctcccccctccctccctctccttctttcttatttatttattgagacaaagtcttgctctgtcacccaggctggagtgcagtggcgcaatctcgcaatcccggctcaccgcaacctccgcctcccgggttcaagcgattcttctgccccagcctcctgagtagctgggattacaggcacccaccactatgcccagctaattttttttttcttttttgtatttttggtagagatggggtttcaccatgttggtcaggctggtctcaaactcctgacctcaggtaacccacctgcctcagcctctcaaagtgctaggattacaggcgtgagccacagcgccaagcctaaaatgtcacagaaatttaaacatgaacgcttcttgttgtacaatgccttatgtgccaaaaagtgaaccaggttttgttactgttcttaactgcaggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctct

SEQ ID NO: 37924 - DNA, 5551 bp, Homo sapiens
gagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaaggtaaggcagagggtgggagtgaagtgccctggggcttgggtcaactggactcctccttagagctgtcctgagctggagggcctctgaggtggcgaggtggggggcccagaccccacagccaccatggagagctggcactgcttcctctggccctgatgtggcagcagggccagggtcctgaacccccttccccgccacctagaagcaaaaggccatcctcacacctctccccttccccagactcgcctcgggccctgggctcgggccagcattcggatagccacggggagtcatcagccgagctggacgagcaggacatcttggctcctcagaccgtgcagtgtccagcccaggtgcccagtccagggaagagggtgggcctctgggagggccccacaccccacccatggatgctcagccctcaccttttctcaggccccagcaggcggcagtgaggagaccatcgccaaagccaagcagagtcgcagtgagaagaaggcccgaaaggtgggctggtggctccctctgggacctcaggcctgggaccatctgtgtggggaacgtccttaccaagaccctcacactccatggctaatgaaatcccatccatcaggggacctttgggtccatgccagtaacccacacaccttcccctaaacagctgaggctggaatgtcatgagaaggcccttatagactgaggctcatggggaaggaccaaccaccagcccaaggtcttggggaagttggcggtggagactttgccttcctgggcactgtgctgctctcctcccccgacgtgggtcaacaccaggtctgagcccccctctgccctctactcccaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaaggtctgggtggcggctgtggtggaatgggggatccgagggataggggacaagggggggacaggctctactgacacagctgtcttccattttgcagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtgaagtgcaggggctccagggcctcgcagggggtggtgggaggcgctacatgggggctctgccccagggacctcaagcagctccagccacttccctgctcccccaactccaggtggacgaggcggggctggaactgcgtgacattgagctggtgatggcgcaggccaatgtgtccagggccaaggccgtgcgggctctgagagacaaccacagtgacatcgtcaacgccatcatggtgagtgagcactggcccctttccctacccctgagctgtccccaagggcctcgagaggtcctgatgttggctccactgcggggtgcttcccccaacatgaccatctctttctgcaggaactgaccatgtag

SEQ ID NO: 37925 - DNA, 3611 bp, Homo sapiens; identical to SEQ ID NO: 35769

SEQ ID NO: 37926 - DNA, 82145 bp, Homo sapiens; identical to SEQ ID NO: 37814

SEQ ID NO: 37927 - DNA, 5677 bp, Homo sapiens
acgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactacctt

SEQ ID NO: 37928 - DNA, 11023 bp, Homo sapiens; identical to SEQ ID NO: 37272

SEQ ID NO: 37929 - DNA, 28537 bp, Homo sapiens
ggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaagtgggtaaccaacagcttggaggacccgagtggattcgattctctctcactcctcggccactcaactgctccttgtccctgactccgcggtggggatgaataactcaactcatttcgggccgcttttctcagagggcaaagatgggtcagggtgggatgttacattagtgttgagactctttggatccgtttcgtgggtaccgaggacgcctgggtacgcgggacaggctgcacccgcctgctagaggcgccccatcgaggcgccacgggtgaagctcccggccccacctacggggcggggctccggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccggtgagtgagcttgagccgaggcgcagagaggggcgtgcaggtgcgggcgcggatggaggcgcaggtgtggcggcgcgagcgggtacaaggaacacctcgtgctgggcagcttctttacgggggtctgtggtttcgtgcacaggggtgtgggtgcagagcgggctggcgaaccccgtcctcggtagattcggtgctacctgcaactagaactcctttaaaggaaatcctagtctctgcaggatacctgggtgtgattcgcacattcttagatttgagtgagtgtacttgaataaccagttccaggcccttgcattttgaagtgtttaaataaaatgttccggtggacctgtgtgcattactcaatcaaggacagactgcctgatggtcaggtgctttctcccgaagaagttcaggagttcagcccaggatactgcagggccgtgggaaacgctgagtggtcccaagcttgggcggtgcgagcagcccagagcaggccccaaagggccccctgtggccttttgcacccaagtcatgggatcgcctgtcccgtggctctttcccacgagcaagtcacagggctacggacttcctaactgcaagagacagtgagggacgagcgtgactctttcattttacagaagaggaagtagacctagagtgagaaaatatttagccagaggttacactgttgtttactgaacatgcgtaacgtccgagcctcttgacgcccagtactctttcataattcatttctttataaagcaatcagactgcgtttgtctttgccaacagaatcggataagtaggaacctggcgcatctggcctgaggctagatggtgatggtcttgaatagtttaggtaggttattgaaagtggaagcaagatgtgcattgtcttcttttatacctgtaaggagaaattctttaaaatcatggtgggatatgatttagccattaaaattgatataatgttcagcagataaaagtagaatccagaatagtatatacagtttttcctgtaataggaaaatacacagaacatgtatgtggacacgattaaaggccttaaaataaaattgctccattgtgggtagggaattaatttgcttgacggtagttggttttatgggaattgggagagactttgatactttgatactgtcagggcccttcattgaaagaccaccaggaacacaccataagctgaacaaattgggtttagtgttctttgaggcaaaggagaccacacaccatgagcgacggacggtaggttatagaaaaaaacccattacagaatttgaacttcggttgcatgatttggggtaagactgaggaaccgggctttgctgtagatagaatgctgttagaaggtggggcaattctgactgagtaaagaaggaacagccattctgtttagcacgagaaggggatgtttggtgttttgtgcgttgcaggtgcccttgtttttgtctgttcttagagaaaatcttcaagtggcattgctttgtcttggtgtgtcatgtctcagaataatcttatccgacgtaggtatctgtgggattgttgatgtccaggaggaaaacagagcttacctggctgtgagtgtcagatcggcttgtaataatattgagagatagctgtgggactcagagcagtttcaggtgttggaggctgttttttcttctttctcaatagctttatttattctagcaaaagtattttgatagctattttcagaagaagaattaacaacctctcaatggatataatagttcttatctagaacagcgattatcaaagtctagtctggccactggtgtcactttgggaagctgttttcacaggttttcaatgaaactggaaaaataagaatgcaaaactaaaattattaatttagaatgttaatctttactctgattgtatggacttcaagttttcattgttgcaaacgtgttcttaaaaataacggcagaggtagatgttatgtgcatggaatttgttttgttttaacatctccatttggcagaataaaaatttggaccctcctgtgccaaggcctcattaatttttttttactggcctggaaaatcctgggatccatgcactgaaggacctttagaaccttacagaagtttagtgacttcattctctgagaagaataagcagtttttcaactggagtcattatatgataaactatagcctcatggtaacaaaagatatttcaaaagtactttcaataaatatgaataatgagaagcagctttaaattggaaacaagtcatttgatttagaacatctgtaaggattttttgtgtgtttgtttttgaggcttttcacaatattcctatgtgaaggtcctcctgagttattcttcattattgaattttttaggagtctattaagagatgatggtgaagacagtggcacaagaaatgtctggagagatagcgccagatgacatcatccagggttctgtagactcttattaaggattcagaaatttatcctaaaaaatgggaggatctggaaccagccaatgggaggccattagatggttttagacaagataacattttcactttaaaaagatgagtctggattggaggtcagcaagggtagatatgaggagactagtccagaaaagaaaacagggtgcgttgaaggatggtggcgccaggggtgagggagagaagtagatgttctagaaaaaaatcaggagggcgaatgagctgaaggaatcgttgggtgaggatgagggagtgaggtgtcagcgtgacctgcacattgctgaagtgcttcgctgggcgaatggtggcatccgttccaggaaacatggggaggggaaagcttgggggctaaagaatgaggatcgttttcatttggggtgtatgttaaatttcaggtggcagagaggcatccagcaggccactcggactggcactcagaagagagacactgagagtcactggcataatgatattatatttgaagcccttggagcagatgaacttacctagaaataggatagagaaagagaagaaaagagaactaggcaaaggctaagtaacttgcacatgtatgtgtcaagaagaggagaaattgccaaagttaaaacaggacaggccgggcgcggtggctcatgcctgtaatcccagcactttgggaggccaaggtgggcagatcacgtgaggtcaggagtttgagactagcctggccaacatggagaaaccctgtctctactaaaaatacaaaaattagctgggcatagtggctcacgcctgtagtcccagctactcaggaggctgaggcgggagaattgcttgaacctgggagggagaggttgcagtgagccaagatcctgccattgcactccagcctggacaatgagcgaaacttcgtcacagaaaacaaaaacaaaaaaataggagagtaagtggaacaggaagctcagggaagagactgggacaggttaactatgttgaatattattgagatgtcagtggtattatgatgttgggcaactggaggtcattggtcacctcgactggagcagtgttgggggcagaaaacagcttgcggtaggctaagtgtgattggcaggaaaggaactagaggggagagatggctgctctgcgtaataaatctgacccacttcataagatgtgcgaagatgaaacgtaatggcttagtaattaattgccaaagtaaacttgtaaactcatttttatgcatcagcttctcatactagttaacagcgtatgtcaacattgttgacattagctattgaatcagctttagcaatgattttcacgcagttgccagaaatctcatagaccccatctggcctaggaatttattgcacttcatctgcttttccctacttctcccaaagagggaacacacaggtgtaatccattcacttattcaacaaatactgcttgcctactatgtgccagactcctaaacgctgggaatgcgtcagccaatgagatagatgaggtccttcctctcatggagggtttattcacattcctttgacctaaatatcagtagcttaataggatgccatcccatcaaagcccagaagacaagtgaaaacattttcaagctcatgtgaattcttgtacacgtaggaaacatgcctctttgtattcagtgtttctgctgagttgtacataagaggacattataggaaaaacttgtctgcaaaatagttgttgatgaattcaagaattgaatgaatgaaaaattgtctggctagagttgtttggcttctggtgggtatgaaaactgacatgaggtatgtaattttagattatccttcattgtctctttctgagtatttcaataagacaagcacacaagggctttctggacttttaaaattcactattagaagcatacattatttcattgagggtctcctaattctttcgggctcaaatattttaaggagctgtacaagttatgccattttttaagggtatggcgctttcattgagaccttaatgttctctttatatttttgtgttttttttagaatgttgtgttcagtagctctgtaattaatttctcttaatgaatggggaggacattcaaagaggcttaagtttctatcaaataaccagaaaaattagagaattttctgacccaaacagtcttttaaaagcactttccagagagttttttgttttttttttttttctgagatggagtcttgctctgtctcccaggctggagtgcagtcacactatctcgtctcactgcaacttccacctcccggcttcaggcaattctcctacctcagccttccgagtacctaggattacaggcacatgccacccagctaatttttgcattgttagtagtaacggggatttcgccatgttggccaggctggtcttgaagtcctgacctcaggtgatccacccacctcagcctcccaaggtgctggaattacaggcatgagccaccatgcctggcccagagagtttcaaatgcattgaaatatcagatttttaccacttatcttcactcttaggagaccactgaggggcagggagaaaggtagggaagggcagggagagagagagaaagagaggtactgtggggagagggttagagagaattgattctaagttggattttgtttcctgtgatagggtgtacatagtataccatccagaccacataatctctcttcttatcatctgtttctaatctttacctatcatctatttaagtttttacctgccttaatagagttgtctgttattaaactgtttataaacttggggatagtaaggaactttaaataacattaagtaagttcattataattctgttttagggctactcgtgggttttgaagctgtgtctccctgtagaattcttttttgagggggaggaagtagctcttttttccaccctacccctaaaactaacctttttgcataaacgacttaggcgttcatgccatgtgagcccctgaaatactgtagtctcatagctgccaactttcttattttctgtcacacttatcctatttccttgcagccaggttctatgccaatttcacgtttgtttattgctaccaagagtcgttatcaacctcagactcactccacatgtattgttgctagcttgctctttagttcttacctctggggcaggtcacattctctcctaatactagacagagcattttcaactttgctcacagttgtctagtaagaaatgtgcctgtaatttgatgtttattttggctttggaacccagggcgtgcaaatgtcattattaggaagggataggagtcattacgtttcacttaatttgccgagttgattctagtgatcaccagaagccctgaactacgcgcagattattctgttaggaattaaattgaggcattggttttattatctctgtgggaagctgtttgatagaacagggaaagccattgactctgattctgtcaccagctgtgtaactttctacaagtcactaatggagcagggtcttaagtccacaacatgatcataaaattaagcacttgggttaagtacccatcacagtattcccaactcataggaaaacaatggtcagataaacaagaaaatgtaaagcggagtatctcctcacagcagaacttatttacaaattttacaaagtaaaattaagttgcaacccctataagtctctaagtagctcatttattagcaaaataaggaaagccatttaccaatggtggattacctaaattgtattcgattgtagtagcagaagtattgtgtccagggaaaatgaaattattttacatgtcattgagaacccttgtcctggactttgggaagaacatcaatatcaattaaagaacaaagcatgtgatttttgagtgatttttcttgactgtcaacataccgataactgatcagttgttgatatttattagatgatcattgccaagtttgaagtgactgaagagttagcctctgaatcatctgtataaaacaactacaggcgaggatgttttcgaagaagctgagaaaataatgattgagtataacctggaatggaatctgctaagatctataaaaattgacagtagtaaaaatatttgtgagtagaaaaaggcggagttgagcaaattcacaaaacttgtgaacatgcgaggtgtttaaagctcatggttatttattatagtattccttttcagatattttgtggaaaatattggaatctcacatgtgttattgaaccggcaatataaaccatgagcttcatttgctcttgtggatataaccgtcatcatttctgtgaattatcagaaatagaggccggatatcctgatgtctcttgtgacagagccattagatagcttgctagctgtaaagttttgcagtctttgagttcacagttgagactgaagtttttctaaacgagctgcccccagccactattactgaacacgaatggctttggaaattagcttttgctacagacttgatattgtttcttaatgaattcaacgcaaaattaccagacaaagccagacatatgtgagaaacttacagtgtggtaaggcaaatttgacagctaatgtttgaatcacaggtaatgtcaacctactttatatattccccatgttatcaaaagttaaaacaaggtgctagacctccattcttacacagctgtccagcagatacattttctgtgctcaagctacagttccaggagttttctgagctcaagctacagttccaggagttttctgagctcaagctacagttccaagagttttctgagctcaagctacagttccaagagttttcttacctactctactttatcttattttggatttgtacttttttaaaacaattattttactttcacagaactggttctccagaggaaaggagataaagacacttgatatgttgaatgagtaacaaaagaatcataaatctgtgtggactttttttgataagtttaggagaaggttccattttgccactaagcttggacaacttcccctaaaagagtctgttcattccttgtctcaggcagtgacgtcagtgttgggggccgtcctcacctcaaggagcgcagagtctggtattgacaaggaacgcaaacagatgattataaagcagtgtcataaacatgttgatgagagtgtgcacaaatgctgtgggaggaaaggagggtatgaatattttcatatggaagatagatgaagacttcacaagaaagaaaatgcttgaactgaatcttggaagttagaaccagcagttcaccaggtggggaaaaggcattctagcaagagggaatagcacagacacaggcatggaagggtgagagatgataggaagtgcctgcgtatggctataaatactaaggggagtgtcaggagatgaggctgggatggtaagttaccatggaaagatgatgaagggccctgtgctgtgtgccctgaaaatctggtttgggaggcaaatcccaggacaggttgcaacacacatggctggtaagtgcagataatacatcctatcaggtcatttacttttagtgctaagtcagcctctctaacataaatattttccatctactttgttacatttgttcgttactcaatatatttgaaatattagagccaaattataacacctagcacttttacaaattgaattgaaactgaaaatccacttaatggtttaggattttagaagttttcttggaaagaaaagacttattttaagaggcattgaaacgtataaaagagcaatatcagacttgatgttgtcttcacagattaactacttttgaaattgcttattccgttggcaagcatttgttattttctgaaacttaattttctttgcttttcagtggacagaggactgcagaaaatcaacctatcctccttcaggaccaacgtgagtaaacatcagatgatcaaaactccctttgacctttgtgaagttttttctgtatgtaataattgctcataaacgaacgatagtgaataaaatcttaagtcatgtttcccattccgagacagaggtttgtttctcagatttgtttattatgcatttggctgagatcttggacaaatatgaaaatatcttccgattcaaatgcccgtcgctagactatcaaaatcatcggaaagaaaaggattttcagccagacgcggtggctcacgcctgtaatcccagcactttgggaggccgaggcgggtaaatcataaggtcaggagatcgagaccatgctggctaacagtgaaaccccgtctctactaaaaatacaaaaaattagccaggcgtggtggcgggcgcctgtagtcccagctactctggaggctgaggcaggagaatggcgtgaacccgggaggcggagcttgcagtgagccgagatcgcaccactgcactccagtctgggcgacagagtgagactctgtctcaaaaaaaaaaaggaaaggattttcattctccactcaattctcctgtctaccatgaagggtttttctcatctttgacaaatgtaagggctgtatttgaaatgacctgtgattctctatggtgcctggatataaaccaccaaattatattgtaacaaaaaagcataggccctcatatgtgaaacgttctcaaaataaaccttggcacaacaaagctgtcgaggacaaaacaggattggaacacctaagaggaggaccaatgtcatgattcagtgtgtttaacattaatatttttagtctagattttggtctttccaaatcctcagtgtttaaatgggcctgtgagaaagccataataacagctcacagacccctcagagtgtacagaacagagaaaagaaggaacaggtatagggggtggtgatctttttctcctacactgccctttcgctgaaagtagcctgctgtttgtagggggaaacagtacaactctatctagtgatatcaagatgacattttcagttcgtgcaacattccaaattacttacgttgtactgttgttgtctaaacgatgtattttaaatagcctctgtcccagatagcgtgaaactgtaataaactaagttcttttgacttactcgcctttatgtagaaagaggccagtatttggcaggaagcaatttagaggtaaccagtttggatgttgtttggggccagtgttcattccagctctttcttcaatggcctgctgtctgaaagtcttcctttctgtcatcactggcatcattctggccttcagtgacatgtctgccttactgattgattatgtctctctgttggtctcactgccccaattcattgaacatttaatgaggtgccttccatgtttgaggccgtttctactcccttttaggtgcactttacatgtgtctataaattgaatgccctgcaaaccataaacctttcctgattaggcattttactgactcttattgccatgtgcatgtgagtgtgtgtctacctatgtgcatacatacctacatgtatacatacatatgtactccaaaacacatacacgtgtatacatggacataacttgtatgtttctttccttgccttcattttttcgctagctttctttttatctcactagcctgctttcctacacaaaaagcctcggctttgctcttatccttctcttctctcaactctatcaatggatcttgagatttaggagataactgtggtatttatgtacctttgaatgacaaacagacgttctgttcctttgagatcatccttttcaattaagtgcgtagatttgggcagcatccatgggcagatatgagggaagaaaaagataacctgtttggccagcatgactagtcaaatcaatgctgaagataaaggaactgatagccagatcacccctgagtccatctgagtcccattcagcatttctttcccactgctcacgggatgcctagcacttgctctcttatttgtatatgtgtgtgttgtgtcacttggactagtttccatgccacctaggtagccatgtgggttcaggtgatgttgctgatattatgaatggcatggacattgcaaacactaagtctcaaaaatgatgaaatgatatttcttgtttgcagtgaagtaggaaaataaattgtgatgactactgttgattgaataccaatgctgctaagtgttttttttatttttgcatttttcatatagtgtcttccctgctgttataaggtggatactcttttattcttatggggaaatggaggcgcacaagttaaatactgaaatgttttagaaaactgtttaacgagaggtaaaatgtgcaattatggctaagctttagtcattaaaataatttggtttattagattaaccagttctctcaaattctaattagtgcaggtttgatggtagagaggtttgtggggtctcatcatccccacttcattgtaatcccttcattgtccgttgtgttgtgttcatcccctctcatcgcgtctctgagatccatgaacctacccaggactctaggctgaaaaagaatcaggaatttatggcgggtatagaggcatgatttgggattggttggatgttatgaggtgaggagcagctgattggagttcatagggatgagatgcatatctccaacaggccactgagttatctttgctactagacatagaaatctaaatgcacagttgaagggagaggggagactagtaatacctgcccataatatggggaacaataattacttactgaattgtgggacaaaattttacatgtgaaattatggtctgtcagaaatggaattaatttgttgtgatgaaaagtttttttctagaatataagtattgtagcatttcatgtagatatcagctcctaagaaaatggggaacttgaaaatgctttgagaagaacaaaattcgttcactatgattttgtttaaatgtacatttccaaaatcgaatatacttttctgtctaaatcacaacctgaatgtctgctagttaacagtttcataaaacctcatacatataccagggccccaagttacacagcattatttagagaaccaagtaattatttatgatagtggaaatataaatagaaccacagttcatgacttaggtaataacccatccccagctatggacataagtctagataacatttctatttaggagactggtatcattgtggcacataccagagtcaccctgccagtctcaggagcagatcagtggaacagatgatggttatttttaggcataggtttatactgataaaccactaactggcacacccttaaaagctatttcagtttagtaaccagggccagaaaataatgttcctatagcaacaaaaatagttgtagaattcatccaccagaaatatggcccagcttcactgataagtgactggatgttgctatatcctcagaaattgctgcacgtaagttaaagagtaggaagttggaggatatgacagaatacagcttgggcttggactttgtccaggaaaatgagaagagaagaggtatatagtagggaagattaggatggctgacagaatcatgaaggttcttgaagctgatcgtgggaagataatacatgttgccatctggggcttaaaaggtgatcttcctgaaggcaacactggagacattggtttggcaatagtgttacactctctgagagagaattctgaaactggaaaccaattggagaattgtctagagcccagactaaatctttgcagatatttaggagaaaaaaaaaatggcaggtatttcccgtcagtgataatcaggttagagctcttaagccatagttgattttttcatagaaaaccaattcacatgaaccttccctactagatcattctattccaggatttctgtgaccgcttatgattgtgttctcaacctagaagcactaggtagagaatgaactttctttccaaattttggtttgggtaaccaaattctacactgctgttaagactttgcctctcatatattcttatagatgtatctaactgaccctcacaaaaaaccctttcatcatttcaagatgatacacctctcattacaggtacagaggtgcagttccatggtacaccataaatcttgacttaccaccctacaaaagatggcatgaattgatgcttgacaaggcaccagtggtatgctatgatgcttaaatcttttatttctttatttttattttttattttatttctttatttttatttattgattgattttttttttgttttgagacagagtctcactctgtcacccaggctggaatgcagtggcacgatctcagctcgccgcaacctccgcctcctgggttctagcaatttccctgcctcagcttcccgagtagctggaattacaggcacctgccaccatgccggctaatttttgtatttttagtagagacaagattttgccatgttgtccaagctgatctcaaactcctgacctcgagtgatcctcccacctcagcctcccaaagtgctgggattataggcatgagccgccatgcccggccatatttcttattttatttatttattttccccccaaggaccgtggagattctatattaaatcttttatttctaactttattaaatattattgtatttttaaaagaacacttcatgaaattacccacagaatagtttaaaattgtgcttttgatacctttctgccctatacgttaagtgacagcagaggaaaagaggtcattcctctgtagcctttgttcttttttgtaaactttacctttgtttctttccctttatgtcatctcccttcatgtaaataattaagaatcaaattcactttaaagataaaattagacttactgtattaatgtattaatcgaggccaggcacggtggctcatgcctgtaatcaatcccagtactttgggaggctgaggcaggcggatcacctgagatcagaagttcaagaccagcctggccaacatggtgaaaccctgtctctattaaaaatacaaaaattaggccaggcgcggtggctcatgcctgtaatcccagcactttgggaggccgaggcgggtggatcacgaggtcaggagttcgagaccagcctggccaagatggtgaaaccccgtctctactaaaaatacaaaaattagccaggcatggtggtgcatgcctgtagtcccagctacttgggaggctgaggcaagagaatcgcttgaacccgggaggcagaggttgcggtgagcagagatcgtgccattgcactccggcctgggcgacaagagcaaaactccgtcttaaaaaaaaaaatacaaaaattagctgggaatggtgatgcacacttgtaatctcagctacttgggaggctgaggcaggagaatcgcttgaacctgggaggcagagattgcagtgagccgagatggtgctactgcactccagcctgggtgacagagcgagatgctgttttaaaaaatatatatataaattgtcaaatagcactctcttttagctacatatgggtaagccaaaaggtaatcttgacagcatttcattatgtcttttagtaagcattttatttatttttcagctaaaggttatagtgaattctctgaagaatatgataaatacattcgtgccaagtggaaaaattatgcaggtggtggatgaaaaattggtaagagatattatttctcacaataaatgttaagcacatagaaaatgcgctgttatttatttaaaggcataattcagcaacctcttcgcagggacttgggcaaatctgcatgaatctagctcactgtcagaacttcagagggacttaaatttggggaattggtaatattagggttacagcatagcaaattatggtttcgtaaaaggggatgggactacattacgacattgggcaaataaccatatttcatctgggagtgtggtatttccttccctttatgtagtgagttcactattgaagacttggttttttttcttaagtgtctcagggacatccagagattttttttttgtagatatgagcaaatgacatactcagcctggccccttattctgtagagttcctcagtagctctgaccctgaaactcatttgggctgagtgtttctgtgcaatcaccaaaccatttcattttcatcctcatcatgcaggaagactccatttctcagccccgtttttgttgacgcagaaccaatgaaacacctagggcctggcccctagaactgttaaagggatcctcattgctcttgatggcagattttgggcattaatgacatttggggttgggcagctttttttttttttttttttttgagacctcatctcactctgtagcccaggctggagtgcactggcatgatcatagctcacagctgccttgatctcccaggctcaagggatccttctgcctcagcctcctgagtagctgggactacagtcacgtgccgccacacccagctacttttctgaatttttagtagagacggaggcttgctgtgtcacccaggctggtctcccaactcctgggctcaggcgatcttcccgcctcaacctcccaaagtgttctcccaaagtgttgggatcgtaggtgtgaaccgccatgcccggcctgggttggatatttctttgtcgtgggcttgtctacattccaggatgcccggcctggggtgggtgtctcttttttgtggggctgtcatgtgcattgcaggatgtttagcagctcaggatgcccggcctggggtgggtgtctcttttttgtggggctgtcatgtgcattgcaggatgtttagcagtgtccctggcccttacccactggatgctggtaacaccccctcagttgtgacaaccaaaaatgtccttagatgttaccaaatctcccgtggtcgagaatcattgccctagcggctgagtgctgtggccacatcctccctatgacacttgtacctgccaagcaccaaacccattatccctcacgtgcatgctctcggagcttttgtttcaggctatcctttatgttcatacttaccggacttcctcaaaacaaaaaaatgctggcaggagcaaaagaggatgaggcccccacgttccccgtatgccttaatctcccctctactctgaatgttatcagggagggcaacattgcagagagtttttgtgccacgccttggaatcggacaatactgggttttaaggctggatcagtcacatactagccttgtgtcctagggaaagtttcttaacctatgaaacctcagttttctcatcagggagaataataattactaatatatatttcatatggtggttgtaagggttaaatgacatactgtgtataaagcatagtgcttggatgtaataagtgtttaataaatacccattacgtcacatttgtttgttaaatggctggaacattccacttggggaatgctttgagttcctagggagaaaaaaaatatgtttaggtgacattacatgtaattaccaagttggttaaaaaagtgagattcgtgaattttaagcagattatctcagcaaaaggccgtgaacttaagttgtgatctggatgttagtagttgccattgagaataaatatatgatgtccaccactgaatttgctcaatgtctctggtttgctaaaagaatgcagttacttcatcttagctgaagatcagccattaaccatgacacagggctatggatagaatagtgcaggtttatctctgtgagtgtgggaaggaaatggtaagaacggtatatgccagtggctagagggtgaattcgtgcagagagataaggagtgcttgttatgatgtttttgtggtgtgggtcaggttaggtcatccaagtggaattactctcgttcctgccttctctggagaatgatggaaaaataaggcaggaaaaacaatctgagaatctggtctctgtataggggcccaatattcagtattacatagaatctttttataactacatgatgtaaaaatgctttaaaaaataattcctatcacttattatgatagcagtatctagaaaaaattatatgtccaagaactagatttcaaagcatgcttttattatatttgtttatattatattatatattttttattgttattatgttaaatgcttttattaatatatttgttttccagcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgctgtatgtcttagatatacagcacaggtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacattttgggggtgtctgggtactcattttctggatatatacctaggaagtgaactgttgtgttatagagtaattgtgtgtttagccttatagattctgccaaacagttttccaaagtgattccagcagttgacaatcagcagagtatgagagtttcagttttctcctcttgataattctcctctcgatagtgtcagtctttttttttcctttttttttgttagtgtcaatctttatttgagcctttttgttgagtgtcgcagtatcgcattttagtttcaatttgcatttccttgatgattaatgagattgaacagtttattgactttttttttttttttttggttttctttgtttcttttggagaagggcttgtgaaggtcttttgcccttttaaaaattagattgaaggaattttttacatactttgaatataagccctttgtcagatatatggattctgaatatctgctcccagtctatgaccttcatttttattctcttacttttgtcttttgatgaacagaaatttttaattttagtgaagtctaatatctcagtcttctcttttatgagtagtgccttttgtatccatttaaggaatcttggcctaccccaaagtcatatatatatgcttatatattttcttctagatgtttaatgtttactttttacatttaggcctatcatctattttgaattatttttgtatatgctatgacttatgggtcaagcttcaggtttttctcatgtggtatatccagttagttaaacagcatcaattcaaaaggctatcctttcctcagcaaattgcagtggtgtctttgatataaatatacaatacatatatatatacacacacacacacacacacacacacacaatgtgtatctgtatatacaatcaggtgattgtatatatgttgttttgtttggggaattaagtttcatttacatatttgtctttttgtcttcccttatatcaatactatttcacctcagttactaaagctttatagtaagtcttcaaattaggtggtataattcttccaactttgtttttctcaatatttatttaagttactgatttctctgagcagtatcttttattttcagggagaagacctcacatgccattcgttaaaattattcttagatattgatggtttgggaagctatttttaaaatttcaatttaagctttatggcatgtaacgaaaaatattttccccacgaccccaaaagttttatctttaagctagcaaagcagtagtgtcattattttaaatagccaacagtaccttcattttatgagatgattgagaatttgtgaaaatcagtagtatttatcaacaaaagtggctagttttgtgtgctgcttctttaaaaaactcatttaaaagatagcatactggaaatatgtacttgctgcctttatggaaagcaagtctaattcctttattatgtaaagaactctagcaactcaataccaaatagaaataccttatggattaagaagaataacatgatgtataagtggtgtaaatttatataattattataaattattataaatgtataataaaataactagaatttcaccaaattagaaatttaatggaaataaaatacacattggatttgggtgaaaaaaacatgttgagcttaacatgttaatgttaaatgggacagaaatacaatgtgctgcctacttttgaattaaatgctaaatagcagtattatacattttgggaaaatattcaaaaaataaaataccctagaatggagtttcttggcagctctgtactaattttaatagttcttgaatctcctttttcaccttagaaattttagtcacactttaaaaatctgggcaaaatatatgtccagcaaacagccaagagccagatgtattaaatgatcatatttacgctcccaaaagaaaattcaaaatgaagcatgttgataaacattttggatgtgatgttggagaacaattgcaacctgcccagatgttcagctcgcccgaaggctgcctccttggtgacttgtttcatcttgagtctagagagtccaggctggggaagaaaaccacctccagccggccgttccagcacagccccactggccaaagcacacactcacacaatgaaaacactgaaactttttcttaaaacaaatttttctcccattgtcatggttctgtatattaacacaaaattttcttttctcataggagagattatttcattcaatattttttatgaattatttaccatttgtacttcaatagtagcagaagacaaaaaaggtaattgtgcgctgagggagggtgggcagcatgaagcactacataaagaaaaatcttctaaatgaaattagaacttctgaaatttgggcttgctatgtaaattctgtgtatgttgcatacagctttttatttcttggtaaaattttgtgattgtactgaaaattttccttattttcagactactgtactgcctattaaagttgatttcagacatgcaaaaaacctggaagaaatgttgcagggctagaaacattcttctcttcctcatagtttacttctacccatctacatgctttgatggaagtgctcgcaggaggtgcttccttatcttcgtgtatgtcatgacatctgtccttttcttgaggcccagaacacacattctcccatcctttcccagccaggcaacccaatggataccagcctcactttcccatatttttcctgactggttcccagagtacaaagcacaggacaacttcgctaactcaccctgatctttgacctatactctgggtataaatctgcctgtaccttacccttgagatgtcctgctctaggggatgatgcctgaagggaaacatttgatgaatcacagtaattgaggctccgatttctgtgtcctggtagaaccatgtgatagtgaaccaaaacatgaccattgattccttttcccatattctgatcttacctggaaacccgtgctctcagattttgtggggttatctggcagatagacggtgacaacagtcccatctggtgaaggcttaggatattaggatgtttcttacttcttattgtttgaagaaacagttgtgaataaaaattaatcaaaattagaggccaggcacagtggcttacacctgtaatgccagcactttgcgaggccgaggcgggcgaatcatctgaggttgggagtttgacaccagactggccaacatggtaaaaccccttctctactaaaagaaaaatacaaaaaaaaaaaaaaagtagccaggtgcggtcgcacatgtctgtaatcccaactacgtggaaggctgaggcacaagaattgcttgaacctgggaggcagaggtcgcagtgagctgagatcgcaccactgcactccagtctggccaacagaacgagactctgtctcaaaaataaattaattaatcaaaattaattgtccagctttgatttagaatcttaactgctattacacgtctcttctgtctaccttcaaataggtcatctaatacatgggagaaacatggattttggagtatttcttgggtaagtaaagaacaaagggtcaggcatggtggttcacgcctgtaatcccagctttttgggaggctgacacgggtggatcacgaggtcaggagttcaagaccagcctggccaagatggtgaaaccccgtctctactaaaaacataaaaattagccaggcatggtggtgggcatctgtaatcccggctacttgggagcctgaggcagagacttttttgaacctgcgaggcggaggttgcagtgagccgagatcgcgccactgcactgcagcttgggatacagagccagactccatctcaaaaaaaaaaaaaaaaaaaagaacacagaactgttttggtctgtaggaagagtaggttgtgttatattgatgataagtaagtcccaagtcacacccaaaatgtgatcataagtgaagataaatggattgcttgagtgctgagacaagagggacatgctcttctattttatgtgtccatcttgacctttctgaaaaaataagaatattgtaattagcattctatgtttgaatctgaggctcactatttataagctgtgtgatattgagagagttacctgacttctctgaacctcaattttatcatttggaaaacagaataaatataccatattgtaaaggtcttgttaggattgatcgtggtgactcggtaaataaagctcctagtgtaatgcctggccctcatcatcatgttgatcattactatcactgtgtttctgaaatgtcactgaaacatgtcttttataggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccagtaaggagtctgttgttacataattatacaggtagccttctgtcctgttaccgttatgtaaaagttgaaatctaagaatatgaggacctaaagggaatatgaagccccatttcacccccttgtacttcttgtcacttcataggtatgagatctcgtggtagagaagagtagaaaggaaacggaggtttctgagcctcttctgggataaagagcatgtggctgggtgtcaagggctgggagtcacaatctgatttctagtcctgggtcttccgctcacttaggcaagtcaggcgttcattctctgcccttcagtttcctgtccaaaaagcgttgccagtgataccccacctacttatctcacatactagaatcaaaaatgctttgaactttttaaaaagccttttatggttttgatttatttttgccttccccattacccaagctaggcctttatatcccactctgaagtacagtgagcgacagggccttaaagcgcatggttgatgtttctgacttcgttgctttgtctttttctcagggactgttcagtcttacactgaatgaacgtttcagtataaatggtggttatctgggtaagtagagcattctcaagtgaaatgggaatctcagagcttttttatgaggaaggctggactgtgccttctggttacaaagtccaacctcttccggttcccgactggttacaaagtctaacctcttctggttcctgactggttatatagtccagcctcttccgggtcctgactggttacatagtgtcacctcttccggttcctgacattgtgttcatctcttccaggtattctagaatggattctgggaaagaaagatgtcatgtggatagggttcctcactagaacagttctggaaaatagcacaaggtaaagtgtttcgttgctttactattaaatatttattttaaattactcatattaaaaaataaaaatatttgtcaagctccagcttaatcctttgaggaactattgcagaatttcttaggtgaacctctgacactcatgtggaattactcatgttttcttcgtgcagactgtgtgttttatagcaaataaatgaattacttaaaaagcactagggatactgacattatgaaaggcacctatgaatatttttggtgtacagaaaaaaaatgacccacacacaaaagaacagtcatacagtaaaatcttcatttaaatggtagtacagaccaggcacagtggcttatgcctgtaatcctcacgctttgggtggctgagatagacagatgacttgcacccaggggtttgagaccagtctgagcaacatggcgaaaccccgtctctataaaaaatacaaaaattagccaggcatggtgacacgtgcctgcctgtagtcccagctactcaggaggctgaggtgggaggatcacctgagcccaaggaggtcgagactgcagtgagctgggatcagtccactgcacttcaccctgagtgatagagtgagactctgtcttaaaaaaacaaaataaataaatacaaaatgtactacatattaacctgtaagttatatcttgccttggtatagaaatcttacaatagcaaaactgcctttccttcattcagccagcactgcgtccaaataaatgggcatcaatcctatttttaatacttcccagggaataagatttaatgttagtagtgttctttgataacccacttcaatttttaatagtcctaattttcaagaaggtttactttctgttctctaagtcctacatactgtaatattatttccctttgttctgttgttgagtgaaaggcatggacagtaagggtggaagatgatctcttgaggccactttgtttctccttcagattagaggggcttcctaagattcccgcttcccatctcagtgttcaccatacagggtcagggattgcttttcccagaggcattgctcaccatccttttttagaaaacacattgtggctggccatggtggctcatgcctgtaatcccagtactttgggaggcgaaggcaagagtatcgcttgtgccaaggagttcgagaccagcctgggcaacagagtgagagcccatctctaaaaatagaaataaataaataacacattccttagatacttgtttttctttagtttctacagagctaaacatttccgttctaagtcatctaaaaatgtttcccaccatcatcctcagcaaactaacacaggaacagaaaaccgaacactgcatgttctcactcataagtgagagctgaacaaagagaacacgtgaacacagggaggggaacatcacgcaccagggcctgtcagggggtggggtgaaaggggagggagagcattaggacaaatacctaatgcatgtagggcttgaaacttagatgatgggttgatgggtgcagcaaaccaccatggcacgtgtgtacctatgtaacaaacctgcacgttcagcacatgtgtcccagaacttaaagtaaaatttaaaaataaatgaagttatttactaaaattaaaaaaaagtttcatttttctttttaaatgtttctatatagttatgaagaagccaagaatttattgaccaagaccaagatattggccccagcctactttatcctgggaggcaaccagtctggggaaggttgtgtgattacacgagacagaaaggaatcattggatgtatatgagtaagtaggtttgttaaagcaaaagaagtagaaacaaaagcatacactgatatactttgagttttaaggcatgtagcctaagagggaatctctccttttgtatctagactcgatgctaagcagggtagatggtatgtggtacaaacaaattatgaccgttggaaacatcccttcttccttgatgatcgcagaacgcctgcaaagatgtgtctgaaccgcaccagccaagaggtacctttgcagggtcatctatagaaagaaactgttgccattaaagattcccttggttctggcatttttctttggccttcaagtaatttataaacgtcctatttttcatagtatctctagccactctccactgatttttttgtttcgttttcttaacttaaagagcaaaattgtgctgtactttccttttctggttctaatgctggataccactctgaagttgaataacaaacaggcaagaatttaaaaaaggggaaggagagagaggaaagtaatccattaaaactgttacctgtgtttctaacagtgactcccacagaaactccactgcggggatggaggggaggttgattaaagaatgtcttggtttctggtggcccatgtgtgtagataaggctgttggcttctgtatttaacttactgaacaaaactattttcttgtgttttagaatatctcatttgaaaccatgtatgatgtcctgtcaacaaaacctgtcctcaacaaggtattttaaatgttatatgtatatttgccttttagggaaagaatttggccctatgttttatctttctctgttatctttgatcagtttgagcacaaaaggtgtgttcagcttaggactgattttttattaaaaaatgtttttgtgtggctaaaactgtattttggaatacaagaaagaaattgatcactgaggcttgataggtcagaatattgtttatagctttatttacatagcatttgaattaaggctagcattttactcttattggtatctattaaaaatctcacactatataactaacacctaaatgtcaacaaaacaaagtctgcagtccattttcagacagagctctgtgtcttggtgggttcgggtttcccttaaactttactacatctgtttatcttttccctacactgtagttttaaaaaaatgcaaaaagtttcctatcatcccaccactcgctaacaatcattccctgaacgttctgaatatgcccccctaattttcccatttgttccttcttttcttggtccttctccacagctctccctaaagtaaacatgccgcctttaccctgccaggacaaatccctccggcctttagcatccaggtcaccctggctctcacaggaagcctgccttcagttcacgggccctgccatacttgcgttttgcctataccatctttgagcaagtcacaatctcgtgacttgtgtttgggtgtgtgccttgtgatctgggtgcctgcagtttcccccactgtattggaaatgctttaaggatagggatagccaaagctccacggtttttactccataggacaccggcaggtctcccaggactgccagctgtgcgtcaaggagggttaaggcagtcttaaagcattgggggtggagcaatgtgctgtcaggaataagctcctataaggagctggagattctttcctgagcctgtttatattcattacctgaaacagtgatcctgttgaagttgtttgctttagttatttggtgagactttagctaattttatatgattatactatattaatataaatatatacattatataacatgctttgcatatattaagttatattatttaatattaaataacttctaaagcaaattctacaagtatagaaatgctaatatatatcagaacatctctgaattgaaaacgtccttaaagtaaaaataacttttctttcagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgca

SEQ ID NO: 37930 - DNA, 12742 bp, Homo sapiens
attttcctggggctccggggcgcggagaagctgcatcccagaggagcgcgtccaggagcggacccggtgaggcgcggagaggggcgggcgggggaaccagaggggcgggctcggtgctggggactcggtgctggggactcggtgctggggactcggtgctgagggcccggtgctggggactcggtgctgggggctcggtgttagggcctcttggtgcactggggttgccggtccgcgcagggatggggactctggggctgcggcgcctctgcctctgggaccgtcaccccccgctggccctgagcgtgcgtcgcaggccaggcgggcggggtcgcagcgggcgtacccgagtatgggcgggaacgagctgccggccggtgtggggacccgcgtccctgccctgtgcgccaggctcgactcttgaagggacagaggcggcgtctcggacccggggctcccctaagtccgatgggtcggagccccctcctcccttcccggtcctcggcctcacccggggttccctgcgccgtcgctgcgaccaagctgggagcaaaacgcactcgctcatatgcgtgcacacaagctggtggacacacgcacatgagcacacgcaggcacgcgtggactgttgcacactccacagccacagcctcgtgtgcactcacagcaaactcatgaaacaggaaccgtgaggcttccctcacccggcaggccctcagctgcccgttctcacgcgggttttgctgactccgcagtaatcaccacattcagttccttgcccactactggtgaatcacctgcagcttgagaagcacgttttctgccggtggtcagcagaggatccccggcttctaggaggcccagggcgaccggctgcaggagcccgcgtaggaggcctgtctccagcagggcgggggtggtggcagggcctctccacggggctgctgctgagcccagagcgggaggacaggaggccaccagcagaggggacaggtgaacaggtgctgagcaggaagggttagcccggtctagccccaggcctggggggctttgctgctcacctggggtcccctctgggcctggctcagcagagaccagggcagagccgtccacaccgtgggcctgggtggggtccatggcctctgcaggctgcagctgtcttctgagaggtgttggtgtgctcattctcggtagagacgtggggtcacctgtgttccctgagcccctgcagcagctgggaaagcagtgtcagccacccctcaggtgctgtgggggtacagagtccactgaccacacaggaggaccccaatgaacccagcccgagggggccggagcttccacacacccagcacccatgggagccgggacaggcaggcgcccggggcaccagggagcgggaacaggcatgcgcaggcgtgctgggcggtgcgtgaactttcctaggcgtgtcactggcatggctccaagcctgcgcatcatcgcttgtcagggagcactcagaccctgccgtgtctggtgccggcgcctcagataccgacccctgtgttcgtggtttgagagaaatctgattgccgcctccatcttttcccgctctagaagtttgttttttgttttgtttggtttgagacggagtttcgctcttgttgcccaggctggaatgtagtggccagatcttggctcaccacaacctccacctccctggttcaagcgattctcctgcctcagcctcccaagtaactgggattacaggcgtgcaccaccacgcccggctaatttttttgtatttttagtagagacggggtttcaccacgttgttcagactggtctcaaactcccgacctcaggtgatccacctgcctcagcctcccaaagtgctgggattgcaggcatgcgccaccgcgcccggcccactctagaagttttgaggctccgtgcgcctcgtctccctgtacctggtctccctgtgccaggtctccctgtgccacacacggagctgcccggccagtcaccgcccacctggccactttccctggggccgcgccctgccgcctgccctctctctgatttttagccactgcgtggcattcaactcaagcccacgcctctggtcaggaggatggcaggagaggactcaggcagacgggcagagtggcagagctgccaacaaaaacgcaggatacccagtaacatctgagtttgagatcgttaatcgtgttttaatataagtgtgtcccgagtgtcccacgggacaagctttcaccaggacatcattggttgtttatctgagactcagatgtgaccagatgtgcctggtgacctgagaggggcctgtgttgccagggtgcgttttcttctgataaacggagcaaattcccacagcaacccaaagtcgctgacacctgctgcccagacagagctggggccacgcatggtccgcagcctgaagcctcggggtagagccagacctgccgctctcctcccggtctccccccagctccctaccccctgagcccttcaaagtcattctcaagccaaagacaggggtcttccaggcccagggctcccctccacggctgactcattccacacctttcccgccacttgccgggtgtggaccgacaggaagggcaccgccacctgctcctagtaccctccagcccatcccttgccgcccttcacccctggctggacaagggtcagggtcgccaacattggagggcactcagtggggagctggtgaaggtgctgggaggaagggaggaccggggagaggcagtgagaggacccgcgtgtgagaagcagcggccgccaccacagttgggctaaagggacttggtggggaggcagcatctccggaacggtgcagtccaggccgccaggggctgagaccatggagaggatgaggccagaaagacggacagtgccagcttctcactcccacccccctctccccaaccactgcagcccagggccccaggtcttcaggaagcaatcggcagggaggctaggagccagcactgcagggtccaccctcggtggcagaggcatctaggagcagctgtagcccccgagagcagaggctccaccgagctgctggccccatggaatgcacagcgggcagacttgggacactcagggtggaggggaggcagatgcagccactgccaggcgggaggagcttggcatgaagccaggtgcgtgcagctggcccttgggggcctccaggacccagctgctgaggtctggctcagggtgcagctctctgccgagtcagggctgactcaggacacagacgggtggcagagccagcacctgggtgggcaggtggggtggacgcagcgctgtcggggctctctggggatctgtgacctttggctgtgtgcccagaattcccacccctaacacatggcaggggcagtccctggaagcatttgtgaaacagactcagatggcctccaggctccaggtgagggcaggactccccagagcagcctggggagagcagcagggcatcccctcccggacacggtcggcggggtggtgcggagagcagtgggggagcccccagcagccccgaccctccctgctgtccatctgcacggttccaaggtgggtggctgagctggcatcgtggagcgtggggtgagggagccggacccaggccccctggggtctccttgtgtgaacctcacctccatgcaggggtctgcaggtggcctgggtctcccaccgcactgggggtgggggttctgtggtcggctaccagtccccaaagatgtcacgtcctcatcccagaacctgacatggcaaagagactatgcagatgggatgaagcctcgggtgctgagctggggcatgtgtcctgggtcacccaggggggcccttgatgccatcacagggtctccaggagagggagagaggagggggagtcagggagatgagggaagcagctggggggcagtggtggggagatggcagaggggccatgagccgagggatgcggatgcctctggacgctggagacggagagggacagattccgcctggagcctccagaagggaccaccctgacccaccccttgattttaacccagggagaccccgtcggacttccagctaatctagaatgctggacgtatgatgggagatggggcccgagcctgtctccaagcccatctgagcagccctgaggggtcacagcaggaaagggggtgttagtgaggggccacaaaaggtctcaggtgtgggttccctccccttgcactcagccctgacagggtggggtggggtttccaacagaagggactggacttgtactgagcatagcggctgcctggagtggggaacccagacctcaggacacggcacccgcagcctgcgccaatgtgggaccatccctgagcctcagcagcacctcggggttggtgacgtgcctcccagcagtgacagtgtccccacacctgcactctgcggctggcagggtcttccacgtggaggcaggaccatggtgagagtatgggaatgaccgggtggctgcctgtggctgtgcagggcccagggatgactagaggcatgttcacagggggttggagcgcttggggcaatgggacgagaaggccggagcccgtctgcaagccaggtcctcagcaggcccagactccaggctccaggaggacccctggtaacatggggtccccggggttggtgacgtgtcctgctgtgacactttctggtggtttatttgtttggagaaacacacatctataaatctatagacatctataaatagcacgtctgaaggtcgctttacagagttccctcatgggagttccctgcaggtcatctgcactccggcgtgtgggctgcactgggagctgggagaggcagggctggagttgccgccctacctagggacttttcctagcaggggtgcaggcacccgagaggcagggcagcctggccacgaacccttgccccagccgccttcgaaggtggagttctctcggctgaaaggcgtgtcctgccagggctcctgctgggccttacccgctgccccacctggaacagacccaggctgcctcccctcactttcccttccctggtccctttcaaagtccagcaggaacgtcaacaggttcatgcaaaagcacgtcacctggtccacgtgagggcctgacctttgaccagcccaggcatcggcccagaccccaccggcgggactgactgagttagggttggggttaggttagggtagtctcctgtgcaaggctgagctcctgcgtggaggcaggtggggctttgtggagcttccacacagggaccctcatcccccagccactctcaggggatccagatccacacggatccagcacctcctgtatgcagggcatgagtggggaccccgtgggaagcacagaagcggcgacctcgctggggcctgtgagaggctcatcactgcctgtggggccctcccccagcaccgtgggtgtgtgccctggagccgcctctgcctggcgggagaggagccacacagctagggggcccctagtgtttgcaggcctgagacaagatggcacaaggaggctcgcctgctggaagctgcccagcagcctgccttgccagtgagagcagcagaggtaaagctgacttgcgcattaggaacacacagaggtgtaaacgatggattcgaaaggaacgcaactgagtgctgccccgggaggggggctggtggacgggcagggtggtgggggggctggtggacaggccggggaggctgatggacaggctggggaggccggtggacgggcagggtgggggggctggtggacgggctgggggggccgctggctgcaggttgtggtcagcgctgggcttggctgggggagtcggaccctgggtgctggtcatgtgagggtctctgtgagtgactggaggtctggacaggacccacgaggagacagacacgctccaagaattgtaatgccgaagctctgtgccctgggtgtgcagtgatatcaaacacatgctcctaggtagacggaaaattggtttcatgcttagcgttggtgaggggctggggctggaggctggtcttagtatagtgttaggtcagacacggctaccaacgattccacctgtcctgacccatttctataggaaacatgctcaggcacagttacgagtaatttattgtaaaacaaaagggctgacccgcaaggcagatggggtccccgctgtgctgcgggcaactctgtctcccgcccccgcgtgtcttctttgtttcgtgaggtcagcattgcacaccctctacaggcacagggaagggaaggagggcaggggctccagcatccagagcaggtcggggaagagctcggggacccccagcctcccagcccccgccaggtgacagccgctcccgctgtccccttcagcagctgcagggggctctgacccatgggctttccttcctccagggagtgtttcaagagccagtgacaaggaccaggggcccaagtcccaccagccatgcagacctgccccctggcattccctggccacgtttcccaggcccttgggaccctcctgtttttggctgcctccttgagtgctcagaatgaaggtaggtctcggggccccgcctctctgctggggaaaggggggcccggtgggggcatgacaggggcaggaggggtggactgaggttgggtccaggtgccaccagacccccgataatgactgactctgcagacccagggcctgaccatgtggagctgggctgcctcaggtggcggtgagtggaccgtgtcccgccgtgggtggagggtggtggtgagtgggccgtgtcccgccgtgggtggagggcggtggtgcccgctgtggtacctggtggtcactgtcagagcaattgtggggaaggaccaagatcacgaccagtttccaagggagagggtctgggtcagttgcgacctgtgccatggccgggaacagacagcagccctggcctgggggctccttagtcaggcgcacctcaggcctgccaggagtggatctgcatttgaacagggtcccccagtgagatcctccccagctctctagatccccaacctgtcagcaaagtgacctgaggggcttttcttttcttatcttttttttttgagacgggttctacctctatcgcccaggctggacgcccaggctggagtgcagtggtacaatcacagctcaccgcagcctcgacctcctgggctcaggtgatcctcccacctcagcctcccgagtagctgggactacaggcatgcacaccatacctggctaaattgtgtattttttgtagagatggggttttgccatgttgctcaggctggtctcaaactcctgggctcaagtgatcctcccacctcggcctcccaaagtgctgggattacaggcgtgagccactgagccacccgaggggcttttaaaagatgtcagagctcagccacatcccaaaccacatcccaaagcagttcagtcagaatcctaagaacgaacaaaaaacaaaacaaaactgaaagggaagaatcccaggtggaagaaccctggtttcgggagattctgcccccaccccccaacagtggttccaaagtgtaactgggctggggcaccccctggacagccgcccgctgccctcgggacggtgtgaatttgtgcagtggccttagaggccctgcagtccctgaacactcagagcgtccaggcaggcagccagcctgctcgtcagaggaaactcagtccagcccgaaggccaggtgcccctgaagcccacctcctcccatgggcaccaaggcccctggcacttgccagcacatggcacccaccatgtggttttgtatttggtgaaatgtggccaaatggcggctccaaccagcatgctgtgtgctccccgagagctcaccctgccgtccgtctgtccgtccatccgtccgtgtccagtcactggtggacgctgacgcagcagggacagtagcagcaccaagacctcaggctggtaccatgctcgggcccgacggcctgaatctcaggcatccttgagctggctgctggggcaaaggccccagaccctctgagggaagcagctgcacgggtcgctatggggcagggttcacccaggaggcgggagagagagactgacacgccggcttgtgtcaaggacttgacctcccaggactgtggagctgtgtatggagctggcccagcaacctggagctgagcgggtggccgggaggggaaagggaatgttgggggtggcacaagcaggctgggccccacaaggacaggctggaacccatgtctgctctgcttgcctctgaggctggcctgtgggtgtctgcagaagccctgcccttcctcacgcagccgagcacctgcacctggcctaggccttggagaaacaggagggagctgggggcggtggggcctggccactgcttcccacgaggagggtgattcggcaggtcagtggcagcactcctgccacagcgcagccgcccggcacacacctgaggctctgacttcacccaccccagtggaaatatacaggggagggagttgataggaaatgccttcgtccaagctgacacaccccaaggaacagacgtgggtgtgagcacgcacacacacacacatacacacacacagagccacccgtcttttttgttgctattttattcttcccacacgagatatatgtgctgattgggtcgggtggatgtatacatagttcactgtgtcccttagaggccctgtctcctgccctggccctggccctgggcacagcagccagccaatgccctgaggtccagccctgatccgtgtgtgcctctgtctggccctacaggctgggacagccccatctgcacagagggggtagtctctgtgtcttggggcgagaacaccgtcatgtcctgcaacatctccaacgccttctcccatgtcaacatcaagctgcgtgcccacgggcaggagagcgccatcttcaatgaggtggctccaggctacttctcccgggacggctggcagctccaggttcagggaggcgtggcacagctggtgatcaaaggcgcccgggactcccatgctgggctgtacatgtggcacctcgtgggacaccagagaaataacagacaagtcacgctggaggtttcaggtgaggggaggctcggggaagcaagggggaggggagtgagaggggacacggggaggggagggggcctgggcagggggagggctgagactgagagggaaggaggaggaagaagagcaggcatgagccgggctgccaggagacagggttggcgggtagagagttggggtggaggcctcttgacctcctgggacagttcttcctttgggaggggcaggggtcaggcaggaggctcagggggcacagaccccacagtggggtgggacccacagagggcagccggagtcccacaaacaacacagaacacaaagctgctcctcaaaggagcccagtctgcctgtcaggggtgggggctgcaccctgcagccaggaagcccaggcaccccccgcctccctgccacccccaccccggctgtgtggggaaactgcaccccaaatacctgtgctctgagaggccctccagacccgcagcacctggcttcgaggcacctgccctccctttactggggtcacccagaggtgctcaaggtcgcccgcgcagcacccttagtgaccacgaacaggggcctcccaggctgccacggtcctgccccgcccctcccactcccactcccatgttgtccacctcgacaagcacctagaccacacctgccctcgccactcctgtcttcagggctgggaccacccccgacccttctctgtccccacccctctcctcctgccctcaggggatgctcgctgccccactctctgcctcagctcccccgacacaggcatgatcaccacccactcatgtccccactagcccagcccactgctccctctgcctcttctcccccgactcagggcccacagccgtcaccaccagctacttatctggttcaaccagaaagcagtggtggccagcagagcagcccccaggccctctgttctgccctccaagcccctcccacctgctccctaggccctgagcggccaccccaccgtgcggggccactgacccctctagtcaccaaacccactccccacccctcccctccctttcctgcaaagctcaggagcctccacggcccctcccagccctcccaccttcaccacacccggttccgacctacccgggtcacccaaattgggttccgctttgctctccacccccagggcatctggtgagcccttcctgggctcaggcatgaggctcctcagatacctggccctgggtgggccacaacagggcaggcccctcccctgcccttgcatctcttccccagaaccccgaggcctgaaggaccgggccagcgcgcagctcctgggacctggcacatccaggggtagatgtttccctcgctgccccgacacacctgcgctctgggtctccttccacctctggtcctgcgccccctctcctcctggctccctcccacccctgtacctcctgggcaacggcggtgccgtcttccaaggctcattctcaccccagggagtgtgtaggaggaggaggctgggagctacacggaggaggtagggggtgggggatgcccagcccacctgtacacccctgaactgcctccttcaggtgcagaaccccagtccgcccccgacactgggttctggcctgtgccagcggtggtcactgctgtcttcatcctcttggtcgctctggtcatgttcgcctggtacaggtgccgctgttcccagcaacgccgggaggtaggaggccctgcaccccagtttgtgcggggtggggagtcttgggtggggctgccccaggctgaggtcagccttactgtcctgcacctgctggggctccaggagagggtggggggagcaccggtcccagagagccagtccccgccaggggcccagccggctatggtcaagaatacagagccaggctccccacccagacccgccctgcccttcctgcaagctctcactgtccccaggactccctggagggcagcatggcagggtgcgtggtctccatcagggacggaacttggagtttctgagccaagggagcctcttgctgagggtgccttggggagtgggttcaacctccagcagtttcagaacccaggcgagggctgggagtgtgcctgggggtgggggtgtgcatgagcacgtatgcccgtgagtgtgaacgcacgccccagggcagagctgtgggcacgggggcgcgcggctcacacaggcacctccttcctccccctgcagaagaagttcttcctcctagaaccccagatgaaggtcgcagccctcagagcgggagcccagcagggcctgagcagagcctccgctgaactgtggaccccagactccgagcccaccccaaggccgctggcactggtgttcaaaccctcaccacttggagccctggagctgctgtccccccaacccttgtttccatatgccgcagacccatagccgcctgcaaggcagagaggacacaggagagccagccctgagtgccgaccttgggtggcggggcctgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccaggacgcatgcccctccctctgccctcatcaaacccacagacccggactccctttctgccaccccaggctggtccggccccaggtgtggggtccgctctctccactcccagggctccgcgcccaagtgagggggcccctgccggagcctcagacacactccagttcagggctgtggggggccttggccacatacctgtcccttggctatgagcaggctttgggggcccttccgcggcagccccgggggccgaggtagggtcgggggcttagaggctgggatggctcctggccccaccgccagggggcagcgcaggccgggctgggaggcggcggcggcggctcgggctggggggtcaggtggacgccgccctccggggctggacgcgcatccctcagtccctcggccacccgggggtcgctccctcgtgcccaccgcacctgccgagcctctttggacccagatctgttcatgcttttgtcttcgtcactgcggcggggccctttgatgtcttcatctgtatggggtggaaaaatcaccgggaatcccccttcagttctttgaaaaagttccatgactcgaatatctgaaatgaagaaaacaaaccgactcacaaacctccaagtagctccaaatgcaatttttaaaatggaaaacaaaaatctgaaagaaacgtctttagtggctttaagccccaaaacgtccctaaggcgtcctcgagatgaagacgggggggagcccccagccaggtggagaccccgcagggacgcggcggcgcccggtgaccgaggcctcgcacagccggccgccctgagggtcgggccggagccagggtccaagaggggcgcgtttgtgtctcgggttaaaataaggttccgtccgcgtgctgggtcaga

SEQ ID NO: 37931 - DNA, 2423 bp, Homo sapiens; identical to SEQ ID NO: 37116

SEQ ID NO: 37932 - DNA, 2136 bp, Homo sapiens; identical to SEQ ID NO: 36140

SEQ ID NO: 37933 - DNA, 20090 bp, Homo sapiens
tctggcattgcaagcctcgcttcgttgccacttcccagctcttcccgccttccgcggtataatcaacactacgagagatagagccgcctagaaccaggttgttttttctttcttttatttttatttcttgtttgaatcacttgtcgttaaaaaaaagtacttgaaacgtttggttcttgcttagcaagatgtttgtgtttcttccacattgattgcatccactcagaatttatattctaccctggcaatatgagctgaggcaatcttaacttgatccgttagttcccccaacctaaaaactagggacattttttttttttgagacagagtctcgctttgtcgcccaggctggagtgcagtggcatgatctcggctcactgcaacctctgcctcctgggttcaagcgattcttctgtctcagcctcccaagtagctgggactacgggcaagcgccaccacgcctggctaatttttgtgtttttagtagagacggggtttcaccatattggccaggctggtctcgaactcctaacctcatgatccgcccacctcggcctcccaaagtgctgggattacaggcgtgagccagcgcgcccagcttttttttttttttttttttttttgagatggagtctctgttgttcaggctggagggcagtggcacgatctcggctctcggctctcagctcactgccacctctgcttcccgggttcaagcgattctcctgcctcagccttccgagtagctgggattacaggtgtgcatcaccacgcccagctaattttttgtatcttagtaaagatgggatctcatcaggttggccagcttggtctcgaactcctgacttcaggtgatccgcccgccttggcctcccaaagtgctgggattacaggcactgcgcccgaccttttcttttctttttgagatggagtgtttctctgtcgcttaggctggagtgcagagtgacatgatcttggctcactgcgacctccaacccccgtccccaggctcaagcaattctcctgtctcatcctctctagtagctgggattacaggcttgtgctagcatgcagggataatttttttatttttagtagaacggggggtttcaccacgttgatcaggctggtctcaaactcctgacctcaagtgatctgcctgcctcggcctctcaaagagctaggattacaggtgtgagccaacacacccagcctaaaatgattttcttttcaaaggaaacttactagcaagccaagcttatttattatttattttattttatttttagagacagggtcttgctctttcgtccaagctggagtatagtggtgatcacagttcactgcaaccttgaactcctgggctcaagcaatcctcccgcttcagcctccttagtagctgggactataggcgtgcaccaccacacccagctaactttttgtattttttgtagaaagagggtctcactatgttgcccaggctgtttttgaactcctggccccaagtgatgctcccacttgggcctctcaaagtgctgggattacaagcatgaggcaccacacccagcctgtcttgcttattctttttgcttcaaacatatctctgctctggctggatgcggtgcctcacacctatattctcagcactttgggaggccgaggcaggtggatcacctgaggtccggagttcaagaccagcctgaccaacatggcaaaaccccatctctactaaaaatacaaaaattagccaggcatggtggcacgtgcctgtaatcccagccacttgggaggctgaggcaagagaatcacttgaaccctggaggcagagtttgcagtgagctgagattgagacactgcactccagcctgggcgacagagtgagaatccaccacaaaaaacaaaaaaaaacaaaaactaaatatatctctgctctgtaaccaaatttcagataaactggtgcagcccttcagtatggggcaaaaaaagttatctttatgtcttttgtccacttttatcactacaaattttacaaaatatccctgcaatttttttttttttttgagagggagtcttgtgctgttgcctaggctggagtgcagttgagcaatctcggcttactgcaagctccgcctcccgggttcacgccattctcctgcctcagcctcccgagtagctgggactacaggtgcccgccaccacacccggctaattttttgtacttttagtagagacagggtttcaccatgttagccaggatggtctcgatctcctgacctcgtgatccgcccacctcagcctcccaacgtgctgggattacaggcatgagccaccatgcccggcctttttttttttttcagacagaatctcactgtgttgcccaagctggagtgcagtggtcactgcaacctccatctcccaggtttaagtgattctcgtgcctcagcctcctaaatagctgggattacaggcatgtgccaccatgcccagctaaagatggggcagggggtgcagggatctcgatatgttggccagactcatcttgaactcctgacttcaagtgatcaacctgcttcagcctcccaaagtgctgggattacaggtgtgagccaccatgccggctaattttgttgttattgttgttgttgttttgagatagtctcactcctgtcgcgcatactgaagtgcagaggcgcaatcttggctcactgcaacctccacctggctcactgcaaccttcacctcctggattcaagcgattctccttcctcagcctcctgagtagctggggttacaggtgtgcaccaccacccccagctaatttttgattttttagtagagacggggttttgccatgttggccaggctggtcttgaactcctgacctcaggcgatctgcctgccttggcctcccaatgtgctaggattacatgcgtgagccaccatgcccggccttgttgtttttagaaacgatattttttcctgttagcttgtgaaagttgattgggtcattcttgtcatccccaactaaaacagtgtcaagaggtaaagggaaaaaaaagcactcagggcacataacattgctccaaaaatgtaattatctgtaagcctggctgctgaaactgcccgctataacctaaaccagtttttttgtttgtttgttttgagatggagtctcactctgtcgcccaggctggaatgcaatggcatgattttggctcactgcaacctctgcctccaggttcatgtgattctcctgcctcagcctcccaagtagctgggattacaggcacccgccaacatacccagccaatttttgtatttttagcagagacggggtttcatcatgttggtcaggctggtcttgaactcctgacctcaggtgatccacccgcctcggcctcccaaagcgctgggattacaggcgtgagccaccgtgcccggctgacctaaaccagttttatctaattagctgctaaaaacaacctgcagtgactctaaggatcgttttacctagttgccattacttgccaatcaaaacttgccagctccccaaaaccttactagtgacaatgaactttcttaaagaacaatatacaacagttctctttttttgttgtttgttttgatatagggtcttgctttgttgcccaggctggagtgttccggtgtgatcacagctcactgcactcccaaactcctgggctcaagtgaacctctcatcttggcttcccaacgtgttgggattacaggcatgagccactgttcctggctatatttctcttttacaaaaataaaacctctaaccatctgtttgttcttctgacgtaccaaagaccaccctgtttgtgtgtatgccctgaatggcaattattgcttcccaaatgttttaaatttatagatttgtctctgtattttattttacttggacagcctttttctttttcttttctttttttctttctttttttttttttttttttttagatggagtttcacttttattgcccaggctggaggacagtggtgcaatctggggctcactgcaacttctgcctcccgggttaaagcaattctcctgcctcagcctccccagtagctgggattacaggtgcccgcccccatgccgggctaatttttgtatttttagtagagatggggttttgccatgttggccaagctggtctcgaactcctgacctcaggtgatccacccgcctcagcctcccaaagtgctgggattacaggcgtgagccactgcgcctggcttggacagcctttttgtacccctgattcccaggagaactgctgctctattttcccatggcttaccttgaaaagagtaggatactagagaaaaggatggctaatcacgtgtttacaagccatgtttcaggagatgacccttgtagcccggatatttatttgcctcaccaaaattcaggttctaggtgtaagccaggatttgggggatggaactgaaaatgcttctccaaacggtgaaaagcgggcccagcgcagaggctgaggaggaaggatcacttgaagccaggagttcgagaccagcctgggcaacatagagagacctccccccacgccctgcccaccaccgccgtctttacaaaaaaattagccaggcatggtggtgggaccacaggggcacaggctgaggtcagaggattgctccagcccaggagttccaggctgcaatgaatggtgataaacccactgcactctttcctgggcaacagagtgagaccctgtcttaaataaaataaaataaataaataaaaaaaaaagaaaagtgaaggcaacgttaataagtgtccactatgacataataataaccagcatcacacacacacacaaatcttgcatatatcacaaaaatctcagtatggtaattctgtggagaaaaaaaaaaagcccatccaggtaagcatagaaagtgttttttcatcatctccctttgactccaaatgaagaagcagagttcccaatagcatgaactagatgttggcagaggaaaaagcgagtcctcgtcctatcctggtgtaaacttctgattctggacaattctcagtaggattggcaatgactcttctaggcctccttgtgattgttgatatattttttttaatttaaagttccggaatacatgtccaggacgtgcaggtttgttacacaggtaaatgtgtgccatggtggtttgctgtaactatcatcccatcacctaggtattaagctccgcatgtattagctatttatcttgatgctcccctcccccggttatcaggatttttaaacagtttgctctaattcactgacaggattcttttagaatgaatctaaaaaagctgggaatctttaacctgagcgcagatcggatcacgtggaacggtgctggtgtttgttaaaaattcagattgccccgaattttcgactcagagggtctgaagtggggctaagatctgcagattaacgggctccgtgggaggctccctgctggtggccagtcccggggtttagctgttcactgttgctactcgtgctaaaccacggtctaacactaccgacactattaatcgccctggtcctcaagacagccgcgaccccagacgggtgaggccctcatcctctagcaccagatggggcctgggaactgctgcttagcagattcagctacccacgtggtcacccggggcaaccacaaggtcgactcaaaagaccaaaataaatgtataacgaatgccaggaccaaagccggaatatatctaatcattcattttgaggtttaaacttaaaaatgttacataaaaaaataagtaacctgccaaaaaatgcagagtggcggcgggggcggggggagaggtggtgaacgcgaggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtgaggttcctctctttcgattcttagggtcgcgtcccgctgaaggtcagaaaactgctgtcagctcttgttgaagctagtcagtggagtctgacattgtgtgaaggtcagcaggcccagcatttcacctctgcctggagctcagtttagaggaaaggaataaatgaaggtggtttttggaatacttacgtaggctttctcttagtgctgaatacgaaacgaccgtgaaaacgtcctgcaggtgcaaagaaccatttcatgtggccagcactgtgacaacagtgaagctggtttctaaattgtctctccggcagagtgtgtgctttgtggcacttggacgtgtttaaagaatttgtccttgagttttccacctggttttgagtaatttttagtgatggagaattcaagtaaaagagaacaaggttggaaaatggctgtaaggattaatacccttcgttatttgtttcccttgaaattaacatgatttcagtgtaaacgcattgacactgacactttttttttgttctaaaagtaatctcaatttgaaaggtgaaataaacatgttggctgttttgctgccttaacaaccgctggtagcatcttgggtttctgttaacaaaaaagcatttttaacggttttcatctagctcctatggaaggtagaggcttcagaattgacagtgaccagtcgcagtattacaacttgaaggagaaactgaaggaagttccaggtggctgcaggatttgttgagagagtaaaataagtccacatgccacaactcttggtttctaatctaactctagcatttattcagtttttgtttgcttgttttttttttttttttttttttttgagatggtgtctcgctcagtcgcccaggctggattgcaatggcgtgatctccgcccactgcaaccaccgcctcccaggatcaagtgattctcccacctcagcctcccgagtagctgggattacaggcacccgccgtcatgccctgctactttttgtagtttttcgtagagacggggtttcaccatgttggctaggctggtcttgaactcctgacgtcaggtgatccgctcgcctcggccttctgaagtgctgggattacaagcatgagccgtcgtgcccggccgcttgttgtcgttgttgttgttgttgtttttaagtaaaattggaactactttgagttttgccccttgtaggaagctgtttatcttagaattcctgcaactccattaaaatacatctaaagtcaaaataataaaaattgggtacctttaaagggaaagacacttacattttgttaacagttgctttttttttttttttttgagacggagttttgcttttgtcgcccaggctggagtgcagtggcgcgatcttggctcaccacaacctctgcctcccaggttcaagcgattctcctgcctcagcttcccgagtagctgggattacaggcatgtgccaccacgcccagctaattttgtatttctagtagagacggggtttctccatgttggtcaggctggtctccaactcccgaccttaggtaatccgcccgccttggcctcccaaagtgctgggattacaggcatgagccaccgtgccctgccaatagttgctttttaaaatactgactgccaggccgggtgcagtggctgacgtctgtaattccagcactttgggaggccaaggtgggtgcatcacctgaagtcaggagttcgagatcaacctggccaacatggcgaaaccctgtctctactaaaaataaaaaaattagccgggcatggtggtggtcgcctgtagtcccagctactcaggaggccgaggcatgagaatcgcttgaacctgggaggtgaaggttgcaatgagccaagatcgtgcccctgcactccagcttgggtgacagaatgagactccgtctcagaaggaaaaaaaaaatgtgtgtgtatatatatatttactgcccagtaaatatatatttatttactgcccagtctgggcaatatgatgaaatcctgtctctataaaaaaaataagtacaaaaattagcctggccaggtggcgcactcctgtgatcccacctactggggaggctgaggtgggaggatcacctgagcccaggaagtcgaggctgtagtgagccgtgattgagccactgcactccgacctgggtgacaagagtgagaccctgtcccaaaaaagaaaaaaaaataagccgggtgcggtgctcacgcctatagttctagcactttgggaggccaaggcgggtggatcacttgaggtcaggagttcgagaccagcctggccagcatggtgaaaccccgtctctactaaaaatataaaaaattaacctggtggaggtggcgcacccctgtagtcccagctactcgggaggctgagaatcgcttgagactaggaggtggaggatgcagtgagccgtctcaaaaaaacaataataataaagtacagactgcattttaaaaatatgcgagtgtttactgtgtactaggagctgtataaaaggttttcacatatatcaaaagctactttcccatttgacattttaaacaaaatgctttatatgtaattagcattttcaccagtactttgatcacactaagctggcatttgtttaagcttgtaagttttataaaggctttgttaaaaatcaaatttttaagaatacttttgcactaggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtggtgagttgtttttcatttgttagttttttctctagtttgtatagactctcaggttcttaaaccatattgttaccatttagccctgtcatggttctcttgttatagtcaaatgaactactgttacatatttttcttttgatattagtatggcttctttgttctggtaatggcccttgggtagaaacagaaagaacatacactaggtaatggaatctttgtgacctctggaagacttcctttttccttttctaaaaggcattagaaaaaatgtaagttcttattgataggttttcttattcgttttctttttttttgagacagaatcttgctctgtcgccaggctggagtgcagtggcaagatctcggctcactgcaacctctgtctcctgagttcaagcaattctactgcctcagtctcctgactagctgggattacaggcatgcaccaccatgcccggctaattttttgtattttagtagagacaaggtttcaccatgttggccaggatggtctcgatctcctgaccttgtgatatgcctgcctcggcctcccaaagtgctgggattaaaggcgtgagccactgcaccggtccactgataggttttattttttcaaaggcagtagctactagatatttggcaatctgtgaacttgcacattacagatgcagtagagaagtggggaggcaagcataggaagacactataagttggggaatttctttggagatgagtatttggacttttaaaataaaggttaaatatatatgtgtgtgagagtgtgtgtgtatatgtgtgtgtgtgtgtgtgtgtgtatgtgtacacacacccccacgttcagcatatatgtttttcttttttcttttttttttgagatggagttttgctcttgttgcccaggctggagtgcagtggcatgatctgggctcactgcagcctctgcctcacgggttcaagtgattctcctgcctcagcctcccgagtaggtgggattacaggtgcccaccaccacacccagctaatttttgtattttttgtagagacaaggtttcaccatgttagccaggctggtctcgaactcctgacctcaggtgatccacctgccttggcctcccaaagtggtgggattacagacatgaggcactgtgcgtggcctccttttttttgagactctgttgcccaagctggagtgcagttgcgccatctcagctcactgcaacctccacctcccaggttcaagtgattctcctgagtcagcttccctagtggctaggattacaggcacgcaccaccacacctggctaatttttgtatttttagtagagatagagtttcgccatgttggcctggctgatctcaaagccctgaccccaggggatccgtctaccttggcctcccaaagtgctgggatgtttttttattttgttttgttttgttttttgagacagagtttcgctctgttgcccaagctggggtgcagtagcgtagtcttggctcactggaccctccacctcctgggtttgagtgattctctcctgcctcagcctcccgagtagctggtattacaagcatgcaccaccacagctggctaattttttttttttttttccttagtagagatgggattttgctgtgttggccaggctggtccaaactcttggcctcaagtggtccgcccgcctcccaaagtgctggtattactggcgtgagccactgcacccaacccctgtatgctaagatgaagaataccacctatactaccctgtgtgccttgaaagagaaagacacactttgttaacagttgatttttattttttattttttatttttttgagatagagtcttgctctgtctccaggctggagtgcagtggggctatctcagctcactgcaacctccttctcccaggttcaagtgattctcgtgcctcagccacccaagtagctgggattacaggcatgcaccaccatgcccggcaaacttttgtgtttttagtagagatgggggtttcaccatgttgcccaggctggtctcgaactcctggcctcaagtgatccaccccctttggcatcccaaagtgctggttttacaggcatgatctaccgtgcctggccaacagttggtttttaaaatatgtttttattgaatttagccaaaaattcaggttttaacatagttacagatttcttagaaattaaaggagaacatttattttaagggttttacttaatttgattagcttcttgtctggtttacatttgttttgtgtggacttttttttccttaatcacttggttttattttcatagcttttaaaaatagaatctcgtgttacagtgtagaatatatatatatatatataatttttgtgtgtgtgatagtctcactttgtcacctatgctggagtgcagtgacacaatcttggcttactgtgacttccacctcccaggttcaagcagttcttctgtctcagcctcctgagtagctgggactacaggcatgcccgtgcccagctaattttttttttatttttagtggagacggggtttcacaatgttggccaggctggtctcgaactccttacctcaagtgatctgcctgcctcagcctcctaaagtgctagcattaccactgtggctagcgtgagccactgtgctgggtctgtagaatatatttggattattatgatcacaaaactagttttttgttgttgagaaatgggctttgaaaagatccgaggaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtcagggtatgagaaataagttgtaggagttagggaaagcagaggatgacatctggataaactagagagagtggaactgtctagtaggcatgcagatatgggaaaagatagtcttgatactcttggtaatgtctactacggaaaaagagccacttgatgtggaagaataattacagagcccaaagttatcattagctgtaagacattggccaatttagcatcttcagtgtacagtatttatctttgaaaggtgaggtcgaaacagattaattctgagttccccttttagcttttgaaatccaagtgtctagaacagtactgtccagtagtattggaaatatgtagtattctgcagtgatgagaatacatctgtgctgtttaatatggtacctactatactatcactattaatcatgtaaaatgtggctagtgtgacaggaactgaatttttaatcttttaaatttgacaaatttaaatagccacatgtggttagtggatgctgtattgaacatcagagatgtaggttaaagtttttggatgtgtaatgatattccatgatactccaagtacttctccagagttttcattattgaccagactattcctggaatagcctttttgcttcagacatgatttaaagatctaaaatatagttttaatgatgagagatgatttggtgctgttatgttatgaaaatttgtatttgattggttacagttaggtagcttttaatttcactttctactaactcgaagagtacaggttttgattaatttttgaaactgtttatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcgtgggtttgagccccatgttgggcaccagatgaagggggccagcccctccacacctgtgagtatttctcgtcaggtgggttgagagactgagaaaataaataagacacagatacaaagtatagagaaagaacagtgggcccaggggaacggcgctcagcatatggaggacccatgccgccactggtctctgagttccctcagtatttattgatcactatctctactatctcggtgtgggggatgtggcaggactgtagggttaatggtggggagagggtcagcaggaaaacgtgagcaaaggtctctgtgtcataaataagtttaaggaaaggtgctgtgccttgatgtgcatgtaggccagatttatgtttgactttacacaaacatctcagtgcagtaaagagcagtattgctgccagcatatctcacctccagccatagggtggttttctcctatctcagtaaatagaatgtacgattgggttttacaccaagacattccattccccgggacaagcaggagacagatgccttcatcttatctcaactgcaaagaggctttcctctttcactaatcctcctcagcacagaccctttacgagtatcgggctgggggatggtcaggtctttcccttcccacgaggccatatctcaggctgtctcagtggggagaaaccttgcacaatacccaggctttattgggcagagggccctgcagccttccacagtgcattgtgtccctgggtactcgagactggagaatggcgatgacttttacgaagtatactgcctgcaaacacatttttaccaaagcacatcctgcacagccctaaatccgttaaaccttaagtcaacacagcacatgtttctgcgagcacagggttggggctatggttacagactaacagcatctcaaggcagaagaatttttcttagtacagaacaaaatggagtttcttatgtcttcttctttctgcatagacacagtaacagtctgatctctctttctttcccccacagggaagtccttttaagtttaggaagatttatatttactttctctttttaaaggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcaggtattaaaagaaatttagtcccattgctattatcttaagtcccattgctgctgattgtagaatagcttctacttaatgaaggcatattttaattacttcctaatgggctgaactttttaatacaaatcagtaggtaagacaatgtaaaacagtagtacatttaaaggttttgttggtttctttaaagtggaagctgtttgattctgattaactctttttttgttgtttgagacggagtttcactcttgttgcccaggctggagtgcgatggcacgatctcagctcactgcaacctctgcctcctgggttcaagcgattctcctgtctcagcctcccgagtagctgggattacaggtgcatgccaccacgtccggctaatttttgtatttttagtagagacggagtttcctcatattggtcaggctggtctcgaactcctgacctcaggtgatcacccgcctagggcctcccaaagtgctgggattacaggcatgagccactgcgcctggcctgattaactcttaatggtaaatatttttagcacttaggtaatttttatagtagcctccaatttaaaaccacaatattgataaaattgtaaaatatattttctcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggtcaaaggaaataaatttttagaatccatttatttgtactgaagtaaaagttcacatatgcaacttctatttaataggttaacttcacaaacctattctgtaccataggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacaggtattattttaatgattaaaagaaatgttaaaaaagatttggataattctaaggcattggttgagactaatggtatattgactgatttgctaaatgcattttactttttattatggaaaatttcaaatacatagaaaagttaggagaatggcatagtgaaaccccatgtatctgtcacccagttattgcatagagtagcatgtttcgttctagtttcatttttaaccactactgttctcccttctagataattttgaatcaaatagaaattatatcacttcatttgtatgtatttcagtataaatatgttgcctattatgtttttttctcatctcatgcacatctcctaattgcagcaataaaatatacaggtcaggtcgtgaaagatttggggtactgatgctttgcattgttaggttttgagtttcagctttttggcataatgacttaaatttgaagatagttgatttcttactttaagcttgctagcgtgcgtatttccttacattatagatcttcttggaaacagaattgttctacaaaggtatccgccctgcaattaacgttggtctgtctgtatctcgtgtcggatccgctgcccaaaccagggctatgaagcaggtaattttgcatcactttggcagtaagggggctatcattagattagcatcttaaggtattaatatattaactatatttgtatagtgctctgtgtcactgagttacagtacagtaatttctgtattgcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattgtaagttgttcttttcttcatttggtcaggttcctattgtgtatcagggtcttcccaggcctacagagctgcatcacatatcacggcctgtactacgtgttgttatctgttatctttcatcaaaggcacttttacttaaactacatttgttttttgatttttgatttttttttttttttgagacgaagtttcattcttacggcctaggctgaagtgcaatggcgcaaccttggctcattgcaacctccacctcctggattcacgcgattctcctgcctcagcctccttagtagctcggattacaggtgtgagccaccacgcccgactaatttttgtatttttagtagagacagggtttcaccatgttggccaggctggtctcgaactcctgacctcaggtaatccaccctgcctcagcctcccaaagtgctgggattacaggtgtgagcccccatgcccggccctgtattctgttttttaaagagagacagtgtcttgcagtgtcacccaggctggagtgcagtggtgccatcatagctcactgcaggcttgaactcctgggctcaagcagtcctgcagccttagcttcctgagtagctaagactacgggcatgcactaccatgcctggctaatttttttgtattttgtagagacagggtctcactatgttgcccaggctggtcttgaactcctggccttatgccatcttcccacctctcaaagtgctggcattataggcgtgagccaccatgcccggcctcaaactatctttctttttctttctttcttttttttttttttttttaatacagagtctccttctgtcacccaggctggagtatatttttagtagaaatggtaaaacctctaccattttggccaggctgatcttgaacccctgaccttaagtggtccacccgcctcagagtcctaaagtgctgggattacaggtgtgagttaccatgcccggcccaaactacatttcttattatcatttgagtgtaaatgataggggcttcacaaccaggaaaacttaagtatatttaatgtcttcctttcaggaattaaggcctgttagagtcccctcccccacttggctatatgaatatgtaatttggcagatttaaaagaaagttaatacgtttttattttgtcaagtcatttcagcaaaatatttatactcaaaacagtattaacactgtcagattataaacagtgcttatggactatactgaaagattatgcctcaagccttgaaaatataagaaataactgttttctgtcaggggtgggaggaaggattattaagtggagttctaggtcattgatattgtgaagaatagataatttacagggacatgttaggaattggagaaaaagtaagttttcctgaccttggtaacatggcattcatttctttgagcaactcacttggcattcttcttgtatcttttcagctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcaggtatgaatgcaattgttggcatctttttttaaagttatgtttaagatatgaagttaaaattattttcaaatctgtagttaggctagtcattaaaactttttccaggtcagaacttacgacctgcttttatttccaaatagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagtt

SEQ ID NO: 37934 - DNA, 89249 bp, Homo sapiens; identical to SEQ ID NO: 36059

SEQ ID NO: 37935 - DNA, 855371 bp, Homo sapiens
agttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaaccctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgtactgacttagtattttttgttcttgatttatcttgctgtgaaagtggaagtaaaattttaaagtgttagtgtatttttcatatttctccttatatattctggaatttatgttttatagaagttgctattacaaatattaataattgttatgtgcttattgtaaattgtattacttactattataaagtggtttgtttaatgttttcttgacctgaattctacctcatctgtcgttaatattgcccttgttttgtttttttggtcagtcttttcctagtatacctttgctcatccctttattgttattattgtttagtgttttagaatcactttaaaaaaatgtatttcttgcatacgagagagttgaattttgctttgtgattcctgttttttttttgtaaattttctgtacatgtcttgtattttcaaaagtcattcttgcttttttgttgatttgtttttaattatagctcttctcacgtttagggccctccttccccttaactttattttatttttttgtggggatgggtgtggtaagttttgagatctgcttccattagtttcctctatgctacttgtttctcattgccctttcagcatttttgtggctgcttctgtttagctgttttggtttcacttgatttttgtacgttcatacctaatctagactttatgaggaattttttttttaccctcataatttctctggaaatgtaattttcttttcctttcacttcatctactttccccatgttttccttttgttttctatttcttttccagggagaatgggggagattcagaactaaactgttaccacatttgtccttgaaacacaggttttgacttttgaaattttaaaatgagtacttaacttagtctaaagttaagcaatactcttattctttgatcaacctccaatttataggatactgttttccactgttttagttatttttgttttgtttcaaacacaatgataattatatcattttataatataaataaattaaaaataaacagtaagtatatcatttatttacaggggtcagcaaaaggcatctataaatgaccagatagtaaatatcttaggctttgttggtcatacagtctctgtcacaactaattaactctgccttgtagcctgaaagttgccatagacaatagataaacaaatgggcatggttgtgttcaataaaaatttatttacaaaaacaggtggtgggctagatttagcctttgggccttactttgcctacacttgctcttaagagaaagagtatgcttctagggccctagtaaccctgatccaacttaaattaaaatttggcatatagtttttttttggacattatatatagggaaaattcatgccccaaagtagcctgatatctagtaaatggcccaaagttcccagggggaatagttgtttcgtatatgtggaaccaaggctgaaatagatgctatctatctgcctccacggagcatatttttaaaaactcactttttcattgaggatgtacactttcaatgatcttgactttacatagatactctctaatcttatacctacatgggtccaccttcaatgttggccattaaaatggaatctctaggccacctgattagtatatgtcatccttactgaatatagtttataattcacagttggcagaatatatttcgtgtgcttcatcgtttcctttattgaacgtttgtcccactcagccatcagacataatggtggttatgctttccaaggatggctaggaaagtactatgggtttattctgatcaactattagtgataaatattgatataggttgttagctgatatattaatctcctggtaggtttttgtttgatttgggataatctgattacagaatgccaattttgttttagataatctaaacatatttttatattgagtttcttttggcttattctacaaccaaaatactatgtctaaataaatttatctgcagggtatttttggcttgatttttgtcttactaactgcattacttgtcaggcatacttaagaatgtagtgtaagatgaaaatgggaagaatacatgattgatgagttttataagaataatagataaaccatgggcagtttcacattctgtgaattattgaagtacaaagcaaaacccaacaaattttttataaaattatttcttaatagaaaaattaatatcttactttacttattcctaaggcattttgaatttgctgcttacatgttgaaagtatgtggtgtcataaaataatctatagtactttcaaagaaaagagtacaaaatgatgggtaaatgtagtttaaagatgctgtcagaataattaaattcaccacactgtcttccacagtggttgaactagtttacattcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcatttcttcatgtgtttgttggctgcataaatgtcttcttttgagaagtgtctgttcatatccttcacccactttttgatggggttgtttttttcttgtaaatttgtttgagttctttgtagattctggatattagccctttgccagatgagtagattgcaaaaattttcttccattctgtaggttgcctttcactctgatggtagtttcttttgctgtgcagaagctctttagtttaattagatcccatttgtcaattttggcttttgttgccattggtttagtgttttagacatgaagtccttgcccatgcctatgtcctgtgaattgttttggctgcatgttgtaaataaactttatggaagaaagaacagaaagaggatagttaggaagttgttaacggtaatctgggccaaaaatgatgatgagaattagtcgatctgttggattttttaaaaaagtagagccaatagtatttgctgagggtttagatgtagagtgtgagataaaagagaggaaccaagggtgattccaaaattttgggcctgagcagctggaaagatgaaattgccatcaaccgacatgtagtagattgtgaagcaggtttggggcaaaggtgttttaacgatgaggagttcagtttggacatgttatacgtgagatagccactagatgtcaaagagaaaatgtcaagcagacagttggatatatatgttgctataggtactcttttttttaaaaaatttatattctttttctaagaagttttagagcaggaattctgcagtatacctccttatgtgtacactttctagtaaagtgccatattcttactggagtcctagagagaaagatctgggctgaaggtgtaaatttgggagttcttgggagttcttaaagccaagagactagatcagatcactaatgaagtgggtgtagataaaaaggagaataaaaggattgagctatagggtccccgaataataagaggtaggggagaaaaggaagataagcaaggaagagtacggtgaagtgtaagccaagtgcagaaagaatattaagtgggaaagtaatcaacggagccacattctgctgatgcctcaagtacaatcattactaaggattgatcattgaatttagcactgtgcagtcattggtgatcttgataggaacagtttctgtgtagtgatggggtgaaagtctcacaatattggatttaatagggaatgagagaagtagaagtggaaatgatgggtggaaccagctctttcaaggaaatgtgtttgaaaaggaaagcacaaagtgagcagaaactggcaagaaacttaggatcctttttagcttggatttttacagaagcagacaatgagacaggatttcagtgaaataattctatttgggaaagtgtaggtaacactgttaggggagttgatacaaggacgagaaggcagccatttaaaggtccaggctttaattgacacataatctctgaaattttctttaactattaaccctgtcagttgtcagttgatgtgtcccatggactatgtctccaaaacctacccattcttagtagagaacctatccatttttgctagagatggggtttcgccatgcctgtctcgcactcctgacctcaagagatctgcctgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtttcgccatgcctgtcttgaactcctgagctcgagtgatctgccttcttcgacctcccaaagtgctgggactacagacatgagccaccgtgcctggccaaggacgggaaattttttgtgagaacatcctagagtacaacttctaaaagtgatgtcgggttatcaagtgcttaggtgtgacagtgacaacaagacttatattcaaaattgttggaaaaatccagaaaatgtttaatgaagaaatcagcttgcagtaaaggttccacatgcttttgtttgtcacagagtggaagtggccttcataattgtataatgatgaaaagacttcttaatccacagctttatttactgcatttttcattttctggaagtagttttattttcctctaagctcctgtgtccttttgtttttaaatgaatatgacacatgctacaatttgaatatgtcccctccaaaattcatgttgaaacctaatccccattgcggtagtattaagaggtggggctttttggtgtgtgattaagtcaggatggctctgctgtcatgagtggattagtgccttacaaaaagtgctggagggagctagctgggtcctttttgccttccatccttccaccatgtgaggacacagcattcttcccctctggaggacatagcaaacaaggcaccatctggaagcagagcgtagctctcagcagacaccaaagctgccagcaccttgattttgaaattcctagtttccagaactgttagaaataaatttccattgtttattaattacatatatgctgttttttataggtactctttttttttctaaaaaaatttatattctttttctaagaagttttagaggaggaattctgcaacatatctcctgtgtgtatactttctagtaaaggggcatatattaaatgcttgataaatatttgtggatgaataaatacgattttcatcacactttccttaaaagtgtgaatctgtttcttgactttgtttttagtatattaaccaaattatttaaattgtgtactatacgtaattattattctccttctagtggtgactcataacatgctgtgcttgatgtcctctatttgtctctccacatctaccttttatttttttccatcctgtttccatgccctctggcttccaggtaggctgagccagtggtggtagatctgatggtgggagatgagtggggttgtggtattttattccaccaactttctccctgctggataaccttgggttagttgtgttgctttattgaaggctgaactgtcaggtgtcctcatatagctattttctaggaattctggaaacactccctcctcttgcttttttaaggccaaggggtggtaaagtcttcctgttgtggtaggtctcaggatattgccctggtcatacctttataaatagcctttattagatactttataattgttttgatcatattatttatttcctgtcagcaccctggctgatatagtagctactattggctttttagagattcaaatataacttttgaccaaaatgatccttcatatgttcttattctggaagttgagaggaagaagtgtcttgtgggaggatttcacactttattagtggataaaaatgttggcagaagtataaacatttcagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaaatttctttttgaattatgctaactcagactcaacttttttttggttattatgctatcaacgtagaagtaatcattgtcttactagcaaaatacctccaaagtgtatttgatgggaggatatttatttttttaaaagcccatttgctgtattcctttaagttttctctttaaaatcatgttaatttaaaaaaattgttgatttttttcaacttctccattattctgaaatccagaaattcttattgtatatttgtttttaaaaatagctttatcacatatacatgtgcatgtcatctggtttgcttatttttgacctttataaaaaggttgtatttatgccattttctcaggctttctttgattttgtttatcacgattattaccaagattcatccatgtcattatatattgctgcagttaacttctttatatttctgtattttatttgttgtataactctaccacaatttatttacctatttccctgcttttgagcttttggatttggtatctagtaaaatttacccacagtagccattttgagacatatcctgataaactattgcattttaagagataaagaaaaaaatccttaggattttccagcagaaagatgaaatatcttacaagggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttacaaaaacaattggtggagttaatgggctgtaattttccaatccctgtcctggagaatgagcttcacctaatgaacagataaatgggaacacttcaggtaaaagattgatggaaaacatttcccatacttaattttagagctaagactaaaataaaggtaggaatatgtgtagacaactaaatgtgcaaatgttacatgttttgtccaagtagaaataatgcagttaaaaatgggagaagggagaggaaaggggaaatcagagataagaacattgacagctgcatatgtaatagataggaatcaaaagatgccatttaacacttgatattccatcaaggtctattggacccaattttaatttttagtttgttttctgagcaggcctaactatttgcgaagactattattttatacattttattctttcttagaagtctttcaaagaacaaagagaacatttacttgttaaaaaaaatcagaataaaatattctgtctgtgattaccagatgggtctgttgcattcttttaaaaatgaaagatacactgtggaatttaaatgttgttattttctgtgttctaaagcattttgctatttatcattttaggaactaattcattacttatcaattatttccaactatgctaaaaattaacaataaaacagaagttttttagaaagatgatgccacagtgaaaaaaactgtcatcctttagttgtattattgcggtgcccgaagtattttattacctttaaagaaggcatacaagaagacaaagtaccatcattgtagtccgcttttagtttttgttgaacacagttgagaatttaaaatttttcattttctgcccatactagtaaaaagttgaaagatctttcgcagtaattagacaaataagaagatgaatgcaaagagacagataagaatgcaaagagacagatggtaaccctgtaaactctggtgagtttacactaaatctcagactatggatcttcaggaaatgatatcctaaatgaattttttcaaactcttagattcagtgagtgaacaatacatttttattttttattatgtttatatgccccaacactttaaaacaaagaggtttgctatatttaaattctttttggaatttgcaaaaggtagtttttgactgacacttttttcttgtgtaaattacttatgatgtgataaagcaactaaaaggaactattgaatcatgataaatgctgattactattgttctaggtatactgaggattaaaactgacagaacagataataaaattaggtaagaaagatgagaattaagggcactatgaaagatacatacacaaaggaaaacactaacaaagatataaacgttcttacctaccaaaagaaataaaagcaaagaaatatcaaataggaaaaaactcagaaatatgcattataatacatacacacagtaattatgacataaaattctgtgacagagttgagattcaccataatatcagtacatgggaatgggattaacttgtttattaaaagaaaacatttcaacttgctgcataaaacaaaacccaaatctatgcttgatttaggagacatttacaacatattgatgcagaaacgatgaaaataaaggaacagagaaagatttcataggtgaatgattacagtaagacagggaatatcaaaacattatacaagaataccttataattactaaaacccacaattcaccacaatgatatgatatatattagaagaatattatctatacaccagacaacccagcaaccacctatagaaaacagaaaccacaggcagtgaagagaaacagtgtcacttcagtacaaaacaggtcagtcattattgtcaatacacgataggataaaaaataagaaaatatctaaaaaaatctaaacaacataactaataaagttgaagttaaggatgtatagcgaacaatacagcccgattatagagaatgttgtcttctcaaatgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaagggagaaataatattgataggatattaaaatagtagactatcttgtacaacaatgcaattaaatttgaaaatgttgaagaaatgaattatttcatagaaagtagcaatttttcaaattgaacccagtaaatataaaaaatttgtataaagcactttccttagaaaaagtggagaaagcaccaggcctagatgataccagagagtaaatttagcaaaatcttaatagctggatagtctcaatgctatgtaggttgttttagagaatgataaaggaaggaaacttccaaatttgttttataagggaagtataacattgccacttaaacccactacacagaaatggaaaatttacatatgtatatgattaaaaatgaaataaaacctttccccgttaaatatcaacacaaaattctaaataaaatgaacactccaacacattcttttcttaatgtgtgttgagttttattaatatattttataataagcatccttggatgcctgggtatacatcccatttaataataaaatacacattaatagataattaagtataattaagtgggatatatagccaagcatctaaggatgactattatgaaatatattaataaaactcactatattagtaggtcaaaggagaaaaatgatattattttcattggtattaaaaaaatcacatttctaataacgcttgagaaaatgggaatggatggctactgtatgaacataataaatatgtttcaatcccaaagccagcatcttatacttaataagggaaataagcatttctattcacttcaagaacaaaacaagcgtgcacactatctccagtgcaagattatatatatatatacacacacataaacacacacacaactatgtatataactatatatacacaactatgtataactatatatatatatacacacaactatataactatgaagtagtaatatatatacatgtactactttttgtgtaagggaagtaaaatatagttacacatgctaatttgagcaaaaatgaacacaggaaagataaaccagaaaacaagtatgttggttatttacaaggggtggtagagaatggtatggtaaagatatgacatgaaagtatatttacctgtgtttactcttttaaaaaaatagtcttgacttagaaacattgatttttagaatcatattaatcatttacatattgaacaattaaataaaaaaggaaaggaagaaaaaaatcataaaacaatgtaagctgaaacaaatgaacccaactatgtttcaaatgaataggataatcattctgaaacgggatgaaaagaactaatgcaagtgatttttgaacacagtatttgactatgtgctctcagtcgaggtttagatgcgaagaaggactgcaaacaaatctttgaggtttgttttttgaaggtttaggtgaagcaattctgaaattattttagatatatgtttagactaaaaaataagtaaatatatttttttgggaaccaaagttcttcatgtggaagacgagaactgcagctatgaaatggggaagtcaaggaagaatcctggcctggatggattgcaattggaggtatcagtatgagtttatggttacttagataaatagatacatggatatgtagatacataaataaataagttaatacatagatgtagattcttctgaaagggcccagaagctaagacaccccagtagtagtgagcacactgagcactcgtattcccagatctggtttgtaatatttcctatggaaagaaagcagggctccttggaggagctgattctatgactgtgacaaggaaagtaaagataagccaagtacatcttgttatatcaaattaaggaagcactcaagaaaacgatgggtcatgtcaaaagaacacaggaatcaccttctaggggatcccattggtaaaacatgggacaatttgagcattaaaataatttaagaaagaaatacattaaaaactattgaaaaaataggaatgcataagcttacactgagagtagacagacaggtacaaatacagaagaagggaagcctctacataggatgcagactgtcatagctggagttgaaaaatcattttgcaaaagtcatagtaaaagttgggatgggaaagaatcatcaatggatgttaaatctgtgggggtgggtatgaaatttttttatgagatatgcacggcatttaagtctcccctacagattgctgataaggtgcgggagaaaaatcgtaactacatagtagagaaacctgtcaataacttgtctgagtgatcaaaattaacatcacaaactaaggggaattggacactgtgtgcctttgtatataatacctacagaaagagacattacgtgtggtagagttctgcaaaccagttctgtaaaagttgaaatagtaaatattttgggctttgtggactatacagtctctgtctcatctattcagttttgccaattctgccattatagggtgaaagcaagccatagataagtaactgagtgaacagaatgaagagacattttatggaaagggggaaaatattcacaaattatacatctgataagagattaatatccaaaatgtataaacaacaacttaaaacaacccgattaaaaaatgggcaaaggatctaagtagacatttctcaaagaagacatacaaatgataagaaacactggcgaggatgtggagaaaagggagccctcatacattattggtgggaatgtaaattagtacaaccatgatggagaacagttcggaggttcctcaaaaaaactaaaaatagagttaccaaatgacccagcaatcacattgctagatacatacccaaaagaaagaagatcattatagcgaagagatatctacactcccatgtttgttgcagtactattcatcatagccaagatttggaagcaatctaagtgtccatcaacaggaatggataaagaaaaaatggtccatatatacaatggagtaccattcagccataaaaaagaatgcaaccctgtcatttgcaccattgatggaactggaaatcattaagtgaaataagccaggcacagaaagaaaactgcatgttctcacttatttgtgggagctaaaaataaaaacaaactcatggagatagaaaaatgatggttactagaggctgggaagggtcgttggtggggatgtgaggatgattaatgggtgcagaaagtatatatacaatgagtaaaatcctctatttgacagcacaacagtgactatagtgaacaacagtttattttacattttaaaataatacagtagaattggattatttgtgtcaaagaaatgaatagatgtttgatgtgattattatgcattgtgtgcttgtttcaaaatatctcatgtaacccataaatatatacatctatgtgaccacaaaaattaaaaataaaaaaatttataaagcaaaacataaaaatggccaacagatgtatgaaaacatgctcaatattactagtcatcagggaaatgcaaattaaaactacaatgatctatgatctctcccctcacacctgttagaatggctgtaaaaaagacaaaagataacaagtattggtgaggatgtggaaaagagggagtacttgtacactgtttctgggaatatttttttttttttttaacaaaaatgagcagcagagtaggtatgaccccacaggacatagcttacccacccctaccttacagtattgtgactagaaatgcctaacctgaagctaatcatgaagcaatatcagacaaacttcaaataaagaatatgccatctaaaaagagggatggatagctttattcttcaaaaatatccatgttatgggagacagagaaaggttgaaaaattgttccagattaaaggaagcttacaagacatgacagctggttgttgaccactggtgcacaacatggtgacaacaaatgcatgagaactggtgatcccagactggattctatgctggatgaaaaattaaaaaatgctatgaaggacattatgtactcagttcacaaaatttaaatgtatagatacattaaagtattgtacaaatgttaaatttcttaaagttgataattgcaatatggttatgtataatagaaagagggtgcttggttttttttttttttttttttcttttttctttttttttttgagatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtgaattttaagtgtaaattggacattgatttttagcacactggtgtctgaaaatagatccataaaacagatgtattaagtggtgggaattagggatttttaataggagaaatctccagtttagaaacaattcaatcataggaatcacagaaagcaaaattttattatgtgttgcaattaggcttggcatttgtggtagagtttcatttgtgcagacctttttaggaataattaagtaaaatgaaacagtatcaatataatgagtaaaatacagttatgccatgcacaatatttcaattaatcacagactgaatatatgatggaggtctcataagattattctggaactgaaaaattcctatccctggagatgatgtagctgtcaaaatgtcatagtgcaatgcattgctcatgtgtttgtggtgatgctggtgtaaacaaacctacttcactgccagtcgtacagaagtatggcacatacaattatatatagtacataatatttgatgctgataataaacaactatgttagtgatttatgtgtttactatactttttattattttagaatatactttttctacttacaagaaaaaaaaactgtaaaatagccttaggcaggaggtattccagaagaaggcattattatcataggagatgagagctccatgcatatgaatgcccctgaagaccttccagtgggacaagatgtggaggtggaagacagtgatactgatgatcctgactttgtgtaggcctaggctaatgtgtgtgtttgtgtttttgtttttagcaaaaaattttaaaaaataaaaagtgaaaaaataggaaaaagcttatataataaggatttaaggaaaaaatttttatagctgtaaaatatgtttgtgttttaggctgttattacagaaggatcaaaaagttaaaaaattaaaaagtttataagtaaaaatttatagtgggctaaggttaatttattattgaaggaagaaaaatattttaaaaaatttagtgttgactaagtatacagtgcttataaattctacagtagtatacagtaatgtcctaggccttcacattcactcaccacttacccactgactcatccagagcaacttccagtcctgcaagcttcattcatggtaagtgtcctatacaggtataccattttttattttttacaccacacttttaccataccttttctatatgtttagatacacaaataccgttgtgttctaattacctacagtattcagtacaacaacatgctgtacgggtttttcgttcaggagcaataggctgtgtcacacagcctaggtatgtagtaggctataccatttaggtttgtagaagtatactctatgatgttcacacagtgatgaaattgcctaacagtgcatttctcagaatgtatcctcattgttaaggaacacacgactttatcattttagcaaactgctttgccattgtgacaaatgctactgttaaaattgtatacgttttttttacttactaaatgtttttagttttgctaagtgaattattaaaccatatgcttttaagctatttaggaactacaaaaatattatacatatccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaagctcggaagaagataagatacgaaaaaacaacatccgttagaaacatacatataggataatggagtgttttagacacaaactttaaaataattattgttatgttcaaggaattaaaatttaaggtagagaatattaggacaggcctggatactcatacttatgaatcaaatggaaattctagaactgaaaaatacattgagtaaattaagaattccttggatggaaataacagcagattagacacagctgaagggggaaatatgaaatggaagagagatcagaaggaaacatccagaaggaagtaaagaaagacaaaatgatgaccaaaaaaggacagaaagaaatacaaggaagatgtggaaattgtctaacccacatgtgtaattggaatcctaaaaagagaagagtgaagacaaatgtgtaacattattttaagtgataatgaataagaaattttcaaaagtgacaaagacatcaagccacagattaaagaagttctgtgagcaccaaggggcataagtacaaagaaactcagaaatattatagtaaaactgctgaaaaccaaaacatgaagacaaaaatttcaaagcagatagaggaaaaagggcatatttcctttaaaggaaaagcatgaagacaattaattttttaactgaggaaatgggatccagaatacatgttttcaaatagcttaaagacaataatcatccatctaaaattctacataattaaatattcttaaaaatgtaagcaaaataagagcatttttagaaaaacaatgactgagataacttgacagtagtaggctttcgataaaggaaatactaattacaataagtgctattgaagtagaagaaaaatgatcccagatactggatggaatgtaatgaaattatagagatgattctaaatgactatcatataaagctatagtaataatagtggcttgcatatacacaaaatttaaatgcatggtcctaatagcacataagtcagaaaaggggtaaattagtgttaaaaagtctgaaagttggtcgggcatggtggcttatgcctgtaatcctagcactttggagagctgaggtgggcagatcacttgaagccaggggttcaataccagcctggccaacatgctgaaaccccatctccactaaaaatacaaaaaattagccaggcatggtggcatgtgcttgtagtcccagctacttgggaggctgaggcacgagaatcacttgtacccgggaggcagaggttgcaatgagctgagatcgcatcgctggactccagcctggacgacagagactctgtctcaaaagacaaaaagaaattccagttatactaaatgtgacagattaaatattccagttaaaagccaagaatttttggattggatataaaaacaaaacttagccatctgctgcttagaaaagataaaccttaaataaaaatatttagaaaagttgaaagtaaaaggaaggcataacagttcttaatttatatataatttataacagtgttgaaataatgtaaaattgaccaaacacaagagacaaaacatagtgagatgtttttaacccaattttcttggtaactggtagtaccaggagaccaaaaaaccggcaagaacataaaacatttgaataggacaatgaacaattttgtctcacttgatatttgagagcataataccttataattgaagcatatacatggtttccaagaacaaaggaactttcccggaatttactatattctgggttttaatgcaagtcttaacaaatttaaaaggattaaaataatacaaattaattgaccacagtgaaataaaaagtaactttttggtgattacataaaaataataagaaaaaccctaatatatatgtgtatatatatttatatataacatatgtgtatttaatatatgtgtgtgtgtgtgtgtgtgtgtgtgtgtgtatatatatatatatatatatatatattttttttttttttttttttttctttgagacagactctcactccgtcacccagcctggagtgcagtgacacaatctcagctcactgcaacctctgcctctcaggttcaagcaattttcctgcctcagcctcctgagtagctgggactacaggcatgtgccaccacgcctggcaatttttttgtatttttagtacagatggggtttcaccctgttagccagggtggtctcaatctcttgacctcgtgatctgcccaccttggcctcccaaagtgctgggattacaggtgtgagccaccgcgcctggccaaaaaaccctagtataattttcatactgaaaattttcatacttaaaattactgaatgatgacacatcaaaatgcatgtgattcagctaaggaggggcacttatagatctaaatgcatttattagaaatgattttctaaaagtctgaaaatcagtagtctaagaatccccttgagaagttagaaaaagaacagcagactgatcccaagaaaggataaagaaaataaagatataataaaggaaaggaacatgagataagagcatgaattaatgaaataggaaacatgtgatagaaatgatccataaagccaccaaaactcgacaaagttggttgtttttaatagtaatagataaatccccacacagacttagaaacaaagattacttaaataatccatgccaagaatgaaaagggatatcatgacagatcacatagagattaaaagttagtaagaacatatgataagcgactctatgaccgtaaatttgaaaaagtagatgaattatgacaaatttctagaaaaacaaaacttaccagaattgacacatacatgaacattgaaataatcttatgtcaaataactagaatttttaattgaaaccttgttgcctcaaaatacagaagcatacatacagatgaacaaataaaaacaaaacaaaacaaattctccaggccgtgatcactttactggtgaattttcccaaatatttaagaaataagcatttaagaaataaataacatcaatctttcacaaactttctggaaacagaaataattatgttgagatttatgaggccagcataaccttgatataaaaatatgaaaaggatgttacaggtaaggaaaattttagtattgtcttttccatggacgattccagcaatttagaaagaaaataatagattatttgggttcattcaaagaatataatgttacttaaaatttataaaatttgaataattaagaaaatagagaagtaatggtctataatcttgaaagatgcagaaaaaattatagataaaatttatcatgtatttatgataaaacctctggtgaactaggaatggaagcaaatcatttatgtggtaaaatgtacaaggacacatgaaaactttactgcaagcattatggtgaaatagagaaagctttccctctaagattgggaatgggataagggtgctcgctgtcaccacttttattcaacattgtattggaatttccagccagtgtaataaggcagattaatataatataatataatataatataatataatataatataatataatatgtatatgggtaatcagttgctgcaaataacatcaatataaaaaattaatccagagtaattctgtataccaggaacagtttaaaactgataatttaaaaataatataatttatgtcactgtcagaacattaataacctaaggaataaatctaatgacttatgtgcaggatctttacacagaaaactataaaaccttattgtgagaaattaaataaaatttaaatatatctcagaccaaattatgacaattgtttgaaaaactcaatattatgcagatgtctattctgcccaaattgatctgtagatttaatgtgatcccaaacaaaattttagcaggtgtttttcttttggaaattgacatggtgattctaaaatttatacaaaaatgtgaagggtaatttttgtataaattttagagtctccgtgtcaatttccaaaagaaaaactttagaagaacaaagctggaggacttttctatccaaattttagaagaacaaagctggaggagttctctatcagatctcatcacttatgattttacaataattaagtgttgttgcaaagacagggaaatagactaatgcagcaaatagaattccacagacagacctatatatttatgggcacttaatctatgacaaaggtggaactacagagcagtctttcttaataaattgttctgggccaattgggtgtacaattggaaaaaatgaatattaagccctacctcacatcatcataaacaaagatctgtttcagatcaatgttagatctaaatgtggaagtacaataatattctagaagataacagaggcaaatatcttcatatttatgagtaaagaaagatttcttaaatggaatttgagtagttttattagtaaaagaaaaatgatagactgaactatatttatatgtctaaaaagtcagtaagaacacaaacatgccatgctcatggatcagaagaatcaatattgtaaaaatggctatactggccaaagcaatttacagaatcagtgctattcctatcagactaccaatgtcattcttcccagaattagaaaaaaaaaactatcctaaaattaatatataaccaaaaaagagcccgaataaccaaagcaatcctgaacaaaaagaacaaagctggaggtatcacactacctgacttcaaactgtactataaagctacagtaaccaaaacagcatgatacaggtagaaaaatggacatgtaaaccaattgaactaaatagaaaacttgaacataacgccacacacttacaatcatctgatctttgacaaggctgacaaaagcaagcaatgaggaaaggactccctattcaataaatgatgctggataactggctagccatatgccaaagattgaagctggacccctacctttcaacatatacaaaatcaactcaaaatggatcaaagattgaaatgtaaaacctcaaacaatacaaatcctaacagacaaccaaggaaataactcttcttgacattggccttgataatttttggctaagtccccaaaagtaattgcaacaaaaacaaaaattgacaagtaggacctaatcaaactacagagctcttcacagcaaaagaaaccattagcagagcaaacagacagcctacaaaatgggagaagatattctcaaactgtgcatctgacagaggcctaatatccggaatctgtagagaacttaagtccacaggcaaaagacaaataaccccattaaaaaatgggcaaaggacatgaacagacacttctcaaaagaagatatacaagtgcccaacaaacatgcaaaaatggtcaacatcactaatcattagagaaatgcaaatgaggtatcacaccagtcagaatggctatttttaaaaagtaaaacaacaacaacaacaacacagcagattcttatgagactgcagagaaaagtgaatgcttagacattgttgatgggaatgaatgtaaattatttcagccactgtggaaaatagtttggagatttcttaaagaactgagctaccatttgacccagcaatcccattactgggtatatgcacaaagggaaataaataaatcattctaccaaagagacataggcacttgtttgttcattgctgtgctattcacagtagcaaagacatggaatcaatccaggtgcccatcaatggtagattagattaagaaaatgtggtacatacataccacggaatgttatgcagtcataaagaagagtgaaatcttgtcttttgcagcaacatggatgcagttggaggccataatcctaagagaaattaatgcaggaacagaaaataaaataaatcagacataaaagaaaacagtatattcttctattgatataaagttcagcaccaggaaaaacagaattatgggcttagaagttatgatagggattgcctatgattgtgtagtatttgaatgagtagcagcaaagcttctggagtggttatgtgttcactttgtgataattcattgaactatacacttaagatttttatacttttggcatatatattatacttcataaaaatttataaaaaaatagaaatctgagttcaatttgacttcttatatgctaaaagattatgataatttgacataccaaaagagggtcaattttttatgtaaagttagcaaattacgtttttattatcagtgttagaaaagaatggagacataaaatttcagtcatttctgctatcccactccttcaggagtagttgcatctggtttcgttacatttaataagtaagagagaataaacatcttgaacttataggagttcctgttgctcaaaaatgattccttttatgtttttggtatattttgctgattcatattatctttgctcaggcactttaactttggtgtaatgattttgaatattggggtcattgtgatcttcattttatagccttgttaaatgaggcatctcataactttctttgcatatgtttgtacaacttataatgggagcttatgtcttcattatttttctatgtgaagacttttctctgatagtggagacctcagattttcttggcctattgtttaggtcttttcttcaattgttgtattcctttagcctgtgaaaaagcacagtaagttttaacacataaggaatttattaaactttaccatttataactttcagctgtaattatcaactttttatttttatttttatttttttccagtgagggaaaaaagacttcaattatatttctttctttcttttttttttttttttgagatgaagtttcgctcttgtttcccaggctagagtgcagtggcacaatctcggctcactgcaacctctgcctcccaggttcaagtgattctcttgccttggcctcctgagtagctgggattacaggcacctgacaccacgccaggctatgtttttgtatttttagtatagatggggtttcaccatgttggccaggctggtctcgaactcctggcctcaagtgatccacccacctcgacctcctgtagtgctgagattacaggcatgagccaccatgcttgcccaacttcaattatatttctacagatattaaaaagataggtagtgaatctaatggtaatgcttctgtggtacaaattaattctgtacttttaaaatgtctttctaatcacatatacttaaaaaatgttttcataggccacacctggttacatgaaatgatttaatctagcttcaatttgatataatagaagttgtttttacattaaaatattaaaaactatgttatgaaattatttttttttgtgatttctctaaaaaatttcctgtccgaggttttggaaagcgatagaggttaattttataaattatgttattatttaaaacccatttcagtaaatactgatgaacatcagcatttttctttctctgcttactgagtgtctgaaatcttttcaatgaaaattttgttggctctttatcaagtcctgttttggaaataatcctaagtagttctcagtaagggagattgagaatttaaaatttaattttatatatttatgagggaaataatagaaatatatacgcacacaagcacacaaacatatagttgcgaagtaagatatcagagatttattaaaatgaaaataaaatgtttatacaggcaaaaagactattatctttaaaaacatcatgataagagatttggaattttggaatgtctggttaaaatcccatattgataatttaaataagtacttatctctgtagctttgcttttcacagtgattaaaaaatttgtagtacttattttttactagttctcttttataaattgggaaatatcacatatggacaaaagactgtatgatagtatgtatatatagtttcaaaaccataataaaatgaattccctgcctacctgtgctaagaaagaggacattacaataccctagaagcccccatgtgtccctttatgattgtatcccttatattatccccctccattattcttaatattgtgttatttccttgcttttcattgcatgtttttaccctccatatatgtatttgccagcaaacctttcatttagtttttctgtttttaaattttgcataaattgtttatcattgtatgctttcttcagagatctttaaaaagtcagctttatgctctggagatatattttaatggagagaggcagacaataaatatggaaataagtaaaatgtattttaaatgataataagtgctatgaagagaaaagaaagcatggaaggaagatagagagtttcagattgttgcatttaaaaagagtggccagagaagacctcataagacatcttaataaaacctaaaggcgattaaggagcgagccatgcaaatatctgggggacaggtgttctaggaggaggtccagctagtgcaaaagccttgagatgggaacatccttgtcatctggaacagcaaaggggctagtgtagtcgaatgtcttggagtaagatggaaattatcttcccttagagaaataactggaaacccagtcatgtagggccttagaaaacattatagagcttttactttggtatgggtagactttgagggttttgaacagatatgtgacttatctgacatatgtgacatgctctgacttagatttttacaggagcggtgttgtaattacgatgcaagagcagaagcaggaagaccatttaggaggctattttaatgatctaagagggagatgatggtatctggaaccatagaggccaatgtgaaggtagtgagaattggttggattccgaatatattttcaaggtagaaccaacaagaattgaaaaaactaggggactggatatagagtggatgagagagagagagagagagagagagagagagagagagagagagagagagagagagaaatagtgaaagatgaagcaggcatttggcttgaagacctgaaagcatggagttggcattagttgggatgatgaattttgtgggagaagtaggtttggtgtcaggaagaatggaaacttggttttagacacgtttaatttgaggtacatactatacagcttgtggatatgttaaataggtggctggatgtaggaatttcaggatctggacactctaattttctggtcaaagagatgaggagaaacaaccagaaaaggagactgagaatgagcagttaatgagttaggaggaaaactgggagaatatggtattctagaagccaagagcatatttcaaaggaaagagaatttgtcagaagctgctgattggtaaactaatatgaggattgagtaatggtcatggaatctggcaaaccagtgctttttgctgaacttgacaagagaagtttcagtgggtggtgaagtcttgattggcatgtgtcaaataaagatgagagaagaggaattaaagaaaagtactaacaacttttttgaggagttataaggaaaggaaagaaacagggtaacaagtggtaagggatgtgggacaagatatatatatttttaagtttggagaaataattatgtttgtaggttgacaggaaagatcaagaagatgtaagaaatgatgccaaaaataaagggaataatttgctagagggatgtactcaagaaaacaagtagcaatgggatctagtgaacaaatagagtggtaaaccttacctaggaagagcatgggcactttattcataagaacagatatgaagtcaggttatttgaatacaaatacaggtaaataagtagaggtggagagaactcttgaaaattttgtttctttttattttctcagtgaagtaggaagtagagtcatcacttgagggtgagaatgagggatagtggaagattgaggtttgaaaagagaagtatgaaatcatttaggagggagggagagtgaatgagttagggaagtgtagtaggatccttggcagaattttcccatgtgagagacccttaatgtgcgaacgcagagtctttttatattttctgccttactgtggatgcatactggaattgtccttagtttttactattatgagcaattgtagcaaaaatattcttatttagtcttctattgtttcacgacagtttgtctaagctatttacttaatagtataaatgcttgttcatgctctattttacccaactatactccagcctcatcttactaatttgcacttctaccaggggtgaatgacagttcccatttcttctcaacaatctcattaaggtttgatgttttttcatttttgaatattttttgccaatatggtgagtataaaatggtgtcctattttggttttaatttgcgtttccttaattgctaatgaggtataacatcttttcatatttattggccaaacagctactctgaaattttcacccatattgtcatatgtagttgtttgtgtacccttttttgataataattttttgttagttttatattttgccaacattttatctctcagattgtggatcatctttttactctttgtgtaatatttgataagcaaaacttattaattttaatatagcagaagttgtcagtattttatggattttgctttgtgtcttgcttaaataatacttacttaccttagtgttttcaatattgccttccacacatttagtctttaacccaactggataaggacttttgtgtgtgtgtgtgtgtgtatgtgtgtgtgcacaaccagaactataaatagtgctcccagaactatttattgaaaagtccattccattagtggtctgcaatactaacagtttttttggttagaattacttccaggtgattgatattttatatgcttttctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgcacatgttttttttgagatattcatgtcagctctttggtggtgttacttcgggcttttaaaatgagttggggagtattctttttaatactctagaacatttatcacatgtatatatgtatatattattggaattatttttcctattttaaaataataaactttgggccaactaggtctgatgttttcttcagggtgtagagttttaactactgaattcaatataatagttgtaagaacattcagatgttctatttgttgttgagtctgttttggtaagatatatttaaaggaatttatccatgaaactgatatcttcagttaaattgttataaagatgttaatatattctctcaggatcttttagtatctgcaatatctgtagttgtgttcccttttaattatttttaatactgcatttatttatatctccctatatatctatgtattgtttttgaatggagttgcttacatgatgccctcttaagcataaatattttaaaatatatttactaaaaagcaaagatactctcttacataaggatcaaatttagaaaataacatggatagaatattataatctaacacatttaattttttcaattgtaccaatattttttacaaattataacattaaaattgctagattcgatttttttctttttcttttttttttttttttgagacagggtctcactctgttgcccatgcttgagagcagtggtacgatctcggctcactgcaacctccacttcccaggttcaagcgatcctctcactttagactcccgagtcactgggaccccagatgggtgccagcagggccgactaatttttgtatttattagggactgggttttgctatgttgccctggctggtctcgaactcctgaggtcaagccatccgcccgccttggcctcccaaagtgctgggattactggtatgagccggatttgatttcttaataagttttcatgaatgttcacatatgtgattggcctgtggttttccctttttatactctccttctcagattttgatacttttttccttactgagtttgggtatcttttcctgatccaggattacatccaggagcatgcaaacatttagttgtcatgtctttttagtctcctttaatttggaatagtcatgatctttcatttgaagtctgtgcctcgtttgggtttatctgatgtttctgcatgattagattcacattttgtatttttgttaggaataccaaaatgtcatattcttctcccatggctggtgaagttaaatttttgtgaaaaaaccttttttattgagataaaagtcataacataaacttcttaattttgatcatttaaaacagtacaatttagtggttttcagtatattcataatattgtgcaactattaccactagttccagaatatttccatcagccccaaaagaaaccccatacctgtctattctctctatctccatcttctggcaaccactaatttaatttctctctctctatggatttgtctaatctggatattttgtatgtatggaattgtacaaacatggcctcctgtgtgtggcttctttcacttattgtgattttttttttccagagttcgtctgtattataccatatatcagtgcttcattgtttttgttatgactgaataatattccattatctcaatataccatattttaaaaatctatttgtcaattaatagacatttgggttgttttcacttttgactattaagaatgaggctgctgtgaacatttctggaaaggttaacttttatatcttggtaaaagtggtatattttagttttctcaatggtaaatatactgtttttcctttttaaattactaagtgccttattgggagatactttcagattatgtaaatattttatttcttattaaacctttacataatagttttaatacccattgatgattctcactagaaagagttattagtatgatggttactaagtggttatatttcattattccttcttagtctccccagtctatatattcatttatatcagtatgaattcatgtatttttattttatttaatgttttgtaatcaattgctattctttattctggtgcttatattgtcacagatttgcctagtgagctcctttcaatcaggtgtctgtattctttagatatgtccccatcattctttgtgcactcctttaccttctgcacaaacatttgtccctgccctagtgctcgaataaatcattaccctcaaggaacctaggttccttttagtggagaatgttctttaaaaactaagattagagaactacgcatatatccatttatatcctctatatccatttatagatctgggcatgtatctgtagctctacatatctatctgtgcttaaatgctgtctgtctaaattgcataatgatgccatacagcattacagggatcatttttgccttcccctctttcacatttgtaaatctcttctgccagtgagaaacttggtttccattttatgcttcatacattacaaaatatttttgtatgtgaagtatgaggaacaagatttactttttccatttaatataccatatctggtaaatcagatgtaattttaatccccacattttttgtttgtttgttttgtttttttaacaataaactctatgttttagagcagttttagttttatggagaaatgagcagaaagtacagaatgtttccaaatactctcatctcccctatccccaggtcctctattatgtgtcttacgtgaatatggtacatttgttacagtcagtgggtcaatgttgatacattactcattaactaagtccatagtttatattaggttcacttttgtgctgtatattctatggattttcacaaatgtatagtgacatgtatctacaatgatcatttcatacagaatattttaattttcctaaaaataacctgtgatcctcttgcttatctcttcctccctccaaactcttggcaaccactgatatttttactgtctccatacttttgccttttctagaatgtcataaagctggaatcatgtagtatgtagccttttaattttggcttctttcacttagcaataagcatttaaagttcctttatgtctcttcatgacataatagcccatgtcttttattgctgaattatgttgcattgtatggaaaccatcttttgtttatccagttacctattgaagaacatcttggttgcctccaaattttgacaattatgaataaagctgctataaacatctgtgtgcagatttttgtgtggacatattttcaactcattcaggtgaccaccatggagtgcaattcctggatggtatggtaaagttatgtttagttttgtgagaaactgccaaagtggctggctgtatcatttttcattcccagcagcgatgaatgagagttcctgttgctctagatcgttgccatcttttgtcagcattttagattttagctattctaatatgtgtgtagtggtatttcactgttattttaatctgcatttccctgtgacatgtaatgtgggatatcttttaacatgcttacttgacatctatatgtcttctttggaaaggtgtctgttcagatcttttgccttttttaaaattgagcttgttttttattgagttttaagggatccttgtataatttggataccagtcctttattagctatgtgttacaaatatgttctcccagactgtggcttgttgtttcattctcataacaatgtctttcactgaggagaggtttttaattttaatagagtccaaattatgacttttttctttcatcatttatgcttttgttgctgtatctaaaatgtcatcaccaaacccaggttacctagattttctcctgcgttatcttctgggagttttatattaaataattttgcattttacatttagctctgcgatctattctgagttaatttttgtaaaagatgtaaggtctgtatctagatgattatttctgttattactactgtgatgccctgttgttccagcaatatttgtccaatagacagtcctttcattgttgaatcgttttttctattttgtcaaagatcagttgaccatatttgtatgtgtctatttctgagctctctattctgtttccttgatttatttgtctattcttttgccagtcccagggactgacttgattattgtagctttatagtaagtcccaaagccaggtgatgtcaatctttgactttgttcttcttcttcaatattgtgctggctattttaggtcttttgcctttacatataaattttagaatcagtttgataaaaatttggtaaatttattactaaaaatcttgctggaattttgatttgtattacactgaatctgcatatcaagctgggaagaactggcatattgccagtattagttttcctatctgtgttcatgtactatctctttatttatttagatttttggtttcttttattgtttgtagttttcctcataccagtcttgtacatattttgttaggtttctacctaagtatttctcttcttttggttctaatgtaaatggtattgtgtttttgttcttgttcactgctggtatataaaaaatcaattgtatattacccttgtgtcctgcaaccttgctatgctagcttattagttctagagggtttttttggttgttgttgttgttgttgttgattctttgggatttacttcgtagacagtcatatcatttgtgaaaaaataccattttatttcttccttcccaatctgtatatcttttatttcattctcttgtcttattgcagtagcaagaacttccactaaaatgttgaatagaaatggtgagatgaaacatccttgccttattccttttcttggaaggaaaacattgtttctcaccattaaatatgatgtttttatagatgtttatcaagctgaggtattttccctctattcctagtttgctgagtttttatcatgactgaatgttggattttgtcaatgctttttctccatctattgatatgatcatatgattttctttgttagcttatcgacatgatggattgaatcaattgactttgaatgttgaaccagcctagcatacttggaataagttccaccttcttcttcattatatttaaattatcttagcttaaatattgctctactagagaatattttgttccttgatccatattatttatttactgtccactagattatagtattttcttgttttgtaaagaaaaattagagactagagattattttattttattttattttattttttgtgatggagtctcactctgttacctgggctagagtgcagtggtgcgatctcagctcgctggaacctctgcctcccgggttcaagcgattctcctgccttagcctcccgagtagctgggactacaggcgcaggctaccacgcccagctaattttttgtatttttagtagagatggggtttcaccatgttggcaagcctagtctggaactcctgacatcgtgattcgcccacttcggcctcccaaagtgctgggattacaggcatgagcaccgcgcccggccggggctgtattttttcttagcctgcctctcctcctggggaaaaacttctgtgctactgctttggagttgcaggtgggtgggcttagtggcctgttcctcttagagtgacaccactactttatgtacagagcactagatggggatagtagtctctggagtcttctcaacttggctctttctggatgcaacagtctgccttaggagtgaggtgggatgaaggctattgggtccaatgttgttagcctgctggaattagtgtatagctaccaccctatgagtggcaactgggcagaggaagagcacccagacctctcatgatctttcccagaacagagcttctgtaacccagagctggagggaatgagaagtgctggtatcctgccactcctagtgagatatcgctggcctggagtgggagttgagggatgaaggagccttatgttcttggctttacttgcctggggtagaatttctatcatgctgaattggttttgtgtgtgtgaggcaggcgtgagggggttggggtaagtaattatctattgccatagactattgctgttctttttgagtaaatgtttctttatttggtgttgctcttagcaaaattttcttaggttaatggttgctttttataatttttaccaattatagttcttttcctagtgggagtgtttgtggaactcctcatgttaccattctgtaagtgagcttcatacttttttcctttttttttttttttgagacagagtctcactctgttgcccaggctggagtgcagtggtgccatcttggctcactgcaacctccgcctcccgggttcaagcaattctcctgcctcagcctcccgagtagctgggactacgggcacgtgccaccatgcccgggtaattttttgtgtttttagtagagacagggttttgccctggatcaagccaggatggtcttgatctcctgatctcgtgatccacccgccttggcctctcaaagtgctggagttacaggcgtgagacaacaccacgcctggctgagcttcatattctttagaaattaattggtattataatccatggttttggagctgctacatatactatactaactatactttacgtattagctatgtttatgtatataataattctaacttctaattgtttgtatcagggctttagagtagttatttaatatttatttatattgtcatgcacctttactacatatccattcattcagatcagttataattgtgagcatatatttataatattttctctcagaattatactttaattaaaagaacatttatattaattttaatgtttcacaagatgcattgtaattgtaatttttgattacacaaaaaatatatatctcaaatatatatatatatcttgagcaaatgtacctattcatcaatgagtgcaatctatagactccacttaggtaaggtacaaaaacagcaaatgaatttatgctgttagaatagtggtaatattcttatagttttttatgtgagtgctgattacttagttgtgttcatgttgtgaaaaatcattgagttttaggcttctgatatatgcagttttatgcatgttatacttaaataaaatcttaaaagtttattatggagtccatatgagttacacagttttaaccaaatatagtttagactaaatttactatatttaactttttacttatttggtattttaaaatgatgttttgggcctctagttttaagatggcttgtttcctatctttgtaaatgaaaaaataatttataatataaattattatgagtattaaaaattctttttgatattgtgtctcctcaaagcattttaagatgctatgagcctcaaaatatttttttttgaaatattgaagtttagaggtcatttataaattgttaaaaaatatgtttttttcccccacaattccagggaaacctctatatgcaaagtagaccctttatataacatatataaaatcagggaggtcattttatcctttgtaatacatttttaaattttattctgtaggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacataggtatgtatctgttaggattgtacaaagtaggaaatatcagaaattttccatatagatattctcaaatacattaattgatagcatgtgtatatgtcattttagagttaagtgatagaatatgaatggaattctttctaatttcagcacagtagtattatagtaatagagccaggagaacagaagtactgagcagaagtagtggtagatacagggaatacaaaaagctagatttggatgtcctttttgaagactttttatgttgtttccctttgtgaacactatatcagtttattgtgtttgctacatattaattttgataatgggtagatatggaatactgttgaattatgtaaatttttatacatagtaggaatgtaaacattttagattttaagggataagcaaaaatatattaaacatttccgatatacttactatatataggaatctgatagaactagagaaaggaatagagatagtagagctaaagaaataagattttgagacgaaatggaaacccagatgtatctgggaaacaactatataagcatgttttcccaaagaactaaaaacagtttgcatttatacaattcacctaattttagttacgcaatataatcctatcaatttctgaatatttaagtgaatgtatttattgaaatactaaatttaggtatccagtagacccttgtagtgaaaacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacagatgagagtaacaggaacttgccaaagccatgcaggtagtaggcggtagatctaacttttgtaactcctaaaacttgtggtagtctttctatttgactacatcatgctgattagttgggcccagtgtatgttcttaattatggcaacaaattaccttattcttagtaatgcttgtttcttaatgctgtagaaatatagaagaaaatatgagttccattttttcaagcaagttgttcagactggaggaaggaatagcatattttaaacagttttacattttaacaaaggtttttttttatcccctgtgctaacactgacaacaaaaacataaagacagttccacaattcaacataggttaaaactgttcggctttatctcatttgattatttgtaggtagttctcaaaaatgttctctaaaataatctgtttgatcctcctgggtttggagtatgaaatgttggactatttttctgggaaaaggtatttttcatattattatttatacttcaacaaatgtctttcaaaataattgttttcctcatggagtatgtttttgtggaaatagatataagcattatatagtaaaccaattaggaaacagaaaaagtgtcatgttgctagtttttcttttcactgtggtacaccaggacatttttggtgcatttatggaaggcacttaaaagcttagctgattgttttgtgttatatgatatttaaacaggaatatttgtaccatttctaattttttattgttgcaaaatgtattatttgaacattactctcacagtaaattttatacagtcaatatcgctaatctttgggtatataaccttgccttcacagttcccattctattattgcatgatggatgtagaaggcatatgctggtgattttcaatcatgctcataccttggcatcctctttggaggttggttggaaaaaaaaaataacttacgtaatcagattctttgagattggatactgggcatctatgttttttaaaagtgactaaagtgcagctgataatacagctagggtggtgaataagataggttgagtataacacatagcatgacacatttcttaatttgactgtaacatatgacatgacacatttcttaatgttctagtttgtaaatctagtttgaggtcagatttgagaatccaaaaacttaatttttttttgttattgttagtgctgttattattactttcagaaagccactatggcaccttcttcaaggttaacaagaactttctggtaaagataaccttctatttagaattcacacagaattctgaaacaagatgcaaaacaacttattgactatgtttttttcttaatcaaaaagataatagaggataacagaaacatgaaaatgtaatttcctgagttaaattatttaagaatgggtagggaataggatttgtataagaactatatcttgcagaaagcagaacagctgaaatttcaaatgagatttaacgaataatcgagttttcaaaataaattccctgaacatagtggtttacttatgacattaatttctttgtagtgattatttaaaaactaaatcagtaaaaactaaaaagtaattttttatttgggaaagtaatattttaatggtagtatataataatgtatattcttaaccattttataatacagtgaaattgcagttctgtatactcttaaaagatcacttaactggccgggcacagtggctgactcctgtaatcccaccactttgggagcctgaggcaggctgatcacctgaggtcgagagtttgagaccagcctgaccaacatggagaaaccctgtctctactaaaaatacaaaaattagctgggtgtggtggtgcatgcctgtaatcctggctactcaggaggctgaggcaggagaatcgcttgtaccctggaggtggaggtttcagtgagccgagattgcgccattgcactccagcctgcgcaacaagaccgacactccgtctcaaaaaaaaaaaaaaaaaaaaaatcacttaactaattaatgaagcctgggatacctgattttgtccaactgtttggagtgatatatatgtatacatatataatagatatagtttggtaaggcatataatttcatagcaaaatcatattcaaattaagacatctaattatttaattttttggaatactcatgcaaagttatgaaaattccaatctgcttgcttttcatgtttataattatttttattttctggaggttattttattagttcctctctctgtttatccgtatttctctatgcacttcgttaaattcttagggctctttcttgatgaaagtggtaccacttacctggccatctgaaagaaacaatttctttgtagatcaggaaaatccttagaatcatcacacatttctttcaatgaatttagccaactgtcgactgttttaagcttcattgtatcctttgctcaaggtgttctctttctttttgttgggattatatacaagaaatagtagtttaatcttttttaaaaagaggccactaaataaaagaaaaaataaccttttattttgaggaaaggatgaactaacatttatctaatgttttcaacagtgcttggcatgtcacacatgatttataatataattattgttacatctgtgtagtgtacattagtatatttaatttatagaagaagacactgtgatttaccatggttaaacccaaactcacacaggctataagatgttgtattcagaatttaaagttaagtctacattcagagtccttttgatattaacactatacaccgtgatatttatttttcctggtttaacaggaaaaaaaaggaattttagttggaaagaacttgttagtgtagtgagacattcaaaaatagtttttatcaatagatttaatcatatttctgagaggtatttgaatttcactctacctgtccccctcccgaataagttgattggaaaatagtgacctcaagatagaaaatccaggagaaagaaaaggataatggataatgaatctctctcattcttaacaagtctgtatccattttgagagactgtattgaatacaaaaattactgaataaagattaatgaaaaaaatgctctgaaaaagcagcctctttaataaatagttctgggaaaagttgacattcatttgcagcagtatgaaactagaccctcccctctaaactaaaaatggatcaaaacaataaaacaacagaaaacaggaataatccttcaagacatgggtctggagaagactttctgcaaaaggccgcaacagcacaggcaacaaaagcaaaagtaaacaaatgggatcatataaaataaaaagcttttgcaaagaaaaggacaatcaacagaatgaaaagacaacctccagaaggggagaaaatatttgcaaactattcatctgatgggggattaacatccagaatatacaaagaactaaaaaattctcaatgataaaaaaaacctcaacaaacaatccattttgcaaatgtttaacaaaaataggcaaatgatctcaacagatatttctcaaaagaagacatacaagtaaccaataatatatgacaacatgttcaacatcagtattcatcagggaaatacaaatcaaaacacaatgaagtatcatctcacgccatttaggatatctattatcaaaaagacaaaaaaataacaaatgctggtgaggatgtggaacaatggggaaatgtttttgatggaaatgtaagctagtacagccactatggagaatagtatggaggttcttcaaaaactacaaatagaactattatacgatccagcaataccaccactggatatttatccaaaggaaagaaaatcagtatattaaagagacacctgcacctccaggtttattgcagtactattcacaacatccaagatatggaaccacctaggtttccaacaagggatgaatgaatttgaaaaatgtggtatatatacatgctgaaatactattcagccataaaaagaatgaagacctatcatttgtggcaacatggatggaactggaagacattatgttaagcgaaataagccaggaacagaaagttaaacactgtatgttttcactcatatgtggaagctaaaaaaagttcatctcatagaagacaaaaatagaacagaggatactagagtctgaggagggtgggggaagtggtaggttacacagagagatttgttaaagaatacaaaattacagctagataggaggaatacattgtagtgttctataccagtgtaagatgacaatagttaactattatgtgtagtttcaaatatctagaattaggatattgaatgtttctaacacaaagaaatgataaatgttcgagatgattgatatgccagttaccctgatctgatcactatacattatatgtattgaagcatcactatatactccattaatatgtacaattatttctcagtaaaaaatgtaaaaaaggaaaaaagttttaaaaagtcttaactcttgggggaagaaggcaggacaaagaagtcatgaatgtagaataaaaattttaaaataaaatattaacacataggctccaaccatatttcaaaagtttaataaactatgatcaagtaggattcattctaggaattcaactgtgattcgttatctgggaatctataaatataatttattagttcaaaactaccaaagcaacaggacatatcattgtatgttaagacactataaaataatttcgcctactttgcctggcagacagtaaaaaactaaataaatatttatttaatgaatgccaggggacaattcctgagagaagatacgggtatgaatgagtttttttttaaactgagaatgagttaacctagagtaaattgtgcttattttagaatattaaaagaagttttgaagtagggagccaaaaaacaaaaccccagtaaagtaccatcatttcaggggcaggtgggaaaagatatttggcaacatccagaaatgtaattttctattacagaagttttgaaatggctaatataggtttttctttatattcatcttgttgtgagccttgtacatacaacctatgtgtactttctgtcttatttcaaatttgcatttaagactaacttatgaattggcattttaagtgaaacagtaaaagatttttatttttttttgagttggagtgcaatggcatgacctcggctcactgcaacttctgcctcccaagttcaagtgactcttctgcctcagcctcccaagtagctgagattacaggcgcctgccaccatctccggctaatttttgtattttttttgtatttttcagtagagacaggatttcatcatgttggccaggctggtcttgaactcctgacctcaggtgatctgcctgccttggcctcccaaagtgctgggattacatgcgtgagccaccgtgcctggccaaaagattttttaaagtgtctttacagtaatacagatatatatatatacacacacacacacgtttatatatatgtatatgtatattgtgaaaaaacatgagcatttatggaaaaattagccagtgaatttacattttccacttgcattttttaatgtataattgttaaaataaatcagtctgccttcagcttgagtttttaatgtaattatctatccctcacgtgtaaatagttttgatggtatagtaccgtttgctcaaatttgggtttgagagaacagtaactctaattttttgatcttatgtgtattgagtatatggttcataattaatatttagtaccttaaataatgagtacattatgttattttattttttatttttttaagcctgtattccagagagtgtatattatcttggtcttcattcttttcatcgtggctgttttgttggtatagaatattatttctgtaattttcatgatgtcagtaactatggaatttgctttaatttgtttggccttgaactgtttatgaagtgataataacctaagtgctccagaaatatattttcttcttggcaagaaatataaattatagtcagacagattaaaaatgtaggagactttttagtgtaagaattggtttagactacttgtaaacacattatatttatttagtattgagctttaaggcatttgatttatgcccacatatcaagctggcatatttgtgttttcttcctcttgttatctggacagcagagaattccccatatggccatagggaggggtgttgatgtaacagtggtggatgacatagggatttgagctacatacttacacagattgcttgtgccctgtgtttctgctcatacttgatcatgggtaccacttccattttatattcttagggttattggtaacagaactagctcatgattgcaaactctcaacacatagtcacttgattacccatggtcaagcattctatttttatctggacccagtggcatggcagtaatagaggtatataactttccaccacagatggtatggcctttgacatgtgtgtgaagcctgcattgtgattctttcactggggcttgccataaattccacatactactttttccaacagtgacactaccaataactatagtatgtactgggtcatatgtgcctagctgcagagttgcatgcagggtagacttcactgacagcagagctatttcctaccctggctggaaagagctggcagcctttaatgtcttccagtatatgggctgaagcagcattcctaggagtggaatatgctgcctttagaacacaaagaggcctaccagatggtttgctttcttctttgtaatgggagttgcaagatgcataattggtcttttaattcagatgagctgtctgagaatgttcttgtccactggacccctaaatattttaccaatatcaaagtctctgaatctttgtaggttttattttccatcctttgaagcatatgtcttaagaaggtctctgttgcattattcttgcccatctggcccaattagcataatgttgttaatgtagtagaacaatgtaatgttctgcaagatgtccaacaggatcaaatgtattctgactatgtatgacaaaagagggcggaattaatatcatcctaaggcaaaagtgtgaaggtatactagtttcccctccatgtgaatgcaaactatttttgatcctcttttttgatagttagcaaagaacacatttgccgactccatggccatgttaatcttctctaataaagatatacatcttgcacgacacctgcaattttagttctacttggtagtaggtgtctgctatcctttaagctttgtttagtttgccaaactgatgatttaaatggagatttgatggggtccattatcctggcattatttagattctttagggtgatactaattgcttctacccactctctctggaatgtgatagtattttaaaatttattgtattatccaggggataaaagctcccagaggcttccactgtgagaaccaaagaccaaatgtggtaggtgttgtgccatttgttaagcctgtttattccaattctatatccagcgactgaagacatgatcactgggtgagtctgtgacccagtggacccattttgagctggaccttgtccagctgttttcctattgtctcccatcattgggctaagttctgttacagttgctcctactatcagctttggtctatggaggaaagccacgaaattcttagtgatgctagtgtctctcccaccatcatattcttcatggctttggtaattggcatatcctctggccctttccatagataaaatagcctggtgggttttctggcatcacatagtgtattgacttcagcatgtgcacatttttagacttttaatcactgcctttactgtttgctatggcagttccggcattttgaccttacttagcatgggtatacttttcatgttttacatgtttctaagagtcatccagatagcaagtgaacatcacctcttgtggcatccttgtcagaaaggaaaatcctgcatcttggcagaaggctttcaaatcagtaaactctccctaatccaatcataaggttctggccaccttgatcaagctcccctctgaacctagtaccacttgtactctcccacctcctgccaacatgtgctgtctagctgtctaggtttgttgttgttgttgttgttgttttgagacagagccttgctctgatgtccaggctggagtgcagtggttcgatcttggctcactgcaacctctgtctcccgggttcaagcaattctcctgcctcagcctcctgagtagctgggactacaggcgcccgccaccacgcccggctaattttttgtacttttagtagagacgggggtttcactatgttggccaggctggtctcgaactcttgaccttgtgatctgcccgcctcgacctcccaaagtgctgggattacaggcgtgagccaccgtgaccagcgaaggtcttatagattctttggtcgtatactctctttctttccttagcagtcccagcatgtacctagatgagttatgttgatacccaacccaagttataggccctctggccagtactgaagatgtgagcagattctgccctgcgccacaggtcatgctggagagtagcctctacattgtgtttaagcaaaggcagagtgctatctgtcttttaggaaggtaggatggatcatttctgcagtgtcagatgattcaggaaaatttgggaattcaaaatttgggaagactttaaggagcatcaacttctgatattcccattttgtgtgtcagagtcctttttcttctggggcttgaccttctttaattgacagatcttctataattggcagtctcgttatatggtactgaggagaccctctggctttatcagcctttcattatctttttctagagctcactggggctaagcagtagacatgcaattctagtatcttaatagttacccttcctcatgtttttcaagcatctagtacttcactcctgctatactattcccttctattggcatgccttcctactttatcactagtttaagtttttgcagttgcttaatggccactttgtgccaagagctatctgtgctccacctaccaccaatgatgagtttttcattgctagcctggcaatgtatgatccagctctcaaactccaacttatttcttactttagtataccattcctgaaacaagtcagagtttgagtcctctggaaagcagactctgaggtagagtttagtattcatgatgttaattgggagtacccttacaatcaatgcctttgcaagaggtagggggatgatgcagaattggacaaagggagaagttgagttgtgatgctcgatggataaccttagtcaaccctgtaaggattgactgaaggcaaaataattggtcatacttctccaatgttgggctggaatggccaggcctttataccaatacattgatcagtcattcaatatgggtcattctaggaagggtgtgcccttgagtgaagtgggcctgtgttcctcaggcagtttgtgaggtagcttgcaactgactcttcactgacagcactgctagcaacccagacaacaagtttttttttgaattatgatctgggcagcatatatccatgtctaccagaaatatccaaacttcagatgattgacaccaaataaaaatttatttttcacccattatacatgttcatcattggtgggcagggcagattttttttattattattatgctttaagttctagggtacatgcgcataatgtgcaggtttgatacataggtatacatgtgccatgtcggtttgctgcacccatcagctcatcatttacattaggtatttctcctaacacccatcaactcatcatttacattaggtatttctcctaatgctatccatccccaggcccccaaccccacaacaggccccattgtgtgatgttccccctgtgtccaagtgatctcattgttcagttcccacctatgagtgagaacatatggtgtttggttttctttccttgtgatagtttgctgagaatgatggtttccagcttcatccatgtccctgcaaaggacatgaactcatccttttttatggctgcatagtattccatggtgcatatgtgccacattttcttaatccagtctatcattgatggacatatgggttggttccaagcctttgctattgtgaatagtaccgcagtaaacatatgtgtgcatgtgtctttatagtagcatgatttataatcctttgggtatatacccagtaatgggattgctgggtcaaatggtaattctagttctaaatccttgaggaatcaccacactgtcttccacaatggttgaactaatttacgcttccaccaacagtgtaaaaacattcctatttctccgcatcctctccaacatctgttgtttcctgactttttaatgattgccattctaactggtgtgagattgtatctcactgtggttttgatttgtatttctctgatgaccagtgatgatgagcattttttcatgtgtctgttggctgcataaatgtcttcttttgagaagtgtctgttcatgtcctttgcccactttttgatggggttgtttgtttttttcttgtaaatttgtttgagttctttgtagattctggatattagccctttgtcagatgggtagattgcaaaaattttctcccattctgtaggttgcctgttcactctgatggtagtttcttttgctgtgcagaagctctttagtttaattagattccatttgtcaattttggcttttgttgccattgctttggtgttttagtcatgaagtccttgcccatgcctatgtcctgaatggtattgcctaggttctcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccttttcttgtttttgtcaggtttgtcaaagatcagatgtttgtagatgtgtagtattatttctgagggctctgttctgttccattggtctatatctctgttttggtaccagtaccatgctgttttggttactgtagccttgtagtatagtttgaagtcaggtggcatgatcctccagctttgttcttttggcttaggattttcttggcaatgcggactcttttttggttccatatgaactttaaagtagttttttccaattctgtgaagaaagtcattggtagcttgatggggatggcattgaatctataaattacctttggcagtatggccattttcacgatactgattcttcctatccatgaacatggaatattcttccatttgtttgtgtcctcttttatttcgttgagctgtggtttgtagttctccttgaagagaactccttcacatcccttgtaagttggcttcctaggtattttattctctttgtggcaatggcgaatgggagttcactcatgatttgactctctgtttgtctgttaatggtgtataggaatgtttgtgatttttgcacattgattttgtatcctgagactttgctaaagttgtttatcagcttaaggagattttgggctgagatgatggggttttctaaatatgcaatcatgtcatctgcaaacagggacaatttgacttcctcatttcctaattgaataccctttatttctttctcttgcttgattgccctggccagaacttgcaacactatgttgaagaggagtggtgagagagggcatccctgtcttgtgccagttttcaaagggaatgcttccaggttttgcccattcagtatgatactggctgtgggtttttcataaatagctcttattattttgagataccttccatcaatacctaatttattgagagtttttagcctgaagggctgttgaattttgtcgaaggcctttttggcatctactgagataatcatatgattttgtcattggttctgtttatgttatggattatgtttattgatttgcgtatgttgaaccagccttgcatcccagggataaagctgacttgatcgtggtggataagctttttgatgtgctgatggatttggtttgccagtattttattgaggattttcacatcgatgttcatcagggatattggtctaaaattctctttttttgttgtgtctctaccaggctttggtatcaggatgatgctggcctcataaaatgagttagggaggattccctctttttctattgattgggatagtttcagaaggaatggtaccagctcctctttgtacctctggtagaattcagctgtgaatccatctggtcctggactttttttgtttggtaggctattaattattgcctcaatttcagagcctgttattggtctattcagagattcaacttcttcctggtttagtctcgggagggtgtatgtgtccaggaatttatccatttcttttagattttctagtttatttgcatagaggtgtttatagtattctctgatggtagtttgtatttctttgggatctgtggtgatatcccctttatcatttttattgcatgtatttgattcttctctcttttcttctttattagtcttgctagtggtctatcaattttgttaatcttttcaaaaaaccagctctgggattcattgagtttttgaagggttatttgtgtctctgtctctttcacttctgctctgatcttagttatttcttgccttccgctagctttttgaatgtgtttgctcttgcttctctagttctcttatttgtgatgttgggtgtcgattttagatctttcctgccttctcttgtgggcatttagtgctataaatttccctctacacactgctttgaatgtgtcccagagattctggtatattgtgtctttgttcttattggtttcaaagaacatctttctgccttcatttagttatttacctggtagtcattcaggagcaagttcagtttccatatagttgtgcggttttgagtgagtttcttaatcttgagttctaatttgattgctctgtgttctgagagacagtttttttgtgatttctgttcttttacatttgctgagtactgctttatttctaattatgtggtcaactttagaataagtgcgatgtggtgctgagaagaatgtatattctgttgatttggggtggagagttctgtagatgtcttttaggtttgcttgttgcagagctgagttcaagtcctggatatccttgttaacctctctcattgatctctctaatgttgacagtggggttttaaagtctcccattattattgtgtgggagtctaagtctctttgtaggtctccaagggcttgctttatcaatctgggtgctcctgtattgggtgcatatatatttatcatagttagctcttcttgttaaattgatccctttaccattatgtattggccttctttgtctcttttgatctttgttggtttaaagtctgttttatcagagactaggattgcaatccctacttttttttgctttccatttgcttggtagatcttcctccatccctttattttgagcctatgtgcatctttgcacgtgagatgtgtctcctgaatacagcacactgatggatcttgactttgtcttttaattggggcatttagcccatttccatttaaggttaatattgttatgtgtgaatttgatcctgtcattatgatgttcgctggttattttgcctgttaattgatgcagtttctttgtagcatctatggtctttgtaatttggcatgtttttgcaatggctagtcccgtttgtttctttccatgtttagtgcttccttcaggagctcttgtaaggcaggcctgatggtgacaaaatctctcagcatttgcttgtctgtaaaggattttatttctccttcacttatgaaggttagtttggctggatatgaaattctgggttgaaaattcttttctttaagaatgttgaattttggcccttagtctcttctggcttgtagggtttctgccgagagatctgctgttcgtttgatgggcttccctttgtgggtaacttgacctttctctctggctgtccttaacactttttccatcatctcaaccttggtgaatccaacaattatgtgtcttggggttgctcttcttgaggagtatctttgtggtgttctctgtatttcctgaatctgaatgttggcctgccttgctaggttggaaaagttctcctggataatatcctgcagagtgttttccaacttggttccattctccccatcactttcaggtacaccaatcaatcaaatgtagatttggtcttttcacatagtcccatatttcttggaggctttgttcatttctttttagtctgttttttcttactttttcttctcgctttatttcattaatttgatcttcagtcactgataccctttcttctacttgattgaatcagctattgaaacttgtgcatgcgtcatgaagttctcctgtcatggttttcagctccatcaggtcatttaaggtcttctctacactgtttatcctagttagccattcgtctaatctttttttcaaggtttttagcttccttgcaatgggttcgaacatcctcctttagctcggagaattttgttattacctaccttctgaagcctacttctgttaacttgtcaaagtcattctccatccagctttgttccattgctggtgaggagctgtgatcctttggaggagaagaggcactccaatttttagaattttcaccttttctgctctggtttctccccatctttgtggttttatctacctttggtctttgattttggtgacctacagatggggttttggtctagatgaccttttgttgatgttgctgctattcttttctgtttgttagtttttcttctaacagtcaggtccctcagctgcaagtctgttggagtttgctggaggttcactccggaccctgtttgcctgggtatcaccagcggaggctgcagaacagcaagtattactgcctgatcctccctctggaagcttcatcccaacggggcagccacctgtatgaggtgtcggtcagcccctactgagaggtttctgccagttaggctacacgggggtcagggacccacttgaggaggcagtctgtttgttctcagagctcaaacgccatgctgggagaaccactgccctcttcagagctgtcagacagggacttttaagtctgcagaagttgtctgctgccttttgtttagctatgccctggccacagaggtggagtctagagacggtaggccttggtgagctgtggtaggctctgtccagtttaagcttcctggccgctttgtttacctagtcaagcctcagcaatggcggatgcaccccccagccaggccgctgcctcgcagttcaatctcagactgccgtgctagcagtgagcaaggctctgtgggtgtggtacctaccaagccaggcactggagagaatctccttgtctgctgattgctaaaactttgggaaaagcgcagtatttgggtgggagtgtcccgtttttccaggtagtctgtcacagcttcccttggctaggaaagggaaatcccccaaccccttgtgcttcccgggtgaggtgatgccccaccctgcttcggctcgccctctgtgggctgcatccactatccaactagtcccaatgagatgaaccaggtacctcagttggaaatgcagaaatcacccatcctctgcgtcgatcacactgggagctgcagactggagctgttcctattcggccatcttggaacgcctctccagatttttttttgtcattatttagggacccaggctgacagaagacataggctttcattgctaatcaaatgcctccaaccagaaacacagatattccagtagcttgcattacattgatacattcaacttctagggattgtaagagtataattttgtgccagaaggaaaggaactgaaatattttattgaacagcacaaatgtctatcaaaagtattgtatgtaattcttttttaaacttttagtataattgaagattgaagatgatgtcttggagatagtaataaagctgtcacttcctaccgctacatgtattgaaaggcaaataacttctagaagtagaattatgttttattattatttgcctaaattaattgccttcatgtataattacattactattactgtactgtaatgtttctcttctgcaggacttgtgtactttaaaaacaaaacaaaagaaaaccagaacatgactgagagcataagcactattttgtaaacagtgggattaaatgaaagtatacatacttaagagtgaaaccctctagctaccctttatccacttagggtcttcctaaaatgctgttagtccgatttatggtttccaggcaggagactggaaaattatctgaagaaatctgaccagcctaagagaaagcatgtagagatactgacatttggaggtctctaactgaaatggttccacctgatcagaatcccagaggtcaacatgtccttcttaagcactaaattcctaatgactctggtggtgcctcactcttaaatttgcagcctgttattattttgacaattacaaaaagttactaaatttgatcaaaatgtcaaacgagtaggaaaaaataagaaattaggggaaataaagataatccacagaggagattataagttaaatctttatggacagaagatgttacatttgtgaagcaaaatgtgagattttaataaaaatagttaattcagaaaagaaaaaaatgagctcttggaaattaaaattaggaaaacaaatcaatgatttgaagataaagtgaagaatctccataaagtattatgaataatggacaaatggaaaatagggtaaaaaatgagaaatttaatatgactgttccagaaaactttgtatctcagtaatagaattgaaaaagcaaagaacataacattttagacaggaaggaaattatcaagtgagtaattcaaaaatatgtttgggattgaagtacacaaattttaagactaaaagagcctactgagccccagaaaaataaatacaaaagactcacagcaaagctcattacaaaaagacaaaaagaacctaaaaacttatatagagagaaaagaaataggacaaataaatcatgagacttgatagcatagtgccttacaaaagcaatacgagaagccagaagagtggactaataccttcaatatctgaaaatgctttccatgttagaattctaacaccaatcaaatcatactaaaagtgttagagtgaaataaaattattttttagaattgcagattctcaaaaatatacctccaatgtacactttatttagatactttaggattatatctcctattgaagtatgagattaaataaacagatgaaatctaagaaatggaatatataacaggggagaaatatggagggaatccttatgatgatgtaataggcctagagagcagtaagttcagattggagaagaaagatggagtttcaggagggatgtctttacaaagtaaatgaaattgccagatatcttgatgtattagaagatattgagaagaaatgtacacatctggcaaagggttgggggagaaatagcagtagatatacagaaaggtaagcaaaaaagtgaaaatataatttgtggagaaagtaagttatttaagaataaaaatgtagtatgctacctggcttatctgtgaataatatcacagatatatactatcaaagataataaaaactgaacattagctgagtgtggtggtgtgcacctataattccagaaactctggaggctgaggcaggaggattgcttgagcccaggaattaatttagtccagcctaggcaatacagcctaggcaatatagcaattccccatctctaaaaaacaaataagaaactgaatattgctctaaacaaaattataatataaatgtatagagaatggagggagaggaaatatgcgtgtgtaagtctgtgtaagagcttaatcttcaccatctgaagaaggaagtcaggcatattatctgaaactgggaactaggcatgctgtttagaacagatgaaaatacaagaaacaaaaacaaaaacaaactctttatagctgtttatttagaattaaaagtgcttacctccatgattctggaatatgctttgggaagatagggggcagtggatttttttttttttttgataaaccttgtagaaatattggacttttgggcctcacacatgtatatatttaaaaatgataaaataaaagcaaagtataacagtacagaaattaaatgatgcacaagttagtggatcaaggataaatgttcaaaaattgggaaaattagtgcattgacatatacttggaaatatctggaaaatatgatatatgggaaaaattaagtttgatgcttaccagatatacaaaaataagttgcaaaaagattgaagaccaaaatagtaaaagccaacagaaaaacctttactggaaaattagagattatttttaaaatctcagtttactgagtaaacaagcacagatcataaggtgacctaaaggtaagaccaactttctgtaaaacaaggtttcataaactaagtgaaaaaaagatgctgtagcatggaagaatatatggtaatacatatagccagcaaaggattagtatccagaatatttaatcaagaatcctttaaattattaagaaaaagacaaaaagcaaatagaaaaatgtgcaagtcttaaacagtgatttcatagaagactaaaacaaataacctatacatgtgaaaataagttgactcaccagtaactggaaaaatgtaaaatcaaaccattcatcagattggtaaaaattttaagtctgatagaactacatgttgtagagaatataaaacaagaggaactgttgtacactgctaatgtgagtcaacacaactactttggggagcaaattgggaaaatctagtaaaatcgaagttgtgtcttttcttatacctcttggaaatctagagaaacattcaaaatatgcacaagatacatataagagtgaatataccaacatgacttgtaataggaaaaaaatctttaaaaaggctaattattaacagcttaatgggtaaatattttgtgtagtcataacatggaaaactctaacatggttacaatgagcacacagtaccacttgtatctataaatttaaatgagctgttgaattgacatttctccaaagatatacaaatgtccaataagcacatgaaaagatgctcaacatcactaatcattagggaatgcaagtcaaaaccacaatgatatactaattcatactcattaggatggctatgataaaaaaacagaagataacaagggttgacgaggatgtggagacatatgaacccttttgcattactggtaaaaatgtaaaatggtccagctactatggaaaacagaatggcagtttcttaaaaaattgaacacagaattactatatgatctgttaatcaaatggacctcatacaagttatttaccttcatgtaggtctgattcttcatttctaacatagggtaatacctgctccatcaatttcactggattcttataaagaccattttaagatatgcgatgaaaacactttggaacttttatgtgtacttaatttataaaagtatacagtttatactttatataatttcttttgcaccaacctaatagtgctacaaacatataatgtacatttattaaattaactctaacatgtaaaattggcagtcttaatctttatcataggcctccataataatattttctaaaatgtgatcttcagagcattgactcttgaggatcttaataggcattatgtgaaaagtgcttctttggataaaacattgggaaaacactgtgttaaataaagttaggttaggtttctgtacctttacactctctcttttgagaatatttaataggcagatataccatgtggactaaaaagacagattatacactttttcgggggagatttgtgtttcctggattatactttagcatatacaggtcaacatatattttattgttctcagtctttcagcatcattctctttttttttttaattatactttaagttctagggttcatgtgcacaacgtgcacgtttgttacgtatgtatacatgtgccatgttggtgttcagcatcattttctaaacttacagttttggtttttataattttttgatgttcattaataaaatattgagttgaaaccaaatttattttattattgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatttttagagggtcacttatatcagtcatactatcctcatattctggtattctttttgaaaattatcattggtacttaatggtattggattttatgcatctcttctctaccatagaatgcattttgatttgtcaatcatatctttttttcctttcttgtttaatatatttaagggacatgggagtaggtaaaggaaaggtgctgagataagacatcagatacccttttatgtcatcctgccttcttttctttttccagagatcagataaggaatgactcttcttttaaaaagatggaactgaaatgatagagaggctagccccatatttctatcaaggagaacaaggaaagtgagaagaattagattctcattttagttctgtcatttactaaatgtgtgatttttgacaagtctcttaacctctctggaccttaaaatcattatatccattgagaaattggactcaatggtcattacattgccttccccatttaagttaatataatttttgtatttctatggcaaaaatttggtaatttggaatccagtgacagtaaacaatctgctagctcatttagtggcttaacatttgtaaatcagaatgacctttttataagcccattttattaccaccttatcctaaatatgtaaaaattctccactattgccacaaaatgacttaaccacaatgaaactgtgtaactgatatcaagtggctgtccaaacagtaatacatgaaaactgtgaaacataaaacctccagggttctctggttgatttttattttacttttttaaaataataaaagacattcttgaagacttttttgactgattcaatttattatgttaataatatttttgacatgaaaaatatgctgttttaagggcattggcactgcttggtattaatttagtattgtctaggcttctctttccagactgaatttaaaaaatctttttgattattttactcttagttttcttattttaaaagaatgaaacaccataagaagaactcggtatctaatttcaaaattctgtgtctatattgaaaagttataattctagatagcagttctaaagtgtgtcttgtccatgtatagctattatctatttttttaaaacattgttttctatattattaaaaaaatacttatttttctgacaaaggaatattgtatataatcattgtttcttttcctttcttgtattaacaataaaacatgttttgaagacttagtgttttcttaatatattaagatttatagaatatttcatattttgtctggaaagtcttcaagaaattatatagtagttcctctggtgtttttatatcatattgtatgctagaaatatgattttaaagaacagtactaacagaagtacttaaaatagtataaaatgtatatttaaatctatgcttatttttataactaaatcagtagatagggacttttaatagcgtttctttaagattcttgttttgtttttaataggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacaggtaaatttctttttcttttcgtctttgtggcagcaaaatttctcttctacagaagtagaaatatcttctgcttataagaattactttagtagctacagaaatgaaaaatttgtattaccctaattaggaattctaatgtttgaacctagtgattaataatttaatacatttattagctatttttagctttatttttgaaatctgtatatatagtatatatatcaatattttatatataacattgtcatatatatgaattattttctaatataagtttaaaatgctttccagtacatcatttctaagaagtgctgttagattcaaagaaataaaatgaaataatttattttccatgtggtatttttttttcttcctgaattattgccaaaccacaccataaagtaaaaaaatgttacagcatttcatgactaatgatctggttttatatttcttataaaatggtgaataaataaatgagacttatgaaaagttaccagtcaattattaatcagttagctaattaattatttggataaatattgtttagttttttaagtgctgagagtttttatacatttttgcggttacaattaataaatgtatttttaagttttactaatctatattaattcagatgtcttttatatctttagaaaggatgataaacagtatttgttatgatgttttcttttgtatgtatagtaatacactttgttcagtaaaatatatgtaaatcctttgactttctctaaaatacgtaaatttatttattttagtttattttttgagacagagtctcactctgtcacccaggctggagtgcagtggtgtgatcaaactctgtctcctggtttcaagcaattctgctgccttagctttccgagtagctggaattacaggcatgtgccactatgcctggctaatttttgtatttttagtagagatgggttttgtgatgttggccaggcttgtcttgaactcctgacctcaagtgatccgtctaccttggcttttaaaagttctgggattgcaggcatgagctaccgtgcctggcccaaaatgtgtgaatttaaaatgtctgtaggatccttgtatattgaataattaaaatgggggtaaaaggtcttgaaaatcctgtaaacacaattgaactacaaaagttgtcttaatctttagaaaacttactttgaaattgaaggtcatttctttggttaaaaaatgtcttagtgattcttaatgattcttaaatagatattgtaaattaagaagagtaagattttcttttccgtgctgatatatcgtcccccatttgtattatagctgcttctgatgacagatgttacagatatgcagattgtgccagctgtactgccaatacaaatgggtgccaatggtgtgatgacaagaaatgcatttcggcaaatagtaactgcagtatggttagtatttatgggtaaatggtgctgtagttacaacagactgctgctttatgatcattagcttaccatttagtagcactgtagaaaaaaagcactttacacattaagacatttagaaagtatatagggaatcattcacttcttggcaaattgtgaagttagattggtttgttgttcaaatttgtcagtctagattccattttggatccatcaactttacttcttttcatggatgagactgggaacattttttcaaaactgatattgaaaaagactatagctataaatgttgtcttctgttcctatgaaaataagattatataggtaggtattgaaataatttccattggattcctgtcagacatgcattagtggtcgtgtggtctagtgctttgttttcacactttgtgtgtaagtttaacctgagtttttggtagttgtagtttctcttttaactgtctatacattagtggttctcaagttgaggcaattttgtctcacaggggacattttgcagagacattttggttgtcacaaatgtggagctgctattggcatctaataggtagaagcaagggagctgctaaacattctacagtttgataagattttttaacgtcctttttcatctaaagtagagttttagcactattgacattttgagccctataattatttgtttatttgtttatttgttgtgggagggctgttctatatattgcagaataaaaaaacataaaatatttatggcagatgaaaatgggttaagagaagcaaaaattaagattttaagtggtagcatctaaacattctatgttatgtagaagatatcaacaaattgaagggaaaaattttaaaaagtagtatttagtagaattaaagatttttttgttttgttttgtttttttgagacagagtctcactccatcacccaggctggaatgcagtggcatgatctcggttcactgcaacctccacctcctgggttcaagtgattcttctgcctcagcctcctgagtagctgggattataggcaggcaccaccatgcctagctaatttttatattttagtagagacagggtttcaccatgttggccaggctggtcttgaactcctggcctcaagtgatgtgcccacctcagcctcccaaagtgctgggattacaggcatgaggcactgcacccagcccaaagattctttcatgggcctatagcttgagtaaaaataaatagcatggatacatatttccaactgaatataatgtatcattttttcttttttggaaattttattactgaaagtatctacttgtttttcaagatagcaggcagaggtaaaaggcaaagaaaagggagttgaaactaagtaaaaaatttgattgtataattaaaaaaattcttcactaattaataattcaaaatatgtaagttttatgactttaatctaattttcagaacttaaaatggagggaaatttgcagttactgactcattagattgaacccttttgttttcatacatactctgttgttatatactttccagtgatacaagttgttttaataacaagatatacttcaattttatttgagttttaacattaatataacatggttatgctttgaaaatttaaattacgtttgaagatatccactgatattcatctaatgggagttattttagtagaagtcggagttaaataaaataagacatgggaatcagggacttgtattacagttcttcagagaaacagaatctgtctatatatatatatacacacatacacagtttatatatataaataaataatatatatttgtttatatattatatataaatatataaacatttgtttatatatttgtttatatattatatataaatatatttgtttatatattatatacagatatataaacaaatatataaatcttttatatataatatataaatctattatataatatataaatatctgtatattatatataaatatataatatatatttgtttatatataatctataatatatgtgtatatatatatataaaatgagatttattataagaaattggctcatgtggttatgaaggatgaaaagtcccaggatctgccgtctgcaaactgaagacccaggaaagttgatgatgtaaattctactctacgtatggaggcttgagaaccaggagtgcagatggtgtaagtctcagtccaagagcaagaaaaggcagagagaggaaattctttcttcctctacttttttgttctttcaggccctcaattgcttggatgacgcccaccatagggagagcattttactttacttggtttaccaattcagtctcatccagaactgccccctacagacatatccagaaataatgcttagcctaatatgtgtccaccccatgtcttggaaaagttgacacataaaattaaccattacaagtctaccccttgtcaacttggcacctatacatatctacataaaccatacttaattttcaaatgaagataataacaaggtcataattctacctaacataatacaagtatcctgtgtacaactggaaaacacatcaatctctttcccagaaaaggaggtaaagtcctggagtgatatttactcctctccttgatattctgtaaattaaatactatgatgtaaaatcaacagtacttaaattctgatatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggtatatctcctaatgctatccctcccctctacccccaccccacgacaggccccggcaattcctcaacgatctagaactagaaataccatttgacccagccatcccgttactggatatatacccaaaggattgtaaatcatgctgctataaagacaaatgcacacgtatgtttattgcagcactgttcacaatagcaaagacttggaaccaacccagatatccatcaatgatagactggattatacatatattctcacctaaccattttgtatttcctttaccttcagcaagcaccttacctgcttgtagttttttatctgttggggtgactcaaacctttattcttgaagggtcattcttcattagtagtcctgcttgaattggattgttgtagttttccattgatcttaatcacagggtaatataatttggacatttgtccctgcccaaatttctgttgaaatataatccccggtcttggaggtggggcttggtaggaggtgtttgaatcacaggagtggatccctcatgaatggcttgggccacccgcttgttgatacgtgagctcttgctctgggttcacttgaggtctggtcgtttaaaagtatgtggcaactccacctccattctcactcttgctcctattctgccatgtgagatgcttactgccactttgccttctgcaatgagtaaaagttccctgaggcctctgcagaagcagagcagatgctggtgccacatttcctgtaaagcttgcagaactgtgaactaactaaacctcgtttctttatgaattacctgatttcaagtattcctttatagcattgcaagaatggcccaacacacagggtgtagggtatggtaatactgaaagacgccataagggatctcttgtattctagacatattcttcctagcctcctgtgtgaagtggcagttcagtttccctgtactagaagcagtcaccccaatgagcacagtaactcttctttgactgatgatttagaggtgtaaggaacccaaagtggccaagtggcagtcttaatttccaattctatggaatcagtgttgtgttttctggaaaaaattattccttcctctggaattaagacatctaggtcagcaaagaataaggtcacaggaataggaagaaaaatttcgctaatgaattactaagggcagtagtgagtagtaccactcccatttccaccccttgattattggacccataaatgctggctgtgagagaaaaagcaccatatattggatgctgactcagagcttatatggctttctggagaacccttctgtcagccttgcaaggtattactacgtagctggcactgtaactgaatcatcaaaagcccattccactgttttatgaaacgagttgcttgacaattgtagggaacatgataagaccagtgagcataggcccattgctgtcctccatgtgctgtgacatgagttccttggtcaaaagcaattctgtatggaataccaagatagtagagaaagaattctgtaagtttactgatggcagttatggcagaagcattgtgagcgaggaaggcaaatctatagccagaataaatgtctgtttcagtaaaaacaaaatgcttccctttccctgattgaagctgtatcaaccttcctccaggtagctggctgattacctagggggatggcaccatatcaggagctcagtgttggtttctgctactggcatattgggtactcagcagtggtcatagccaggttggcctcggtggatggaagtccattttgctgagcccatgcataatctccatccctgccaccatggccactttgtccatgagcccgttgggtaatgacacaggtggctagggaagaaggtatccacagaagtggtcatcttatccatgtgattattaaaatactcttttgctgatgtcacgttttggtaaacatttacgctggatacaagtatcttcacttatttgccattcagtgagatctgtccgcatcccttttccacaatttttttttttgtcaccaattttccattcatgttccttccaagttcctgaccatacagacaaaccattggccacagcccatgaatccatacataattgcacatctggccatttcttcttccaaacagaataaacattgagaagcactgtttgattttgcccactggaaagatttcctttcactactgtacttcagggaggtcccaggaagggatagcagaacttcagcagtccttttttgggtggtacctgcatattgtgcagaaccatctgtaaatgaaaccagtcttctcttcctctgtcaagtgatctagggaacttctcttgaagtgataggtcagactgggagagagaaggcagtgtggcagaagtggggatcatgggcatttgggcctcttcatgtaacgtagttgctccttcagggcctccttgagcctgatcatgtatataccacttttatttgatgatagagtgccgctgtgcatacccaacctcatgggttggtgggtcagataacacccagttcatgatgggctgaaatcacataatttggtgacccatggttaaacattcagtttctattaaggcccagtagcagactaagagctgtttctgctaaaggatagtagttatctgcagaggatggtgatgttttgctacaaaatcctaagggtctgcactattatttgcctataggggcctgccaaaggctccaaacagcatcctgtctgccactgatatttcacgtaccattgcacctgcaggatcatgtagcccaactggcagagcttgtatagtactctggacctgttgcagagccctctcttattctgagatctacttggaattcgcagctttttagatcacttggtaaatgggtcaaagtaacataccccagtgaggaatgtgttacctccaaaatccaaagaggcctattagacattctccctcttttttgttttggttataggaggggccagaggcaacaacttaacattcacctttgaaagggatatcttgacatgccccatactgctagacccctagagatttcagtgagttagaaggcccctgaattttagatgaatttatttcccaacctctgacaccaaatatcttgccagtaagtctagagtagttgctacatcttgctcactaggtccaatctatgtgatgttatcaatattatggatcagtgtgatgtcttgtggaataaaaaggcagttaaattcctcagaactaagttattaaataggagtggagagttggtatactcctgaggtagaacagtgaaggtgtattgctaccattgccagctgaaaacaaactgcttctggtgatctttactaacaaatttcaagaaagaagcatttgccagatgtttagctgcttgccagtttccagggaatgtgttaattgcccaagcaatgaaaccacatctgataaggcaattacaattggtattaccactcggttaagcttatgataattcactgttattctccaaaatccatctgtcttctgcatagactaaataggcaaatttcatgggaatatggtgggaattaccactcctgcatcctttaagtccttgattgtggcactaatctttgcaatccctccaggaatggagtattgcttttggcttaccatttttctacatagaggctgttctagtggcttcttcttggcttttcgctccgtaattgtcctcactccacaggtcaaggaaccggtgtgagttttctttcagctgctgagtatgtctattccaattatgcattctggaactgggaaaatagccacaggatgggtttgggacccagtgggcccactgtgagagggacctgaactccactgatcatctggcagtcataagcctctgactggtggcccacagtgatgttttgggtctcctggaattaatgtcagtttagaaccagcatctggtactgatactgattatttccctttccccagtgcatagctaggatttagtaggatttctatatattttactcctaggagcaacttcatgctcaactcaccaatgccatagatgtaagcaagtcagactattccaattgctgctttaactctgctgttcatcatagtaacctcacccaccttgcctttgttagttgagtgctgctacctagcccctgccaacctagatccaattattcctgttgcatttatgtttcccaattcagtggctgcacttcccactgcaaggctgggcatacagaaaacagcaatcatggagctcttcaaggatgccagtgctcccctcccaagtttattcctttcaatactggtgaaaggtgtgtcttctggaccctctcagtgagggtgagcagatcttaaaggacaaatccactctaacattccaatctccctaagccattaaatgtcttctatattaaaccaaggcagatccagcatttccaagtcactcactgtgggccaccttttggtctatgttttagccaactaacagaaagagccctttctaactctccaagctataacatcaaatgtataatttctgcttagtgagcccatatcaataaattttgcctgatccaactttatgtttcgtctatcattttccaatacttttaccgttctggaggctgggaagtccaagatcttggtggtagtagatttggtatctggtgacggcctactttctggttcacagtagatgtcttttcactgcttcctcccctggtagaaggggagctcttgtgtcttcaaccccttataatggtgttaatcccatatatgaggactccaccattatgattaaattacgtcccaaaagttgcacctcctaataacatcacattgggattgggtttcaaaatatgaattttgggagatgcaaacattcagtccatgacagacatttacatatgaaaatacaacatatctgagtgaaaacagacatatcttaaaaattgtattatgtaaattgctatcaagtatttataaagtggcattttgctttatattttattcaatgatgatgtgttaacaaggaaaacattgggtgagatagtgtaagagagcagatggtactcacttgtaatttagaatttgatgtaatgtgtcctttagacagttttatcagaatgtcttgtgattaagctaaaccaaatgttaatggcaaagagaggtctttgggatttcagtctagattatgtacattgatatcctatttcatataggtcaaacaatgtgctttattctcacatattttcatttacaatttacatgtcagtatattagagtgaagatcagtagagtagtggttactattcataagcgtgtctggttcattaggccaaaaatgccagctatgtttcagaataatagctttcttttaccattgattaacttggctctatgtgtgattgaaatataatttcattttttgtacttgtttagtatcaataaatgactatatttttcttaatgaagagcagtagagttatttggatggagactctgttaccattgttattctaaagattgacataaaactattattctttttcttattccaacatgtttagccattctcatgtcatttttataggttattttatttatctgatacttcaggtaaatttaattatttttagttagctatcaaatgtttagaactatactgtaatgattatatagaataatgctaatatttatatactatatgaaaacaaaaaattatgaatcagaacaaataacaataagaaagtatgtttctaatgaaaatgaagtggttgaaaaagtcataaaatgatttcaaatttacaaaaatgtatcttctgtaattttttaggatgaataaagataaaaattatatctgggtactttttatctgctactttacagtaagtgtaaaatgctctaatagaaattaacacctttggaatggaggtgatggcaatgtattttatgaaggaagtggcttataaataaatacttggtgagtgacatttaaagtctctaagtggttaaaaattgcttcaataaattttatctataggatagctataacttaattttaactcttaactttattgagtgaaaacaaatatttagctccattacatgagaaggcctgaggtatttatacctatagtcaaaacaaaacaaaaagattgaggtgggggctcaatgtttagcattaaatctttgtatttttttttcttataaagtagagccacaggaaaagctgagccaaaaattttaatatctatttttcatgagttaggttttatcataggtattgataatatgtgaattatctgaacctgggtatatgtaaggaaccaccatcaaagtttctatattgtctactttttttctttattggaaattaacttttaatctctcaatgccagattagttgaaatatgattacattatgtagatttggaaacaaaataaaacttttgcagattctttgaagcctcaatggaggaaatgtgacagatatatacagaagaaatctcaatcaaccagaaccattatttagtgtctgtggaagtaaaattagtttgagttgtgacagtcatttatctttttatattgtattgggttttgataaagcatctttttaccttttactacttttcatttctgcctcattcccaggggtctgcatgatacttttattaagactagaaccattttatgtcatcattaatggaaatgactttgtacatgactttattttttgaattggaaggctgttttcgaattcactggaaaaagttttcattagatggtgcctgtttaaaattatgtaatttgcacacttcattttttaataaacattcattccaattccaagaacaatagtttaacttgttaaaagaaaaacttgggacaaaataaatttagcagagcttatttgaacaaagattgattcatgaattgagcagcattctgaaccaagagcttcggacacctccagctatcaatgtgagcaggaagtatttttagacagaaaaaggaagtgacgtttaggaacatcttgattggctacaggtcaccatttgccctatttgggcatggtgtgatgaggcatttaccttgtatggaaatagtctgatcagttggcagcatgtgtttggctgaagctcagctgctgtgattagctgagactaagctatctgttgtaagaatacactcaaattatgttgcagtttgtttacatactatatcaggccaaatttaatttaatctccccttttggccagctgtcagttttgagaaattgaccaaaaaccttaggcactaatactactttctgtcactatcataatggacttgttttgtctgaatatggaattcacaatttgcaatgtcaagtcagttggatgatttttttatattctctttgtgtttttattattttaactatagtgagaccatctgatatataacagatggctgcatatgaacatataagacttgagaggggccgggcacagtggcatacacctgtaatcccagcactttgggaggccaaggcaggtggatcatgaggtcaggagatcgagaccatcctggctaacatggtgaaaccctgtctctactaaaaatacaaaaaattagccgggtgtggtggtgggcgcctgtattcccagctactcgggagggtgaggcaggacaatggcatgaacccgagaggtggagcttgcagtgagccgagatcgcaccactgcactccagcctgggcgacagagcaagactctgtctcaaaaaaaaaaaaaataataataataataaagactcttgagaagatatggcatactaaggagactattataataatgactatcatgagggtaatattaagagactgaactatacttcttaataggtgcttccatgaatcaaattggtcaaaatcaaatatatcaacaacaagccagaagaggaatctacttgttttaatcaattatcttgtttgttgatttcttaaaactgaatttctatcatgtcggacataattttccaagggcaataggaggtgtcatctgttgcacacactcttccctcttcagtcaacagataggccaaagcaaccatgttatctaaaacaactttagcaagagaatttaaagatgtttgatgggcaactgtagccaatttctgctatagtagctaatgtttgcgacagatttctaatcatagtctcatttacatttatgccaagccagggaaggagcattctaccaaaagatgcctgtttagggatacttagacttgcttgcaaactcctctttattctatagttaaattaagaggtgtagaccaatgttcaatttccaattggttattggaaataatcatgacaattctaacagtattactgttaaaatccctattcaacattttccacttattgagacatggagttgctcacatatatggttggttgttaaatcctatacagataaaaatataccctggtgaggcacgacagacagttccttgccttgtgtgttaggggccacagtagagaagcactagtaatatttctccaaggctccattatgaaatcattgcatggttgaaggatcttgacaattaaagggattagggtgataaatttctctacaaactgttgaattacctttcttttggttatcctattccatttctggcataatgtaactgcaaatccctcataggttttgactactgtcagatttaaacgaagaacctgatgtgtgaagctaaaagcctaaccctgtacaaaggaccagatattgctcttagaacatcagagaaatttgttagaaggtgaagcagagaatctctaagatcatttaaggatttgtgtttaacataacatatccaacattcagttacgttgcctgcaaaagctattgattatgaaatcataataagcatgttatcttcctgggtatatataaaaaataaaaacagagaaaagaggaaaaggaccatggtttcatggtgactaaggaaagaagtcttgatctgtcttcttgggaaagctttcatgtctaggatgtcatttgtttctgaggagaaaggtccctggtcaattttgccttgaggtttccagtgggtgtactgtcctgagactgggaagggtcctcttaaattgagaaatgtggatccaaggctcaggctcaaggccctgaagttttgctgcagagaagaacttcgtgtagtcccttacagctgacttcaagggcagtctttctctggtgtctcttttgaaaagacccagtctccggggtgtagaccatgaaaagtctggttgtcatcagttcgtgggggcttcttctatctggtgaaaatataccttggcaaaatgcattaaagccttgcaatatcaagtcatgtcagagtttataaaagcagtaaatacatgaggttctattattacgggcgtaggccttccagtaaccattttataaggggtcaatctatgttttccagtgggagtggatatgattgccattttaatttgtaatacctttgaacaaggcagtgtagttagctttgcctaatgccattgtgtttataataccttatttgaatattttgcagtttgtccattgaaacatatgcctctattgctgtgattggctgggactcaactatctgttacaagaatatgcttgtaagttaggttgcagtttgtttaatcctaaattaggttgtagttcaccacttgtagaggcagcttcaggccaaatttaatttaatttaataaactaatgaaataaataagggagagtctgattcagttgaattgtatttggagttagaaatgtttattttaaagttcaccagaggatttaaatatacactgaagtttaagaatcattgctgtacaaaggtgaaaaataacatgctcttttaattttgtagtctgtcaagaactacaccaaatgtcatgtgagaaatgagcagatttgtaacaaacttaccagctgtaaaagctgttcactaaacttgaattgccagtgggatcagagacagcaagaatgccaggctttaccaggtaaagatttcaaaatttagtaaatgagtttatggtctacagataaatactgacatagaaaagtacatttagtaaggacactacattttctaaaattaaagtcatagtaaatatcaacctataatattgtagtactaataacactgtttctacaagaaaagttttttgattacatatttgcttccaattattttaaggtgttcatatgtttatgatactgttgaactgattagataccttttcatcgaaaaaaatcttaaaaatgtagaaaataataagcactcagacttaatattcagatttaacaaatactaacattttgttatattttatttaagtgccttttattttccaaactcagtgcatattttcattatacattataacatttataaaaaatattttaaggcaacaataatatagaacatattaattatatattatatattttgcctctctgtatcctaaaatatatatattatatattttccctctccatatcccagggttttaaaaatattatatatataatatattaacaataaatacataaatatattacttatataatatgtaacatatatttattaaaattatatatctagtaattttaactaaatatataatttatatatttaataaatttaaaccataaatttatatatttattatattacatttataatatataatataatataaattatattttaatatattatcctatataatataattttataataaatacatttctttttttatttttttaaaattattattattatactttaagttttagggtacatgtgcacaatgtgcaggttagttacatatgtatacatgtgccatgctggtgtgctgcacccattaactcatcatttagcatcaggtatatctcccaatgctatccctcccccctctccccaccccacaacagtccccagagtgtgatgttccccttcctgtgtccatgtgttcacatttcttataataaatatgtgcttttatgagaatccgaattttataaactacagcaaagctcatttttaaaagtaatttcattttttcacagttaacattgctagtggatgctaagtactcttcctttgaaatataaaagataaaattagaaaattgaaaggtaatacaggcatttaaccagttctgcttgttatacagataaactgagatccatgctggttaagtgatatgctcaaaattatgtgacttgtaaatgacagagttgtagctattaactaggtgttttatttctgtttagtattttacctctctttatcccaggttttttttttttaaaggtggaattatttttttattattattatactttaagttctggggtacttgtgcagaatgtgcaggtttgttacataggtatacacatgccatggtggtttgctgcacccatcaacccatcacctacattaggtatttctcctcctaatgctatccctcccctagccccctacccccactttttttttaaagaaaagtttctgagcctatttaattctaaaacatattggaaaattccatcacagaatttgtctgaaagagaatctttcttacaagttaatgtgataaaaatcaaaattattctgcctttaaaaatgccattgcggtcaggtacggtgtctcacacctgtaattctagcactttgggaggctgaggtgggtggatcacttgaggtcaggagttgaagaccagcctggccatcatggtgaaaccccgtctctactaaaaatacaaaatttagctgggtgtggtggtgggcacctgtaatttcagctactcgggaggctgaggcaggagaatcacttgaactcaggaggtggaggttgcagtgagcagagatcacgccattgcaccccagcctgggtgacagagtgagactctgtctcaaaaacaaacgaacaaacaaacacaccattgaggcgctggaatgtcattcatactttgaattttgtttacatactggcccttaaagcctttaaacagtgcgatgtgcatgtgtgctcattttgagaaagatagtattaataatgcagtaggcagggtttaagaagcaacagtgagatgatactaagaagttgaaagtggtattggtctctcagaattaaactataaaatgaaaatgtagatcaatgaaaatatttacaaagtttcctgaaaatgacaaggttaatcttggaccaaaataagatttgaatgaaggaatgtatacatttcaaggaatattactttgataagaatggaaattagttgccagtggaagtttggaaaaatgatagtaaagttacttttggtagtactcatctactcattccctaggaaaaaaatgttgctttgttataaaggctccacttgaccaggctattattttggaaatgtaatgaaatatattatgcacaaattctcttttcttaattcatatttactaagcagccaactggttatatatcgtttgatttccattcagcttatctcaaggaagtgaatgctctaaatagagggcccagtctgtagagcagttgtacaattccatgacaattggtgtattgcattttttttacattgatctcatatgagcttggcaatttgaatttatctcactaaactcattataaattaattgccttccttttaaccccactgctaagttgttgcttaatactacaaaagcctgaagtataaaaatatttggtttggtagtataatttagtttagccacaaaggcccatgcatttgtttttatttgtatgatttgtcaatgaactatttttgttctcactaaaaaataaatgaggagacaggcaataataatctaaattcttccttgattcagtaaggtgagaaaaaaccgtaatttaagaaaacgtttgcattgtaaggaaaagttttttggtattttggatttaaaaggactgtgaaaattgaaacacatatagcttcaaactgaaaaccagggcatgctacacagtcttattaaatgataattatagtttattgagggattactatgttccaactgctgtgagattttcatggtacccaatttaatccttagagcagcaaccgtgaacgaacaggagtccccaagatgctttcgagtgggtccatttggtgaagactaatagtactgagacattatttgcttttaaaattttccatttgttatgggtttaccatggagttttataacggctatctgttgtatgctattccaatagactgaatgtagaagaaggtatgagaatatagctgtcaaatgccaaatattgaagacatttacaaaaatataaaacaataaaaataaaatatgctattaagttgtaatgttccccttcaacattttgttatgaaatattaaaacagaaatattaaaaaacagaaataattgtggagaggacacccaatacctacattctagattctgcaattaacatattgctctatctgcactatccctgatctctctgcctatccatcccctattcattcattaatccttctttattttttgatgctgaggtctaatttgaattgtcagctactttccctcgggaagggaatttgaggatacgtttcctttgggcctatttgtataccatagtggggcaagacatctcagcagctggaagagtgcatttatagtggggtttaaaattattattttaaatgaataaatacatgtatttgttaaagttaccatttttaattttaaaaccatttttaattttaaaacgctccaaatcagtagatatagcatgcataaagagaagttctgtgggaccctcaataatttttaagacttaaagaccaaaaatttgagaacagctgctttagaacaactttataagagttgcagcaatatatccaaggtccttcatacagggctagaggcgctaatacatttcatatgatatagaaactaaaatgtaatctaactttatagatcagtatatcaatgaaacactattattaattagtgcacactaaagtttagccttattaatatattatataaacctgtgttttggaaaacggtgtttcaagttcaatttggattctatagataaaccattattactgaacagtatgtttcatttttagaaagacatgaataattgtgtaaaaataaacattagcaaggaaagatcatagctactttactaatcataagtgaaatgagacttctctacccatgcttatgaaagaatcagagaacccaacttataccacaactatatacctgagctatagaaattagatttagaggtcaattagcttcacttataggagtaactttgaaactgcttctgttataagcttgttgtttttctattaaagtaatcttgtcttatgtaaactagaccttgggacataaatatagtagtgattttacttattgaaataccatatgccaatataccagatgttacacagaaaacctagcagtcaacacatttaacagatgtcatagagccataatttatctcatgtttaagatttaaagaaaaagttgggatgttctgctttcattctctaccaaactattagaaaaatttatttgaaatattgagatatttaatatgttttatttcaaaaataatttaaacaaatacagaagtactttgaaataattgaaaaatacatttgctttttggtaatctaacaataagacacattttttttcttactagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacaggtaacatttctacttgtttacattatggaaatatgctatgataatttcataattatttgaaatttttttttggttttaatacattattgttgctaattttggaaataaaagtgaaattgatttctcaagtgaattggcagaagacttattttgtataagtaataaggtaataaggttttgtaaattatcactttttgcagagtaaaccactgtattaccttaccaagaagtgatcttatatgaatagatacacttaaagagtatataatttaagaattataactgcacttggtatagtgtggcagaaacaatttttgctgaaaacttttcagagcaattatagtcgatcctctgtatctatggattctgcattcatggagtcaaccaaccgcagatgaaaaatatttttaaaaagtatggttgtgtctgtactgaacatgtacatactttttttcttcccattagtctctaaacaatacggcataacagctattcaataacatttacattgtattcagtaataatctagagatgattttaagtatatgggaggatatggataggttacttggaatactatgccattttatattacataaggggtatgatatttatggatgttagaatccacaagggacctccgtatcctccatggatacagagagatgactatgttaccaattacttgctatatagaaacaagtaatgcttacttgttacagcttactttaaagaagcattgtagatagcatatcaaaatggtggacagcataaaatctggacatatgcttatttctacaacttagtagcaagttaacatccctagctctatgtttctcatgtgtaaactggcataataatcatggctacttcatatgtttattgtgggtaataaatgagatactgcatgtaaagaatatagaaaaatttatttttgagagttaactttggttacaatttttactatttccattttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttgataatagacatctggaggtgagatgatagctcgttgtggtttttatttttgtttccctgatgattagtgatgttgaccatttttttcacacttttgttggtcacttgtatgtcttcttttttttttttttattttttttgagacagtctcgctcagttggccaggctggagtgcggtggcatgatctcggctcactgcaacctccgtatcctgggctcaagcaattcttccgcctcagcctcccgagtagctgggattacaggcgtgtgccaccacgcccagctaatttttgtatttttagtagagacagggtttcaccatgttggccaggctggtctcgaactcctgacctcaggtaatccgcccaccatggcctcccaaagtgctgggattacaggcatgagccaccgtgtccggcctgtatgtcttcttttgggagatgtctgttcagatcatttgttcttttctaattcagattgtggttcttttgctgttgaaattttttagttccttatatattctggatattaattccctatcaaatgaatagtttaccaatattttctcctattagtctgttttcatgctgctgataaagacatatccgagactggggagaaaaagaggtttaatggacttacagttccacatggctggggaggcctcagaatcatggcaaaaggcaagaaggagaaagtcacatgttacatggatggcagcggggaaagagagggagagcttgtgtaggggaattcctctttttaaaaccatcagatcttgtgagacttattcactatcatgagaacagcacaggaaagacctgcccccatgattcgattacttcccatcagatccctcccacaacacgtggtaattcaagatgagatatggatgggaacacagccaaaccatataatctccctttctgtaggttgtcttttcactgtgttgtttcctttgctgtgcagaagctttttatttttatttaataccatttgtttatttttgctttagtttcctgtgcttttgaggtcttgttcataaaatcttttagtaaacccattcctgaagttttttcatatgttttcttctagcagttttattgttttgggccttaaatttagttctttgatccatttttttgttgttgtttttgtatagggtaagaggtgggggtctagtttaattctaatgcatatagagatccagtgtttctagtactatttattgaagagattgtcctttcccctatgcatgttcttggtgtaattgtcaaaaatcagctggctgcagctatgtgaattatttgtgggttctctattctcttcaactggtgtatgtttatgtttttataccagtaccatgctgttttgtttactacaactttgtagtgtattttgaagcctggtagtttgatagctctagctttgttcattttgctcaggattgctttggctattagggctcttttttgttccatacaggttttaggattgcttttcctatttctgtgaacaatgtcattggtattttataggtagtgcattgagtctgtagattgctttgagtagcatggttgttttaacaatattaagtcttctgatccatttgcatggaatgtcattccatttgtttggatactcttcaatttctttaatcagtgttttgtagttttttttttttgtagaggtcttttaccttcttggttaaattaattctaagtattgtaaatggtgttaccttcttgatttattttccacctagtttgttgtttgtgtatagaagtgctaccgacttttgtgtgttgattttgtaacctgaaactttgctgaattagtttatcagtactaagagttttctggtagagttgaagtggtgtcattcctctagggtaatacccgaggttctttgcctcacaccaaggaaatcaaggacacagacacacaaggagtgaaattaagagcagaggttgccaggcatggtggctcatgcctgtaattccagcactttgggaggctgaggcgaatggatcacctgagatcaggagcttgagaccagcctggccaacaaggtgaaacgccgtctctactaaaaatataaaaaattagctgggcctggtggcgggcgcctgtaatcccagccacttccgaggctgaggcgggagaattgcttgaatctgggaggcggaggttgcagtgagctgaggtcgtgccattgcaccccagcctgggtgacaagagtgaaactgcagccccccacccccgtccaaaaaagagcagaggtttaataggtgaaagaaagagaaaacctttctctcctgcagagagagaggggctctggagtgggtcttctagttctgtggtgaaatgcatggggttttatagacaagcttaaggaggtggtgtctgatttacatagagcccaaaagattgatctgaccaggtgtgtcatttacatagtgaagaagctggctgccctaccttaatcttttattatgtagatgggttctctacttggctagtgccatgttgcctgttcctttactgtacacgtggttgacaaagaaaagggaagatgtagcctccacgttgaacatgcctggcccccaggtagccttcacctagtggcacagctgccggcattcaccggtgtaagcttccagctttcttatctctgtctgcagctcaatttcacaggctgctctttgttagaaaaataatgattttggagctgctttttgttaaaagggaagtcttgctcaggactctcttaccctcactatctacctaaataatttctttctagttcttgtataagagtcttaaggtttttctctgtatcatgtcatctacaaacagggacactttgacttcttctgtttcaatttggatgtcttttatttcttctgttgcctaattgccctggccatggacttacagtgctgtgttaaataattgtggtgagaatgggtatccttgtcttgttccaattcttagaagaaaggcttttagcttttcctgttcagtatgatgttagctgtgggtttgtcacatatggcctttattattttcaggtacattccttcctaaataaaggtatttatttatttatttccttcctaaattaggtaattcctatgtaaatacctaatttaagtttttatcttgatgagatgttgaattctgttgaatgcttttgctgcatctattgagatgattgtatggtttttgtccttctatcgatgtgatatttgatgtttattaatttatgtaggttgaaccatccttgtagcccttggataaatccttcttggtcatggtgtgtattgttctgatattgttggattcattttgctagtattttgttgagcattgttgcatatgttcatcatagatattggcctctaggttttttttttttttttttttaatgtccttgtctggttttggtatcagtgttatgctgacctcatagaatgagttaagaaaatcccctctccttcagttctttgaaataatttgagaagaattggttttaattatttttgaaaggtttggtagaattcagcagtgaagccatctggtcctggacttttctttgttgtgagacttttcatcattcattcaaaatcatgaattttgttggtattttcaacttttctatttctttttggttcaatttctaggtttcatgtgtacagaaatttattcatttcctgtaagttttcaatttcttggaatatagttgtttatagtagtctctaatgaccctttatgtttctgtgttattttaatgtctcctgaattttcacttctgattttatttatctgggtcctctctctttcttgtttggtctagcaaatggtttatcagttttctttattttttgaacaagaccaacattttgtgtcattgatcttctgtattattttagtcctgatttcatttcaataaagatcatgattgccatgatctttatttttttccttcttctaattttggattttttttttcttactttgctaattctttgtgatgcaacattagggtgtttatttgaaatcattctgtttgttttttttgatgtagatgtttattactataaacttccctttcagtactccttttgctatatcctataggctttggtatgttgtgtttctgttttcagcagtctcaagtaatttttaaatttcattcttaatttctttcttcacccagtgttgaggactatattgtttaatttccatttattcacattgttttgaatgttcctctttttactaatgtctagttttattccattgtggtcatgtaagatagttggtatgattttgatttttaaaaatttgttgatatttgctttgtgtcctaccatatatggtcattcctggagaatgttccacatgctgatgaaaagtatgtgtattcttcagtacagtgttctgtaaatgtctgttagatccatttggtttatgctgcagtttaaatctgatgtttctttgctgattttctgtctagatcatctgtccaatgctgagagcatggtgttgaagtctccaagtattattgttttggggcatatttctctttttatatctaataatattttccttatgtatctaagtgctccaacattgggtgcatgtatatttacaatttatagtctcttactgaattaatccctttcttattgtataatatgcttctttatctcttttacagcttttgagttaaagtctgctttgtctgatataagtgtagctactcctgttcacttttgctttctgtttgcatggaatatcttttttcatcccttcacttttagtctatatatgtctttccaggtgaggtaagtttctcttaggcagcatattgttagttatttttttaaaaaataccctcagacagtctatatctcttaagtaagggaattcatttactttcaaggttattattggaaggtgagaattattcctatcaatttattggttgttttctggttttcatacatcttttcttcctttgtatatcctttctatcctttgttcctttcttcctctcttattatttatttttgtagttacatggctttttgtagtgatatggttttatttctttctctttctccttagtgtgttggctctaccagtgagttttataattttgtatatgttcattatgttggttatcatcttttctgttctagatgttaggctcctttgagcatttattgtaaggctagtctattggtgattaatttcattagattttgtctgtggaagatattatttctccttaatttctgaaggatagcttttctgggtataatatttgtggttgacagttttttgttttcttctcaatagtttgaatatatcattccattcctcttggcctttatggtttctgctaagaaattcactattgctgaaatggggattttcctatatctgactttatgcttttctgttgctgcttttagaattctttctgtttgattgttgatgatttgagtattgtgtgcattgtagaggacctgtataggctggatctatttggtgttctctaagcttcttcgacctgcatgtccatttctttctgaagacttgggaagttttcaagtgatttattaaatatttctagacacctgttcccttctgttctcttttgtagttcctataatacaaataggttttcactaaatgtttcttgtaaatgctgtaggccttcctcactccatattctattttatttttgttacctgtgttatttgcttttaagtccagtgattcttctagctgggcatggtggtgtgaacctgtagtcctagctacttgggacactgaagtaggaggatcacttgtaagcccaggagatcgaggctagcctaggcaacatagcaagatcccatctctgttaaaaaagaagaaagagtaattattttttctgcttagtcaagtctgtggttgaagctctctgttgcatttttaaagttttattcattgaattcttcagatctaggatttattttgttctttttttctgatatctctgttgttgaatttttcttccaaattatgaattgtttttcttattttgttgaattgtctatctgtattctcctatatctcactgaagttccttaagattattttgaattttctttctgatatttcatatgtttacttatgttgggttctattagtggagaaatattgttttcctttggggatatcatgttttctttgctttttcatgtttgatgtattcctacataaaattcttccaattttatggagtaggttttgtatggaaagaattattagtatgaatgggtcttggggtattagttcaatggggtgtattggtattggttctaggtagatgaagtagtgtagtctccatgtagtttcttcagctataatccacattagtgacatagtagtgacattttcaagtgtcttggtagcctttgcaaagagagtttgtagcagtggtgatgtggctttgttggagagtgtgctcaccttgctgtttctcagattacgggcatgtgagtacacacagtgggtagggcaacttgcattctggcttgctggggttgaggtcataggactgtcactcttggagcataggcatgcagtcacttggctgacctgggggcttgcctgtcaggaacaacctatgagattggttttcaagcttaagatgtgagtgtatagctgctcagttggcctggaaagattttttccagggttggcctttggggctgtttttcaggcccaggagacaagttgaaggctgcttggctgtcctgggggcttgcttgccaggaacaacccacagggctatttcttaatcccaggatgcaggtgcattgctgctcggctggcttgggggaatatctgctgggagtgcctcatggggtcgtgtctcaggcccaggatatgcttatatggctttctggcgagcctgtgggtgtgcctgccaggggtggcctgtagaggtgtttctcaggtgctggatgtggactcatggctgcttgtattgcctggaggcatgcccaacagtggcagcctgtggaactgtttctaggccctgattgccagtgcaaggcttttaggcaggccaagggcctgcctggagaggttgcaatgtggctgtttctcaggccctgagtgcaggcatgtagccgctcctctggcctaggggcgtattagctgcacagagtctcaagggcctctcctgcttgggggagggcatgcaatggtttgactggcttggctggctcaaggaccacattgtcctgtgtgggactgccagaacattcctttggctcagaagtgcagtggtggggattggtttccctgctgtgtaggaccagagtcacagccaatcctggacctaggctccattcagctggggttgtggcattcagccgcctgtgtgggcttggtggaacgaaaatgaactgcagtactggagagatgcagaggctactggacacttgagcaaggtacactccagaggtggctctggtctcaacatggcaccatgctgcagcatcttggctcaagggcttgagtagggaatgagaagtgcacaccttgtattcttaattgagggcaatgcagctgagggaattcctggcagcttctaaactgggctcagagcttgtaaggactgtgggattcttctgtagtaaggattataggtgtttttggtagcaatgggggctggtggggatcttctccttacctattccctataacacgaagtcactgctgatcctaaacagatccaatccaggtggagaagacagggcaaaggctgggtgcctccatgctgcctttctggacttccattcaccacaggtgcatctccactcccccactgcactccagcactctcccttcgacactccagtcaaagcatagctctttattcattgtctcaatcctctcttgtggtagggatgagcaccaggtgtctctagtcagacatcttgctgacatcactgctgaaatttttgtatggacactcagtccactgttactgccaaccctaatttttgtgatgaaatatattaatattagcatgtatatttctcatgagtatcaataatggataatctaatttctatccccagtttctgtctatacagccaaagccctcttccccattaataaaactgatgaattaattatatcctttggcttttataaatattaaaatattttgaagtggatattgcaatatggtacttcttggccttaagttttttttttacgtctgggattaatagggtaaagaaaaactatactaatcatatttatatgaacagttgattcaggaaactacttttctgtgaactgtagctatttttctgtgaaggatagagcagtagttattcatttggtatacatttattactttcagtgtacttggcaatctactgctttctgagattacagagatcaaaagacaattgctgttctcaaagagcttagtggggagagaaacaaacacaattctactgaaatgtgataattgcaatgatagatgcacacagggtgctatatgaagataaagggtaggcatctaacgagtaatgtggacctaagaataatttcctagaggagtgccctagctatgtcttacaggatttggagttggccagcacatgaaaatattggtaaagaggccagagaaatgcctaagtcttttctcttgtcttgagagctactagcttaatggctagaggataagatatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgtcttaaaaaaaaaaaaaaaaaaaagggacaattaccaatgaacatgtgaaaattagttctcactaccacttatgcagagcttattattggcagattcaaattccctgatatttagaaagtactgatatttgatattagaactctgttgttttctttcttgcttaagacatattatttttagttcttacaatataaccttgaaatgtgcttttttgagattgcatatttcaagattgttatgttagtgttcactttttcttccctattataaataataatgattgaactaataattattttgaatgtgtgatgaacttagacttgataagttcatcacacattcaaaagttccatttgctaaggaatgtgatgctaactagcatgccctgtaaatgaagaatgttttggtttatcagaaagctgaacttcagcaagatttcaaaggtggagacttctgcaaggtgacattcaattatgcatatctttatataaaatgaattctgagtcattacagttgtataaactgaagataacccttttttggcaaataaagattgacaaattcatgcactttatagagatatcttgggtcaaatgatcatttacttatcagaaatggctaatgaaatgttacagtgatttatggtgtgctgcagtaaattttcataatatagttatttatcttacataagataatgaactgcctgtccagttcatttactgagtaatagttactttaaatgttttatcagcagctccatttttctgttttcctcctcttcctctcagatttttatcacgatgagttagggagtaatatttcattttaaatgacttgtcttgactatagatagttcagggatataggcagaattgctgtcatgtgaaacacagttgttaatctgaaatatctatgttgaattgactcctgctgttattatcaagagctataagaatgttttaggtttttgcttattaaaatatttttcagaataatatatgaaatatatgctggtcacaatgtgaagcagcatgtgtgtttttataattagaagcattatttattaagtaccatctttgttttaggcactgtgctgatgatggaagataacaatttttattctaatgaattttgtttagcaaaatttactgattacctactatatgtacagtacttgggcaatatcagatctattgtcataacaagaatttataagatatttaaattttatccaagaaacatttgttgagtgtttactatgtgaaatttattgtatttgtactctgcacacatttctaggtgtggctatcttttaagatctctaggactatatgcacatcataattagaataaatactggatataaatatcttatttctatgttgttaatgtctaaggtggagaaacatttttctctatcctggtactccataatgtttaaaaaaaaagaacaatgtggagttttgacatcatttcacattgtaatataatattggtagcttagtattttggaaaataaatctattatcatatatattaaaatagagatgtttataatataaaaaattgtaaagattagtaacttggatcatgaatatatcatttttaatataagaacattttaaaattgagtaattattaaggttataaatatggtaaagatttttatttcaagttaattttgaaatattacagcattaagaatagttatgtagtatttgtcaatcttagttaaattataggcacgagcatcagattttattacttttgttgttttttgttaataaaattatatgacataaatttatccaaaaatcatatagaagtccagatttatttgtagacgtctgagctaagagagaggcagttattcttctgtaagtctttttgctaggtcttgttatgaagtcttcactcagactctatatattgtttgttgattttattttctagtttcacaatgcagataatggcaatttatctttagagtcttaatcctataactgattacattgatagtagtaatagtaatagaagcagcagcagcaataacaatatgttaagtttttaaataatcctaccttatcagatagataattatatctccactttatagaagagtaaactgaggttcatgaaggctaaataaattattccaatcatgtagctaaatataaaacctgtgttttaaaaacagtgttctattctacatcattctccaaaatatgctataattgttaattattcttagtactaaaactcattagaaaggcagctttatatattttcaaatataatttttaatgatagtgaactatttgctaaggaatatgccatatttttacatctaactttctttgaatgccccttttcctgttgtttacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttggtaagtagtccagtaaattagcattcctttaaaagtatgtttcccacccatcttctcattccttccttctagggtgtagtcttattctatgatatttatgtaaattttatttttatacacattcttccccacttactattagtgatctcagcattaacttgtgaaaataacataatattattattttatgcaaactttgttggttcaaatagtgagattgtggttgtagttacttataatatgacaataatctattcttaattcattaatgtcttttacttttatcatgatagtgtttgggaagaagatttgcttttaagattaatggctaattgggactccttttactcttgtagacatatttcagttatcaagtaaaaagaaacatttttgttacatcttctgaaatggatttttgttaagtaagaaaggaatattgaattcttttcttttaaatcttatatttttatcatggtaaaatgtacttaaaatttaccattttaaccattgtaaatgtattttaatgccaattcaatggcattaaatactttgacactgttgtgcaaacatcatcaccatttagctccagaactttttcattttgcaaaactaaaaatctgtacccattaaacaataactctccatttcctccaccccaccccctacagtccctagcaactactgttctactttctgtctctatgaatttactacttcaggtacctcatatggtgaaatcatacagtatatgtgctttgtgactggcttattcccttagcataatgtctttagggtttaaccaagttgtaggatatatgagaatttccttcctttttaaggttgaccaatattacattatatgtaaatactacattttgttcatccattcatttatcaatggatacttgcgttgcttctacctttttgctattgtgagtaatgctgctatgaatgtgggtgtatgaataactgttcagcttcttgctttcacttctttggggtatatatatatagccagaagcagaattacaaaataatgtggcaattctgtttttcacattcccaccagcagtgcacaaaggtttcaatttctctccatccttgccaatatttatttcctattatttttaaataatggccatcttaaaggctgtgataaatattgtatcttgtgtaatattttatgataagctgtatttttattctttgtttatatcaaagacatgttcacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaagcattttggggcaagaatattttatcaatgttggtatatctgctacaagtatagaatgcacagtcttgaaatcacatagagttatgtcagcagggcagtactgggcttgctatgagttatacttcaggagaaagattttgccccttgctgatctctcatgttttctaaggactataggataaggctgcacctgaatgaatatttaatactgggtactatgtggtgagagtggccttgcttacaaacacaaatggcgtcagaatacagctgccaagggaattgcataatgctactgggagcacttgttagccttgtaggaacttaagaccgtgtgaaactctttctgcttgggagaaaaaagtgccaatcttagctagcttcttcatagcagagaatatggtttatctttctgcaatccactctttgacactgacgctcatcaaaaatatgccttttcacctgaattaattggtatgttcagatttggaacaaaaaagtagaaagttttacttactcctgctgctctcatgacctgtttctcaatgttggttgcattcattcatatcccactcattggtatctgtccctcttgtaattaatccagactttatgtccttttttttttgaataatatacttttcaggggcccagtagttaccattctaccaccatagaaagctgcagaatcacctgagataaagttggtatgcaggtttttttttttttttttttttgagatggagtctcactctgtggcccaggctggagtgcagtggcctaatttcagctcactgcaacctccacctccctggttcaagtgattctcttgccttagcctcccaagtagctgggactacaggcatgtgccaccatgcccagctaatttttgtactttttttagagatggggtttcactgttggccaggctgatctcgaactcctgacctcatgatccacccagctcggcctcccaaagttctgggattacaagcgtgagccaccgcgcccggccggtatccaagtttatgtccgttgaggatgctttgatttgaacaaagcaaaatatcagttatttggtaaagtccaaacagacaaataaaatcagaagttcttttgcttctttttcagttcccttcttctcaacatctgagtgtccaggaagctcacaaagaaaaaaggagcaagactccttggatttttttttcttccaatactttaacctgcagtaaacaggatttgaaatgagtgaatctaattaacatgttggtgtgtttgatccaggttccaaagaaactgtagttacagttcagtcaaaggagacaaaataacagccacttggagtctggtgtatctattaaactcaggaatatgttgtggttgaaatgtattcaatgagatagggaaagcaacagtttccctctctatacaggaattctctccaggggatctttatcccgattctaattcctttctcctaacagccctaagttctccactatcatcatctctcttcatttgtcatatttgaaacttttaaaggtcaaaggtccattttaggtttttgcatcagtccactggtttccctctgaccctttctctccaggaaacagccacttggagttttcctaggagtgtaggccataacacagcttgtttctataacgttcataagtatcttcaggactttcttattagatcattgactttcttgcagtccctccataggagcagccactggcagcctgactgatgaaaatacaaacaactatcccagcagcaatatttattttctgcccgtccactcttccttccctcctttgagctttcttgtttttcctctgagaggcaacccattctagttagcaattatagtaatgatatggctcccatgagtggaggaacaccagggctcttgtctcacgttgaattagattaaacaatacggacacacgtggagtggttttaaggagcagagagtttaataggcaagaaagaaaagaaaaggcagaaggttcgctcttacagagacagagggatgggggctccacagccgaaagaggaaaccccaagtgtggtgcgtaccaggcaggtatatgtagaggctggaggagggggtgtctgatttgcatagagcttaggggattggtttgaccaggctttcattcaggtagccctcggaaaaaaactggccttcccaccctagccttttaatatgcaaatgcagggcaccatgatgttctacacacatggggatatgtggggcggccatattcccaaatacatgtggggcaagggcaagaggacaaaggtgggaatcgccatgttgagtggacccagtttctaatggcttgcatatgcatactaaaggttgccggcttggctctaagagctgggacttttctgttagacaagaaacacttttggaggtgttttaaaaagaaatgaaaactttccaaggactccttttttctctatctgcctaaaataatttcttaataacttctatcacagtaacttcataattctgagatccctgttggtggtaaatctagtatgttgaagcctgtaagtgtatggcccttggacaacatggtcacccagttgatactagtccttcttgctcagatgagtcatcttcccatttagaggtagccactgcataaggcaatgcacgtagagacttactgactttctaggcctttcatcactctcagtggtccagtcaaatatgtatttggtccatagtgggcaccactgttacttgaagagctaaggcaaaacagtaacacaatgcaggctggaatcccagctgcagctgttgtgttcatttgttccttcaggctcttggcatgaagtggagaggtatgcctgggatggacatggttggatgtattatgagttgagctccctgttgatatccttttttagggattgtggtaaggaatgggggtgttgtacctgatcaagtgggtggcagtgtggtggttgcaggcataaaatggcctttgtgcatagcaaaacatttcaaaactaggagccagctgcccaggagagttgaatacaagagttgaagacttgtggggaatgagacaatgcgcaccttctcctgcctcaatagtcatgcttgtctctcgacaaacattattgttcaatgaaagaagctagacatgaaagattacatactgtttgactacatttaggtataaagttaaaaaatagtcaaaacggcactgtattgtttagaaatgcgtatttaggtggtaaaactatagagtaaggcaaaagtgtattctcaaaaatgtcagctagaggatgttgctgggggaagtttaggggtgctgattaggaaatgaaacaagagaggcaatgctccacttctaggctttgtgcaggtccagagtgtgtgtttataggaatttattaatcttatatttttctttatgtaattgtatgtgtgttatatttcacaataaaagaggctagaaagtagggaaaaactggtttgtgaaagtctaagctcttatactcttaacaactttctaaaaattatttagaattaagcttatgttgtcacaaatttttcttatatcccattccttctcatttgttctacttttttgtttttttacaattttttttggtggtataacacacataacataaattttaccattttaaccattggtaaataatctttagtaatttctttcaaataaattgtgacataaacttttgagtctttgcatgtctaaaagtgtacttttcattttcacttgaatgataaaatggctaaatgtggtattccaaataattttttccttggaacctctttagcactcagtgttgtggataagaattccaatgccaatctaattttcattcctttgtggaacatcttttttatcccccctttgggagcttttaagatttttttctttcttgttggcattctaaaatttttcattgttttaattcagtttttcagtgattgatgtggatctttaaaattaatttttttttacagtttttcattgaagaaaaggatttttagattttttagattttctcattggctctttaaatctgaagagtagtttgtttcttcatctgctaaaaatgttgtgtaatgtcttaaaatacatgttttcttctctttactcttgttgcaaatattaaaatagttgctggaacttctagatatatcttaatatttcttaactctgtttgcattttttgtatttttgtttgctaatatttagctatttttctttttataatcctttgagactttttatttatttgaaataagttttttgagaacaatataattatacagtgcaaatataaaaattgttgtaactgattttttttgagaaggttaatgaaacataattcactattttaacacaggtatgaattaaattctaccactgacaaatcaaataatgataactaaataccgctggtgggattgtcagctaggcaagcataagtcaggtcttcaggtctgccattgtctctcttgtttttgatcttttgcttcttttgttttcttgattattatagaggcttcattgtctacttctaccatttgttccttgagcagatagtctagtttgctattttttctcctctatagttcctttctctgttctgttgtcatgttcgcctttcctgaagctgtgtatagatcatttgtgctgataatgtccaatactactctaacagttatttctatttcacagggtttttttgttggtttttgtttttttgagacagagtctcgctctgtcacccaggctggagtgcagtggcacaatcttggcccagtgcaatctccgccttctgggttgaagcaattctcctgctgcagcctcctgagtagctgggactacaggtgcctgccccatgcctggctgatttttgtgtttttagtagagacggggtttcaccatgttggccaggctggtcttgaactcctgacttcaagtaatctgcccaccttggcctcccaacatgctgggattacaggtgtgagctactgcgcccggcctccacaggttttttattatacaccctgtgtgtcgttgtggggaagaagggcattgaacattgcctcaaggagactttgtatttctgaaagaagtagttacctggcagtgatccactgtttgtgaataatgaactccttcattatgtttaatttttcccgtgtttttaaccaacagacatttgtagagtagtgaagaaatgccaggaagtacaatagggactaggagtaaaatgacattcttgttcaaaatacaagttaaaagtagctgagtgttactctttcataggtgtcagcttcttggcaatggttttagtgtgcttttgactttaactttatgacttttcaggataaattatatatatttacattatcgttttctactacacgtctattcatttaacatttgagtctttaaaatatttttatacttatcaacaaaactttgtattggaagtggtcttttagttgccttcagaaagttgcctcaatgttcatttgaggtttactggtaaatagaaattaaggcaaacttttctttggaaatgagaaacaaataggattttgcaatattctccagtatttttcagtcataatattgtgatatcattgtttaaaattcacgaattgaagagaggaaatgttttttaagataatttttgactaatggtttctgagaaagctttgctaataattggcattattagtaattgatatattttgggtagacagatattctacttgtgaaaatgaattccagggcaatgtttaaagaaaaataggagatttagtcccaaatgtataaaggttcaaatgaaaattcaattaaatttgtatagtaaaaatagaataatacacaacttgaggataaggtgttatctcacaaatctgtatttttttcagtatttgtaagtttatgtgttcaatttaaacacttcaacaattaaggaaggtaatcatttttaaaatttgatgacaatttcttacagattgattttttaatattcttacccatttgaaaaaccattttgaatattttacaacttgatcttttgaaaagccaaaaataaataaacaggattgctccaattaaccatatttcatacaagtccttatactacacataactttaggaacaatagcatagcctgcataaggtttctcatatattatctattttgctgtgtagaagcttttgagtttaattaggttccttttatgtatttttgtttttgttgcatttgattttggggtcttagtcataaattgcttatgccaatgtccagaagagttttcctgaggtttcttccagaatttttatggtttcaggtgttagatttaaatctttaatccatcttgagttgatttttgtatatggtgagagacatagattcagtttcattcttctacatatgttgatccagctatcccagcaccatttattgaatagggtgtcctttcctcaatttatgtttctgtataatttgccaaaaaatcagttggttgtaagtatttggctttatatctgggttctctattctgttccatttttctgtgtatccccatttttctatgtatctacttttatacaaatactatgatgttttgattactatagtcttatagtataatttgaagttgggtaatatgatgcctccagatttgttatttttacttaggattggtttggctatttaggctcttttttggttctatatgaattttaggattattttttctaattctgtgagaagtgatgttggtgatttgactggaagtgcactgaacctgcagattgttttgggcagtatgattattctcatgatatcagttcttctaacccctgagtgtgggatgtgtttccatttgtttttgtcatctatgatttctttcagcagtgttttgtagttctccttgtagggatagtttacctgcttggttaagtatattcctaggtattttatttttgcagctgttgtaaaaggggttgagttcttgatttgattctcaggttggtcatttttggtgtatagcagtgctactgatcagtgtacattgtttttgtaaccttagactttactgaattgatttatcaaatctaggagtcttttggagggctctttagggttttctaggtatacaatcatatcaaagtctttagggttttctaggtatacagtataaaatcacttcatagtctttagggttttctaggtatacaatcatatcattggcaaaaaagggtagtttgacttccttgtttcctatttggatgccctttatttctttctcttgcctgattgatctgggtaggatttccagtactatattaaatagaagtgacgaaagtgggcctacctgtcttcttctagtacttagaggtaatgcgttcaacatttccccattcactgttatgtttgctgtgggtttgtcatatatggcttttattattttgtggtatgttccttctctgcctagtttgttgagggtttttaattataaagatatgctggattttaatgaatgcttttcctgtaattatttgagattatcatatcacttttgtttttaattcattttatatgatgaatcatatttattgacttgcatatgttgaaccatccctgggatgaaacctacttgatcatgatgaattatctttttgatgtgccactggattcagcttgctagtattttgttgaggattttttcatttatgttcatcagggatattagtctgtagttttcttatgttcttccctgactttgctgtcagtgtgatactggcttcatagaatgagttaggaaaaatttcctatttctcagtcttttgcaacagtttcagtaggattggtaccaattctttgaatatctagtataattcggctgtgaatcccctggcccttgactttttttggctggcaaattggtattactgattcagtcccgctgcttgttattgatctgttcaggattttgatttcttcctaatttaagctaggagagttgtgtgtttccaggaatttttccatttccactagattttctagtttgtatgcatagaagggttcagagttgtctcaaatgatcttttgtatttctgtgatgttgtttgtaatgtctccattttcatttctaattaaacttatttgaatcctcttctttgttaatctagctaatggtctatcaattttatcttttcaaaaagactagttttcatttcattggtcttttgtattttgttgctttcaattttatttagttctactctgagatttgttattttattctgctggctttggatttggtttgttcttgtttctctagttctttgagatgtgacattaggttgtcagtgtgtgatctttcagactttttgatgcaggcatttagtactataaacttttagcaccacttttgctatattcaaggtttagataacttatgtcacagttattgttctttttgcagaatttaaaactttccatcttgatttaattgttaaccccaaaatcgttcaggagcagattgttaaattttcatgtatttacatagttttgaaggttccttttggaattgatttctagtttcattctactgtggtctgagaagatacttgatatgatttagattttttttttttttttttgagacagagtctccctctgtggcccaggctggagtgccgtggcacaatcttggttcactgcaacctccacctcccggattcaagcaattctcctgcctcagcctcccaagtagctgggattacaggcacatgccagcatacctggctgctttttgtatttttagtagaaaccggtttcaccatgttggtcaggctggtctcaaactcctgacctcatgatccacccaccttgtcctcccaaagtgctgggattacaggcgtgagccactgcgcccagccgattttgattttttataacttattgagacttgttttgtggcctgtcatatggtctatcttggaaaatattccatgtgctgatgagaagaatgcatattctgcagttcttgggtagaatgttctgttaatatctgttaagtccatttgttctagagtgtaatttaagtccagtgtttctttgatgactttctgctttgatgatctgtctagtggagtgttgaagtcctccaccattattgtgctgctgtctatctctttcttaggtctagtattgattgttttatgaatttggcagctctagtgttaggtgcatatatattttagattgtaatatcttcttgttgcattgatacttttatcattatataatgaacttcttttttttttctttactgttgttcctttaaagtctgttttctctgatacaagaatacctactcctgcttgcttttggtttccattggcattgaatatctttttccacccctttaccttgagtctataagaatctttaaatgttagatgtgtctcttgaagatagcagatatttgctttgtggtttttcatccattctaccagtctatgtcttttatgtggagcatttataccatttacatgtaacattaattttgagatgtggggtacatttctagtcatcatgttgattgttactagttactttgttttcttcattgtattattactttataggccctgtgagttttatactttcaagaggttctattctggtacatattgacctttcattttaagatttagaactctttttagcttttcttgtagggctggtctggtagtgacaaaatccttagcatttgcttgtctgaaaaggactttatttctccttcatttatgaaagttagttttgctggatacaaaattattggctggcagttattctgcttaaggagggtaaagagagaaccttgatcccttctggcctgtaaggtttctgctgagaagtctgctattagtctgataagtttttctttatagattatctgatacttttgtcttagtgctcttagaattcttttattcatgttgacttcagagagaatgatgactatatacattggtaatgttgtttgtgcaatgaatctctcaggagctctttgagcttcttgtatttgggtgtctacatttctagcaaggccaggggtgtttttctcaagttattccctcaaataagtttttcagatgtttttctctttcttttacctcaggaacaccagtgattgttaggtttggctgttttacctaatctcatatttcttggagactttgttccttttttaaattattttttctttatttttgtttgattggtataattcaaaagctttgtctatgaggtctgaaattatttcttctactttgtcttagagtagtatttgtctaagacaaagtattgttaaaactatccacttgcattttgcaattttctaaatgtgcctttcatttccagaagttggtttctttttttaaaatgtattattttgttaaaatttttatttatatcctgaattgtttttttacattttcttatgttggttttcacttttctcttttatctccttgagtaacatagtagtcaaccttctgaattctttatctggcatttcaaggatttcatcttggtttggatctattgctgaagagctagtgtgatctttttggcagtattataaaaccctattttttcatattgccagaattatttttctggttccttcttatttctgtaggttcttataattatttttgaatttatttttgattcaactgtgcttttttcatttcttttttccccttgagaatgtgactttaatgtttgtagtttattttaatctaatttggctcttggtgctttcagtcatgaaggctctgtatgagttccttggtcatagagagccttttcatggtggctttctcagatactggttgtagtagtgatgtgctccatttataagtaggtgcactgtctcctgtggggttggaatggcagaggtatcatgaagcttatttcattcgccagtggcgtgtacttatttatttatttatttattctttccccagtattttattcactgggttgaacaattcagactttaggtcaataggtggtgtccacaggtaaaatctggctgttgctaaagcaggtatcatgatcctttcttaagaaaagatagttttaaaataaaacttactttcttaggaaatacctgtataacaatattagaaaatttgatttattcagggtgagtcccactaaagatttactttctcctcacgtgatatatgatacaaatcattacatgatagtaaataattggaatgccaagccaatattactaattagatattttcccttatgtcctattgatagcatagtaacccaatatacttttgaaaacaattagaataaactagttaacaatactgtgggctaactgtaatcatagatatacaataaatgttttaaaccaacaaaactaaggagggacatggtaaataggaaatgttcagttatctaaggatttttaaaactgtgtcatttagcgctgtgtactgttgaaaaaatgtaagattttaaaggaagactgtgtcaatgaattatttatctacaaatttaacattagccacttttatttaatgactcaaagagtattcttccttttttatttcttattaagaaaatacaggaggtgatacgtactctctaccttcctatgaaggcatgagatccttacctctcaaaggattgacaactacaaataatgttataattggtaaattttttaaatccagtattctattatctgtgcagagtcaacgatatcaagttcctgatattcactgagaaatttgtgccattgtttgtagttttcttaggaatgtttttgttttaaacactgagtggcagctgagccattaacattatacaatgaaattgagtctgccagaaatctaccattttttcttccattgttttttctttcatgtgactagaagacatcattcatgatgccgtgtatgtctgtcagtatcttctatttataaacaatccccaagacaaaatataatattcctagctaaataatagtaaaagtaactatgtaaataggaaaagactctcagcttaatgtaagatgctttggttgttaagtaaaggtttaaaacatttcatagcaatggctatgtctgtggtgtttgactataatgtctgcttatctttggcaaacttcaccatattcataggctttgttgagtctcataggttatacctgaatcaaaaaacaaaaagacaaaaaaccaacaacaacaaaggttgagtatctgcaaatgagtcatggagtgttattttatagccctgaaaactagaatgtgtgctctggttgcctggctgaaggagagtaccaggttttcatgttcccatccagcttggctttttggatgagattaagtttattcatcacatagtagccaaatactagtatcttggacccttgtgaggagcattgtccataataggtagtccaaatatagcccagcaatctcaggaaatgggcagacgtcacttatactggatgtccacaggcagaatacagagttctttcattgaatgtccttacgaggcacaataagaatggctaacatggatttatatcacagacaataataaaggtggtctgtagggccctaaaagttctagtactgccaaaattttcaggggtcttcaattactgattttatttttctccatgtcatggttaaccacaccttttttcactcctgtggtggcctgtttatctcctctttgtttgtgatgtatgttttatttgcttttagtaattgctgtctcttaagtattattgcaaaaatgtttgcattaactatagatgacctttcatggtttttatcatgatcatatttattttttattagcctataattctgtttgaatatatagtcatgttaacatatttgtcaatgttcctgtcacgcagctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccaggtaataataatgtaatggaaacaatttcagtttctgcttaagggatccaagaaggagtttttgttcttataataaagaaaatttagctttaggaaaaaagcagaatgaaaatgagactaaaatgtcaaagataaaaaattattccatagactatatctatctcagtttatgcaggtggtattcagtttagaatcattagataggctaaatgaattcatggaatatcatgattagctttcatttcttttttaatattttgttatttagtttaagttttgggatacatgtgcagaacgtgcaggttacataagtatatgtgcaacatggtggtttgctgctcctattgacccatcctctgagtttcttcccctcacccccagcccggcaacaggccctggtgcatgttgttcccctccctgtgtccacgtgttctcattgttcaactcccactttggagtgagaacatgcagtgtttcgttttctgttcctgtgttagttggctgaggatgatggcttccagcttcatccatgtccctgcaaaggacatgatctcattactttttatggctatgcagtattccatggtgtatacgaaccacattttctatatccagtctatcattaatgggcgcttgggttggttccatgactttgctattgcaagtagttctataataaagatacatgtgcatgtgtctttatagtagaatgatttatattcctttatgtacatacccagtaataggattgctgggtcaaatggtatttctggttctagatccttgaggaatcacagtgtaaaaacaagcctctttctccacagcctcgctaacatctattgtttcttgactttttaataatcgccattctgactagtgtgagatggtatctcattgtggttttgatttgcatttctctaatgatcagtgatgttgagctttttttcatatgtttgttggctgtgtaaatgtcttcttttgagaagtgtctgttcatatcctttgcccagttttttacggagttgttcatttttttcttgtaaatttgtttaagttccttgtaaattctggatattagacctatgtcagatgggtagattgcaaaaattttctcctattctgtaggttgcctgttcatgctgttgataagtttcttttgctgtgcagaaactctctagtttaattacatcttatttgtcaattttgacttttgttgcagctgcttttgggattttcattatgaagtctttgcccatgcctatgtcctaaatgttattgcctaggttttcttctagggttttttatggttttgggttttacatttaactgtttaatccatcttgagttaatttttatataaggtgtaaggaatgggtccagtttcagttttctgcatatggctagccagttttcccagtaccatttattgaataggagatcctttccccgttgcttgcttttgtcaggtttgttgaagatcagatggttgtagatgtgtggtgttatttctgaggtctctgttctgttccattggtctacatctgttttggttactgtagtcttgtagtatagttcgaagtcaggtagcatgatgtctccagctttgttctttttgcttaggatcgtcttggctatatggggtcttctttaattccatatgaaatttaaagtagttttttctaattctgtgaagaatgtcaattgtagcttgatgggaatagcactgaatctataaattactttgggcagtgtggccatttttacgatattgattcttcctctccatgagatagaatgtttttccagttgtttatgtcctgtcttatttcattgtgcagtgcttgctttgtagttctccttgaagaggtccttcacatcccttgttagctctatttctaggtattttattctctttgtaacaattgtgaatgggagttcattaatgatttggctctctccttgtgtattgttggtgtaaaggaatgctggtgatttttgcaaattgattttgtatcctgagactttgctgaagttgattatcagtttaagtagtttttgggctgaaatgatggggttttctaaacttaaaatcatgtcatctgcaaacaaagaaaacttgacttcttctcttcctgtttgaataccctttatttctttctcttacctgatagcccttgccagaacttctagtaccatgttggataggagtggtgagagagggcattcttgtcttgtactggttttcaaagcaaatgcttccagcttttgcccatttaatatgatattgctgtgggattgtcataagaagctcctattatcgagctgtgttccatcaatacctagtttagtgagagtttttaacatgaaaggattttgaattttatcaaaggccttttctgcatctattgagataattgtgtactttttggctttggttctgtttatgcgaggagttacgtttattgatttgcatatgttgaactagccttgcatcccagggatgaagttgacttctggtggataagtattttgatgtgctgctggattcggtttgccagtattttattgaggattttcacatcgatattcatcagggaaacgggccagaattttctttttttgttgtgtctcttcctggttttggtgtcaggttgatgctggctttataaaattagttagagaggagtctctccctttcagttgtttggaatagtttcagcaggaatggtattaggtcatctttgtacctctggtagaatttggctgtgaatctgtctggtcctgggctttttttggttggtaggctattaattactccctcaatttcagaactgttactggtctattcagggattcagcttctttctggtttagtcttgggagggtgtgtgtatgtgtccaggaacttatccatttcttctaggttttctagtttatttgcataggggtgtttatagtattctctgatggtagtctatatttctgtggggtcagtggtcatatcccctttatcatttttttattgtgtctatatgattcttctttattttcttctttattagtctagctagcattctctctattttcttagtttttcaaaaaaccagctcctgaattcattgatgttttggagggtttttcatgtctctatctcttttagttctgctctaatctcagttatttcttgtcttctgctagcttttggatttgtttgctgttgcttctctagttcttttagttgtgatgttagggtgtcgatttgagatctttccagctttctcatgtgggcatttagtgctataaatttttctctgaacactcctttagctgtgtcccagagattctggtattttgtctctttgttctcattgttttcaaataacttcttttctgcgttagttttgttatttacccaagagtcattcaggagcaggttgttcaatttccatgtaagtgtgtggttttgagtaaatttcttaatcccgagttctaatttgattgccctgttgtctgagagactttgtaatgatttcaattcttttccatttgctgaagagtgttttacttccaattatgtggtcaattttagaataagtgccatgtggcactgagaataatgtatattctgttgatttggggtggagagttttgtagaagtctattaggtccacctgatccagagctgagttcaagtcctgaatatccttgttaattttttgtctcgatctgtctaatattgacagtggggtgttaaagtgtcccactattattgtgtgggagtctaagtctctttgtaggtctctacaaacttgttttatgaatctggatgctcctgtattgggtgcatatgtatttagaatagttaactcttcttgttgaattgttctctttatcattatgtaatgcctttttttttgtctttttaaatctttgttggtttaaagtctgtttgtcagagactagtattgcatcccctgctttttttttttttaactttccatttgcttggtaaattttcctccatctctttattttgagcctatgtgtgtctttgcctatgagatgggtctcctgaatacagcacactgattggtcttgactctttatccagtttgcaagtctgtgtcttttaattgggggatttagcccatttacatttaaggttaatactgttatgtgtgaatttgatcctgtcatcatgatgctatctggttattttgcacactagttgatgcagtttcttcattagtgtcattgatctttatatctcggtgtgtttttgtagtggttggtactgccttttccattccatatttagtgcttcttttaggatctcttgcaaggcaggcctggtggtaacaaaatcccttagcatttgcttgtctggaaaatattttatttctccttttcttattaagcttagtttggctggatatgaaattctgggttgaaaattattttctttaagaatgctgaatattggcccctagtctcctctagcttgtagggtttctgctgagaggtccactattagtctgttgggcttccctttgtaggtgacctggtctttttgtctggctgccattgacatttttgccttcatttcgcccttagagaatctgatggttatgtgtctttggttgatcttctcatggagtgtgttagtgatgttctctgtatttcctgaatttgaatattggcctgccttgctaggttggggaagttctcctggataatattctgaagtgtattttccagcttgttttcattctccctgtctacttcaggtactccaatcaattgcaagtttggtttctttacgaggtcccatatttcttggaagctttgtttcttttcattcttttgtttctttagtcttgtctgcatgccttatttcagcaaggtggtcttcaaactcttagattttttcttccacttcgtcacttcggctattgatacttgtgtttgcttcatgaagttcttgtgctgtttttttttcagctccatcagatatttatgtttctctctaaactggttattctagttagcagctcctctaaccttttatcaaggttcttagcttcctttagctcagcgtagttttttattacccaccttctgaagcctacttctgtcaatttgtccatctcatcgtctgtccagttctgcgcccttgctggagagatgttgtgatcattcggaggagaataggcgctttggcctttgggtttttggcatttttgttgttgttgttgattctttctcatcttcttgagtttgtctagttttgagtttgagtttcagtttgtctgttttctttgaggctgtttacccttggatagggttttttgtggggccttttttttgttgttgttgctttctgtttgtttttctttcaatgatcaggtccctcttatgtaggactgctgtggtttgctgggggttcacttcagcccctattcatctgcttcgctcctgcccctggagatatcactcaaggagactggagaacagtacagttgggtgcctgcgccttcttctgggatctctgaccttgagggtcagcaagtctgtgtcttttaagtggaaagtttaatttgtttaccttaaaagttactatttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggtatcatacctttagcccaatacaggttttcttgactcacctattttgtgcttttattggcaaacatgttacatttttatggttataggacaaataataccattatatacatatatttaaaaataattccttaaaaatatcaggtaatagaaaaaaggaaaataaatatgcatttcctatttttattattacacagtaattaccagtactgtttttctttttgcatggagttgaactaccgtctgggtcacttgctttccttgaacaacttcctttagtatttcttgtatggctggccttctagcatctcattctcctaattttttaatatttaggaatgtcattatttctccaattttctaaaggtagatttgcttgatagaggattcttagttagcattgttcttttgagtatatattattatactgcttactggcctctattatttctgatttaaaatcagttgttaatcttattgggcttttttgtaagtgagaaatgattttatctctttcttctttcaagattttgtccttgttgctttcatcattttaattataatgggtctttttgtggatctctttgtgtttgtcctatttagagttttttaggtttcttggatgtgtaagttaatatttttcatcaaatttgagttttcagaaatgatgttttcaaataatttttattttcttttctctttctccctcctctctttccagtgtttctattattcatgtgatggtaaaattaatgatgtcccatatgtttttccaagctctgcttacttttctccattcctagttctctctgtattttagattatataatctgtcagtctatctttaagcttgctgattatttttctaccagttcagatcttctgttgaattcttctagtgtatgttattgtacgtttctacttcatttgtttttttcttaaaaatttttatttctttgttgatattctctatttgatgagacattgtcatcatacccttcttcttcaggcatgatttctccctcccctcccctcccctcccctcccctcccctccccttcccttcccatttatttattgagacagagtttcactcttgttgcccaggctggagtgcagtggcgcaatctcagctcactgcaacctccgcctcctgggttcaagcaattctcctgcctcagcctcctgagtagctgggattacaggcatgtgccaccacacctgactaattttgtatttttagtagagacagagttttgctgtgttggccaggctgtccttcaactcctgacctcaggtgatctgcccaccttggcctcccaaagtgctgggattacaggcatgagccaccgtgcctggcccgttattttttatatctttaattatttttgaatatttttgtctctttttttttcctgagacagagtctctgttgcccagcctggagtgcagtggcgcgatctcggctcaccgcaagctccacctcccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgtcccaaatgatgggattttattttttatggacctttttcatggctgaaaaatatttcattgtgtgcatgtgtgtatgtgtatttatttgtttattcacactttctttatccattcatccatgtttggtatttaggttgatcctatattttggttattgtgtgtagtgctgcaatatattaatacattgaagtgctgatgtctcttcaacatactgattttatttcctttggatatacacccagtagtgagattgctggatcatatagtattatatttttattttttttgagaaacctccaactgtttttgatgtaccaatttacattcccataaaaaatgtatagagttcccctttctccacatacatgccagcatttgtttttttcactgtcaattttataatttacccatggctgtttaggagcatgttctttaatttctatctatttgtatagtgtttgaagttccttctcttttcttctagttttatttcattatggtcagaaaagatacttcatatgattttgatatatttaattcattaagacttttttcctaacatattagctaacctgaagaatgttgcatatgcatttgagaagaatgtgaattctgcagcttttggatggaatattttgtatatgtgaagtcatttttgtcataaattcagtttatgttcagtgtttccccatatattttctgccttgatgatctgtcgattgctgagagttgggtgttaacattcccctactactattgttttgctttctatacctccctttggatctattaatgtttgctttctatattaagttactccaatgtgcattccatataaattctcgattgttctatcctcttgtattgatccctttatcagtaagtattgacctcatttatctctttttatagtttttgacttgaagcctattttgtctaatagaagtatagttaatcctacttacttttccatttgcgtgcaatatgtttttgcatctcattactttaagtctatgcacattcttaaaggtgaattgaatcttttgttggcagtatgtagttgggtcttgtttctttattcattgactcactgtttgtcttttatttggagaatttaagccctttacattcaaggtaattattggaaggtaaggattttgtactgccatattgctacttgttttctagttgttttgtagaacatttctttctttcttctcttactgcctccctttgtgttaagtgattttctctagcaatatgatttgatttcttgctttttatttttagtgtatatattgtaggcttttgttttttgcttaccttgagcctatcaaaaacatcttattattttaaaaggctattttgaattgataagttaattttggtcggaagaaaaggaaaaacccactctattctttaacttcattactcttctacattttgcatttttgatgtcataatttacatcttatattgtttatcccttaaccaaatcattttagttgttgttatttttatttgctttgttttttaaccttcctaataaggatataattgtttcttgacccacgattaccatgttagagtattctgaatttgtttagatacttatttttacctgtcagttttatagttttgaactttttttgttacacattaggattattattttttctttttgttcgaacaactcctgaaagtattttttttgtaatgtagttctggttgcaagggttttcttcagcttttgtttatctgggaatgtctttagtctttatttctaattaataagtttgctctatacggtattcttggcaggcagttttgttgtctttgaatatgtcatcccgctctctcttggcctgtggggtttctcctggtaactctcctgtcaggcatattggaattcctttatgtgttatttgctttttttttttttttttttctcatgctgctttcagtgttctctgtctttgacttttgagaaagtggttatatatgtcttagggttatcttatttggattgaatctgttttgttacctttcacctttctgtacttgaatatttatatctttcttcaggtttggacattttctgttattttttttaaataagctttcttccccattttcattttttattcttttttgaacactaatgatacacagatttgctcttttgacactgtttcatagaacctctgtgtttttctcattgcttatctgttttcttctctgagtgtgtattttccaatagcttgtttttgaaatcagtgattcttctgctttgtcattctgctattgatgccctttattgcattttttttttttgagacggagtcttgctctgttgcctaggctggagtgcagtggtgcaatctcggctcactgcaacctccacctcctgggttcacgccattctcctgcctcagcctcccaagtagctgggactacaggcgcccgccaccaagcctggctaatttttttgtatttttagtagagatggggtttcaccatgttagccaggatcatctcaatctcctgaccttgtgatctgtctgcctcagcttcccagagtgctgggattataggcgtgagccaccgcaggtgtgaggcctgcatttttcctttcatttattattctttttagctcctggattactgtttgattttttaaattatttcaatttgtttgttgaatttctctaacaaattcctcatttgttcctctgtgttgtattgacattgctgatttttcttaaagcagctatattttaattctttgattgcctatgatttatgtgcatatgtttaggattagtaattggcaccttgttttgggcgtttcatgaggccatcttttccaagctaatcttatatcttctttacatgtgtctctgtatgtttattgacaaattaggtatttttttccagtctttgcagtctggatttgtttgtgactgctctgtttcggtgggcttgttgacatattctgagcatactgactcttgtatttcattttagtgctagaaggtgctctgagcccagctttgacatgattgtctaatgcaggatccaaactcattgtgatcatgggagatccatattgggtgcccaggccatgtaagagatcagggtcagaccctcacatatgaaggattgtagaccatccatctgacattgtggcactcataaacatcctctgtggtggggcatcctctctgccagggatggtaagccactgccaagttctctgtgctgcctgttactagccctactctttcttttttccataggtggcctcaggtggttcagccccattgtacttgtgatgctcttcatgggctgatgcagaagcaaatctcccatgaagggattcaggatggtagagaagcataatgcctatctccggcttcctcttttgagtgtagaatccctgagtcctggagacctttctgtgtatagtactctaagggcttggggatggggtattgtggtcacagaaaactgattctcttaccatccaaccatacttttactagtctgtagtctggagaggcttcacagccttacttgtgcattcaggttttttttagccctcgtgaaggcaattgtatgtgtgagtggttgttcaaattgatgtttcttcgtgggtataattgttggagaaacctattttgctgtttgctctgcttccttgaatttaacattgccatctttctaaatataatgctctgtattaattgcttctcttaatttgtcatgaacattattccttgctattaaattttctaattgtttcataatgtaatatggagtttaaaaacattataattattctcaatttcataaagaggatgatgagcattttttcataactgcatattctttctataatgtgttacaatagacttgcacctctaagaatttctgtaaagtatttggttttactcttttgtttgtctgtttcttcacatgctaattcattttgatgatcctatgctagcctcttgggaattcctctcactttcagattttctgaatataagaggcagttttacatgctatttaatatctgttttttttttacattcaatgttccatatacatatttgtttctgtcgttgattagctgtgtgactttgtgtagttgcttaacccagatttctccatcttagaatcagtcctgaacacagcaacttccacatagcattgttttgaagattaaataataaaattcatatgtacaatttggtcctctgtctggccaaggcatggtgtttacagtgtttaaaaattgatgcttatgtacacttaccaatcagaacagataccaactacaaacaattggcaccagcagaatattggctttcctcatggagtgagagagagctcagttaaatgctagttgctatcatagttgtaataagtaaaaataatcatgagggtgacaattaagatgatttttggccaagcagttaccagactaagttaattttatgtcccaaataggcacaaagagcatgagcctttcatacatgaactttattctgaaatttttatattctgctgtaatattaacatcgaaacatggaagtctcagttacacagatatataaacaatctcatactttatatttcattctgtttagttcaaacttaaatagactttcagttaaatcttgaagtttttcttacctaaagaagatacatatttatgcaaattaattcaaaagtacttttttttttttttttgagacggagtcttgctctgttgcccaggctggagtgcactggcacgatctcggctcactgcaacatctctctcccaggttcaagcgaattctcctgcctcagcctcccaagtagctaagattacaggcatgcaccaccatgcccagctaatttttttgtatttttagtagagacagggtttcaccaagttggccaggctggtctcaaactcctcacctcaagtgatctgcccacctcggcctcccaaagtgctgggattacaggtgtgagccaccacgcctggctcaaaagtactatttttattaattttactattagtttactttattctggttagaatctattgccacactattttctatattgattgactctttattatcatgtgttaatataattaagatgaattttagcattctttatcaaagttatagtatttagccttgtgtttatataacttaacagacataccattcttatgaatttttaaggattatgctaaagattattccctctttagctataacttttatgttccagttcatctttaaccatggcattgtaaagaggttaaggtaaaatttcaacacatgatttatggtacatactgtcttgcacaaaactttgagctatatgtgttattaatttttaaacaaaacttggaagatgctctttgggcacttttacaatccagctttttaagatacattctttgttttgatagctattatacttgatattatgttagatatttgtaatgctttttactgtttcctttagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacaggtaagtttcttttaagcaaattttggtgtatttttactaaggaaaagataattaagaaagcagcgcctgttgtggagaatatatactactacagaaaattttttactcagttttagtatgttttctaaagtaatacatattagaaactgtgaactataaaaattctgtaatatgcttgattcaaaaatattcctttttcttatttcaaaatgaatgcatgtttcttattgtaatttctcaaacacagataaataaaagaaaaaacacctactatctcactattcaaaaataatcattgctgatagtttttttaataagtaataatttattgttttgacttcagaaataataattaaaagttaaatgtgtttaacttacatcaggtaagatttttattgcacagggtggtagtatagagtagtatctaggagagtatgggtttggaaccaaatctgggctgaaatcccaactctgtcactgttcaaatgtatgaccttggttcattaacctctcagtgtcttatttttcccatatgtaaaatggagatgataataattcactgagttgttgtaaaggtcaaatgagattttatgtaatataggccttaggaattgaagcacataaaaaagagcattataaatgctagccataatcatcacattcttgtttactaaaccctactttcctccatcttcctctctattctgccacttctttctcctactttgtaaataatatttgttctttaaatataatttccttttaaagtagaatttaatagaaatccttcattatctctagattggaacttgtcttttaaatttttaatctaccgtctctaaatggagtttgcctacatagcacccacagaaatacgtttttggctgtgaagatgtgaggaatttgagggagtggagcctgactctggttagataatttttttttaacactagctgcatattagaaccagctggaaagcttttaaaaatatggctgtctgggccactttctaaaacaattaaatcattatcttggttgtggttgtagggtgattcttaggtaattgttctttttaaatgtttcccaagtgactaatatgcactcagagttgagacacatggggaatgatgaactgattcaacatttgagtcaacaaaattgtgcagctaatacagttgtaccttggtatccatgcggattaattccaagacctttcctgtgtaccaacatctgcagatggtgaagtcccttacatagtggtgtagtatttgcataaaactgatgcatatcctcctgtgtacttcaaatcatctttagttgtaattcctaatacaatgcctatatttcacttcattcacatggattcaaagtatacttggtgcatggcaaatataaattttacattttggaatttgggggattttttctgaatatttttgatctgctgttggttgagttcacagatgtggaacccatgggtaaggagggcctactgtagtatgttgggtgacaaataaagataggtgaatggaagttttgtgttatgcagtgctctgatccatttgaagctctaatacagatgcattggcccacatttaacattttttatatcctaggcaccgtactaatagctttattgtcattattttatattagctttacaaaactgtatggtattactttgatcctcattttacatgtggacacaaatatttaatgcacaaagaagttatctaaaatacccaagatcatattgctagttagagtaagaaaatgtctcattcctaaacctcgctcttaactgttaatgcaggagttatgttcatatggaccaggaagatccagttgttctcacctaaaagccacagcttagtgctctgtccagtggatacataagatgcagtaattatgggccaagtggaatccacaaaatttagggtctacatactagagtcatagtgttttttaattttatatttctaaaaagaccaaggttttcaagacaagctctttctaaagtgtttcagtactgaattttccatggccatacattttattggagaaagtgcatgtgtcagataggttatgtgtgttaatgtattgattgcataatttgaagaaaaaatatactatgagatgttttcattcacattacaatttgtgtgtctctgtaaactgtcgtgtatttaatataaaattgtggtatgttttattttacttttatgaaaattattttggatatattttccaacatattttcatgcccatatgtaattagttcattctgtaatttacttaatatatttctgttggcatttatataatgcttctaaccataactccaattcttgagaatgactttttagcaaagtgaaacccacataacagacacttaactatgtacagtgttgtgcaactgtctgatttttttttctttttttttttagacagagtctcgctgtgttgcccaggctggagtgcagtggtgtgatctcggctcactgcaacctctgtgtcctgggttcaagcaattctcctgcctcagcctcccaagtagctgggggggggggactacaggggcccgccaccatgcctagctaattttttttttttttgtatttttaatagagatggagtttcactatgttggccaggctggtcttaaactcctgacctcgtgatctgtctgcctcagcctcccaaagtgctgtggttacaggcgtgagccaccatgcctgggcattttttaaagtttttaattaaaaagaattcaatttttaattttgtgggtacatagtaggtgtatatatttatggggtacatgaaatatcttgatacaggcatgcaatgtgaaataatcacttcatggagaatagggtaacctgctcaagcatttatcctttgtgttacaaagaatctaattacactctttaagttatttcaagttattttaaaatgtacaattaagttgctactgactatagtcaccttattgtgctatcgaatagtaggtcttcttcattcttcctatttttttgcacctcttaactataccccctgccctccagccctctaactattgtttttgtacccattaatcatccctaccttctccccagcaccccattacccttcccagcctctggtaaccatccttttactgtctatgttcatgaattcaattgttttgctttttagattccgcaaataagtgagaacatgcaatgtttgtctttctgtgcctgtcttatttcacttaacatagtgatctccagttctatccatgttgttgcaaatgacaggatctcattcttttttatggatgaatgccataaaaaatatataccacattttctttatccattcatctgttaatacagcagtccccaacatttttggcatcagggagtagttttggggaagacaatttttccacggatggggtggtggtggggtatagtttgtggatgaaactattctacctcagatcatcaggcattagttagattctcataaggagtgcgtagtctagattcctcacatgtgtagttcacagtagggtttgagctcctatgagaatctgatgccaccacagatctgacaggaggcagagctctggcctgaatgctttttcacccgctgatcaccttctgctgtgcagccggttcctgacaggaaatagactggtaccagtccatacccaggggttggggacccctgtgtaatggacacttaggttgcttccaaattttatctattgtaaacattgttgcaacgtaggagcgcaggtatctctttgatataccagtgtcctatttttaaggtttatacccagccatggaattgctggatcatacggttgctcaatttttagtgttttgaggaaccttcaaacttttctccatagtacttgtactaatttacattctcaccaactgtgtacaagggttctgttttctccacatcctcacaaacatttgttattgcctgtctttggatataagccattttaactggggtgatattacagttctgatttgcatttctctgatgatccatgattttgagcacctttgcatatgcctgtttgtcatttgtatgtcttcttttgagaaatatctcttcaaatattttgcccactttttgattggattattagatttttttctgtggcattgtttcagcttcttatatatttgggttactagtcctttgttagatgggtagtttgcaaatattctctcccattctgtgggttttctcttcactttgttgattgtatcctttgctgtgcagaagctgtttaacttgttgtaatcccatttgtccgtttttgctttagttgcctgtgcttacagggtattgtccaagaaattttggcccagaccaatgtcctggagatttttccccaatgttttgttctggtagtttcatagtttgaggtcttagatttaagtctttataccatatgctttttatatatggcaagagataggctctagtttcattcttctgcatatggatctccagttttcccagcaccatttattgaagaatctgtcttttccccagtatatgttctggtcacctttgtcgaaaatgaattcactgtagctgtgtcgatttgtttctgagttctctgttctgttccattgaactatgtgtctgtttttatgccagtattatgctgctttgcttgctgtagctccttagtataccttgaagtcaggtaatgtcattccttcagttctttttgctttggatagctttggctattctgggtcttttgtggttccatatatattttaattttttttctgtttctgtgacaaatgttactgttattttgagagggattgcattgtatctgtagactgccttgggtaatatggacattttaacaatattgattcttccaatccatgaattgattcttccaatgcatttttggtatcctcttcaatttctttaattagtgttttatagtttccattatagagatctttcacttctttggttaattcccaggtatttaattttatgtgtggctattataaatgggattactttcttaatttcttttttatattgttcactattggcatatagaaatgctactgatttttgtatgttgattttgtatccttcaattttactgaatttatcagttctaagatttttatggagtctttaggtttttccaaatataagatcatattatctggaaacaaggataatttggcttcctcctttcctatttggatgccctttatatctttcttttttcttattgctctagctaggacgttcaggactgtgttcaataacagtggtgaaagtgggcatccttattgtgttccagattttagaagaaagcctctcaattttcccccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaaggtttttctattttgtttaacctttcaaaaatcaaccttttgtttcatcagtcttttttttattgttttcttcatttcaattttattatttctgctttgatctttcttattttcttctattaattttggttttggtttgctcttccttttctagtttttaagatgcatcattagattatttgaagcttttcctctttttttgatgtaggcacttatagctagacacttcctcttagtattgctttgctgtatcccataggttttagtatgttgtgtttctattatcatgtttcaagaaaattttcagtttccttcttagtttcttcattgaccctctggtcattcaggagcatattgtttaatttccatgtatttgtaaattcctcttgttattaatttctagttttattccattgtggtcagagatgatgctttatattatttcagtttttttcaatgttttacaacttgctttgtgacctaacatatggtctatacttgagagtgatccatgtggtgaggaaaataatgtgtattctgcagctgttggatgaaattttctgtaactatctgatagatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgaccttctttgtctattcttttgtttttcgtcttgaaatctgttttgtttgatgtaagtatagctactcctattcttttttggtttccatttgcatggaatatatttttccattcctttatcataggctacatgtgtctttatttgtaaaatatgtttattgtaggcaacagattattgagtattttttttccatccattcagccactctcttgattgaagagtttagtctatttacgttgaaagctattattgataagtaaggacttacttctgccattttattatttgttttctggttgttttgtgttcttctcttccttctttctttctgtcttgctttagtgaaggtgatatgattgagtttcttggtttttatttcttgtgtatcttgtttttttgttttgaggttaccgcgagacttgtaaatagtacattataacccattatttaagctgataacaacttgacactttttgtggtcctcttttccttctttctttccctcctgtcttcctttagtgaaggccttttttttcctggtgatatgatatagttttttagtttttattttttgtgtatccattgtatgttttttggtttgaggttaccatgaatcttgcaaaaactaccttatagcccattattttaacctaataacaacttgacactgtttgcataaacaaacaagcaaatgaaaactaataaaaactctataccttaacctcatccatctgctttttaacttgttattgtttgtatttatatcttattttactgtcaacatcttgaaaagttgttattatttttgagtggttcattgtttagtctttctatgtaggataagagtattttactcaccacagttacagtgttataatattctgtgtttttatgtgtactcactgttactggtgagttttgtgttttcaggtgattacttattgctgattaatgtcattttttttttctgtttggagtactccctttagcatttcttttaggacaggtctggtgctgatgaaatcactcagcttttgtttgtctgggaaagtctttatttctccttcatgtttgtaggatatatatacacttcaaatatatacattttaggatatatatacatttcaaatgtaaaagttgttttccttcagcactttaaatatgtcatgccattgtctcccggcccataaggtttccactgaacagtctgccgccagatgtattggagctccattgtatgtgatttgttgcttttcccttgctgcttttaggatcctttctttattcttgatctttgggagtttgattgattactaaatgccttgatgtagtcttctttgggtttaattctgtttggtgttctataaccttcttgtactttgatattgatatatttctctagtttgagaagtttcgtgttgttacccctttgaataaactttctacccttatctgtttcacttcttcctttttaagaccacgaactcttagattttcacttttgtagctattctctaaattctgtagatgtggttcattgtttttaatcttcttcttttgtcttttctgacagcgtattttcaaatagcctgtctttaagctcactaattttttcttctgcttgattaattctgctattaaaagactaatgcattcttccatatgcgaattacatctttcatctacagaatttctccttgataccttttaattatttcagtctctttgttacattcatctaatagaattctcaatttcttctttttgttatcttgcatttctttgagtttcgtgaacacaggtattttaaattctctgtttgaaaggtcacatatctctgtttctccaggattggtccctggtggcttatctatttcatttgatgaggtcatgttttcctggatggtgttgatgctaatagatgttcttcattatctgggcattgatcagttaggtatttattgtagcccccactgtctgggcttgttggtacctgtcctccttgggaagactttctagatgtttgaaaggacttgggacttggatgttatggtattagttgtatctgctataggggggaccctaagcccagtaatactttacttacaaactcatagagggactgccttgatggtcttggacaaggtctgggagaattctggattaccaggcagagactattgttctcttaccttattttctcccgaacaaacagaattcctctctctgttctgggccacttaaagctgggggtggagtgacaaaagtaccaccgtggccatcaccagtatgactgtgctggtcagacatgaagccagcacaacattggatcttgcctacagcctgctgtatgcactcactggttactgcctgtgttcgcctaaagtcctggggctctacaatcagcaggtggcaaagccagctaggcctgtgttcttcccttctggatgacgagttccctcaggcccctggtgggtccagaggtgctatacaggagttagggactagagttaaaaaccttagaagtctacttagtgttctattgtactttggctgagctggcactcaaaacgcaatatgcagtccttcccactcttccctcccttttccaaaggcagaagagcctcacctcatagccactgccatcaaaggccatggggagtactgccagactacagctgatgatcccttaaggcctaagggctcttaagtaagcttatggtgaatgctgcctggcctgggactcaccctttaggggagtgggctcccctctggcctagggtaggttcagaagtgccatccaagagttaagtcctaaaattggggatcccaagaccccacttggtgctccatccacctgtgactgtgttagttcctaaggtacaaggcaaagtaccatttacttttccctgtgcttttctctaacataagagttttgccctttagccactgcagctggtaatgtgctgtgtttcacctgaagccagcaagtctcagaggctcacctaagaccctcaacatagaacgtgggtattgctgctggttattcaggacccaagtactcttcagttaaccaggtgatgaatgcttccaggactgggtcctttccttcaagtcagtgggttcctttctggcccagtatgtgtctagaaatgtcgtctggaagctaagacctggaaggagggcctcatcattctgactggtgccaagacaaagtcctctccacttttcccacacctcttctcaggtggaagttaggggtctcttttggaaccacgatttgtgcagtctggggttagaggagaggcaatgccagtactcccttagtcaccccctctgctgtcccagcaggtcctgtgccctccagttcactgtttctgggcccagttcagcactaggacttgcctaagagttgtagtccttatggcccagactgcctttcaacttcatttaaagactcagagcattttagcccttggtggtgaggtcagtgggaactgaagttcagactgctaggattggcgattttcctttgtctagtgctggtttgtatgtgccttctgtaggcgggtgtcccctgagttttgttcagttctcctttctactatagcaggacagcagtgagttcagtccctcacgattattgttttctccctcctttagtgcctagagatactttcctccccgtatactgccactgcagggaggtgggagagggctgatgttggcaattggagaatttttaagaaatcacttcagtgcctctttcactgatagaagttaacaccaggtactatgagggctcacctgatttttggttttatgaaggtgttttttctgtttagatagttgttaaattgatgtccctgttggaggggacgattgatggaaccttctattctgctatcttgctctgtgtctctatcacctttatctatttcttaaacattttttatcatcccaaaaggaaactccgtactcatgaaggagtcaccccagcccctggcaaccactgctctgctatctgtctttacaaatttacttatattctagatatttcatataaatggaatcacagtatgtaacatcttgggatttccttctttcactaaatgttatgtttttgatgttcattctcattgtagcaagtaccagtacttaatacctttttacagctaaataatactgtggttttgatttccatttccttaatgattaaatattgaatatcttttgatgtgcttgctggcccttgtatcttagtttggagaaatacttattcaagtactttacctgtttaaagaaactttgttttcttaaattttggaaaaatatgcataatataaagtttaccattttaaacatttttaagtatacagtttagtggcattaaggacatgtgcattgttttgccaccatcattttcattcctctttaaaactttttaatcttgtaaatctgaaactctataaccattaaaaaatagctacccactcccccacctccttccagaccctaagaactgccattctactttctgtttctgtgaatttgatggctatagatacctcatgttaagtggaatcatgcagtttttgtcctttggtgactggcttatttctcttagcataagccttcatggttcattcgtatgatagcatgtatcagactgtctttcctttctaaggttgaataatgtttcattatgtattagtacattcacaatgttgtacaactgtcacctttatctagttcttacacacatcatattttatctatctatttattcattgatggacacttgagttgcttccaccttttggctgttgtaaataatgctgctaagaatatagcttacaaatatctttgtgagtatttgtgtcttttcatatgctttttagccatttctttatcttccttggagaaatgtctattcaaatcttttacttattttataattgggctttttttgctgttgaattgaaaaagttctatatatcttctagatatgaggctcgcatgagatatatgatttgtattttccaccattctgtaggttgtgttcacttttttgatggtatcctttaaaacgcaaaagtttcaattttgatagtttatctatttttttattttgttgcttatatttttggtgtcatatctacaaatccattgccatatgtaacatcacaatgattatttttttgccaacataggtaaaagtaatatatgaatggctctattagctccaaaatgttttaaattattatggtaagttttactattctaacaggcagagtgcttttaggaatatgttcccctttaaggataatacttctctgctaggttgaagacaagtttagttatttcacattaatttttgttactgacgtgatacatttgacaagccaaagtaaaggcaatgaaaaattaaatagagtgaataatagatgcctgttgtattcactgttatactttctccggtagtttatgaaatttttaaataattctttaagagtttccgtgtttcttaaagttggcaggaaatattttgctgtctatgacttttatatggtgatgtgatgggtaaaagtcatttttattttttggggccacattagctacctaataataaacaataagtcacatctgatgaattattttaatgtagtaatgtctaaaatcaatttataaagcatggaaagtaaacatttattactattctttcatttttagttcactttattgggaaaagctcatttttaaaactagtaaatatacttattaaaattcaaagtgcatgccgatattaagggaaagtaggaaataaatttatatttgactggcaaagctttaaatatactgcagcatatatattattttaaaaatccaacctaataaagccaatctaacattattgtcaattattattatattatggttagtcagttattataagttactcttaaaatgttttattaaaattttatttataatgttcaggaagattctctgattaaaaacttgctttggagatatgtatataaaatatttatgtgtgtatatgtatactatatatatatgtatatgtaatctttgtggctatggaaaaatataacaatgttaaatgcttgggctttggaatcataccacttgagtctacatgctggcaatgccactgtcaccttggataaattatttaacttttaacttaattttattttttgagatgcagtcttgctctgttgcccaggctggagtgcagtggtatgatctcagttcactgcaaccccagcctcccgggttcaagggattctcctgcctcagccttcctagtagctgggacgacaggcacgcgccactgcacccagctaatttttgtatttttagtagagatggggtttcacatgttggccaggctggtctcagactcctgacctcaggtgatccacctgccttgacctcccaaagtgctggaattacaggcatgaggcaccgcgcctggcctatttaactttttagtgtcttagttttctcatctgcaaaatgcagctaatttaatttatgttgtaatggtaagtcataaatgtggtactttatatgttgtataatatatgttcctggcaaatgttaactccctaatcctagctattattgtgatattattattactattcataacatcaataagtttagtattttgataaaaatatatgattcaaacttttatggcagtattatttttgtcatattatttccaatctgacttataaactgtagtaaaagaaactaaattaatatttagttgaatagaagaatggctcagtacattacacattatgttatttgcaatgaaggaatatccttgaactccataaatacttattgaatgcctaataaatgcaaggaacaatgttaggacttgaatttatatacattgtgtgggtgctattatagtgttatgaagaaattgagtgatagaattagtgacaaagagatgaattctcattgaagaatctggtcttggaaggtctttcatttcttcaatatttaaaaaaataattggatatataatagttgtacatatttaaggggtacatgtgatattttaatacaaatagataatgtgtaatgatcaaatctgggtaactgaaatatccatcacctcaaacatttatcatttctttgtgttgtgaatgctccaagtctactcttctggatcttttgaaatatacaataaattattttaaactatagtcactttattatgctgtggaacactagatcttattctttctttctaactgtatttttatacccattaaccatttctatttatcctcatctcctcactagtgttcacagcctctagtaaccaccatttcattcactacctccaggagatcaattgttttagctcccacatatgaatgagaacatgagacatttgtcttttgtacctggcttatttcacttaacataatgttctctagttccatcagtgtcattgcaaatgacaggatttcattctttttaatggtggaataatgttccatttgtgtatatataccacattttctttcattgttcatctgtcgatggacacctaggtggattccaaatcttgcctattgcaaataatgctgcaataatcatggatatgcagatatttctttgatatactgattttccttcttttggatataaccagtagtagaatttctggatcatacgtagttctgtttgtagtgttttgaggaacttccataaacctccatactgttttccatagtggttgtactaatttacatcttgaccaacagtgtgtgagagcatgcccctttttctgcatcctcaccagcatttgttatattctgtcttttggataaaagccattttaactgtggtgaggtgggttgcatttccctgattattactgatgttgaacattttttcataaacctgttggccatttataagtcttcttttgagaaatgtctcttcaggtctttagcccaatttttaattgtattattattattattttgctattgagttgtttgagctccttatgtgttctggttattaatcccttgtcatatgagctatttgcaaatactttctccccattctgtaggttttctctttactttgttgattgttagctgtgcagaagcattttagcttgatgtgatttcattttttcaatattactttggttacatgtgatttagaggtcttactcgaaatctttgcccagaccaatgttctgtagaatttcctcaatgttggctgggcacaatggctcacgcctgtaatcccagcactttgggaggctgaggtgggcagatcatgaggtcaagagattgagaccatcctggccaacatggtgaaaccccatctctactaaaaatacaaaaattagctgggtgtggtggtgtgcgcctgcagtcccagctacttgggaggctgaggcaggagaatcacttgaacccgggaggcggaggttgcagtgagccaagattgcgccactgcactccagcctggtgacagagcaagactctgtctcaaaaaaaaaaagaaaaaaaaaaaaaaaaaagaatttcctcaatgttttcttctagtggtttcaaagtttcaggtcttacatttaagttttaaatctattttgttttaatttatatatatcttgagagttagggggtctagttccattcttctgtatatacaggatataattttctgagcaccatttattgagagactattcttgccccagtgtatgttcttggcaccttctttgaaaatgagttgtttataagtgtgtgggtttatttctggcctctctattctattggactatttgtctttatgccagtatcatgctgttttgtttgctgtatagctgtataccataattcgaagtcaggtaatatgctgcctctagctttgttctttttggtcaagattgctttggctattctgagccttttatggttcaatatgaattttaggatttttttttccatttctgagaagaatgtcattggtattttgataaggagtgcatttaatctgtagatacctttgggttgtatggatattttaacaatatttgttcttccaacttatgaacatgatatatattttcttttttgtgtccttttcaatttctttcatcagtgttttatagttttaattatacagagcttttactactttgattccatttattttatttgtagctattttaaatgggattactttttgatttttcagattgttctctgttgccatacagaaatgctactgaatttatatgtcaattttgtatcctgcaggtctactgaatttatttattagttctaataggtttttggtggagtctttaggttttttgaagtataagatcatatcatctgtaaacaaggataattttactttctcctttcctgtttggatgctctttatttctttcttttgcctaattactctgggtgggacttccagtactatgtctaataaaagtggtgaaagtgggcgtctttgttgtattccagatcttagaggaaaggctttcagtgtttccctagtcagtatgatgccagtggtgggattgttttatatgacctttattgttttgagttatatttcttgtatccctagttttttgagagtttttttttaaatcattaagggacgttgaatttcattgaatgctttttcaaccattgaaataatttttgacctttattttgttatatgttatagcaaatatgctatattttgttaaatgcgctatgatgtatcacatttatcgatttgtatgttgaactatcttgcacccctgagatgaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattggtctgtttagtttttctgtttcttcatggttcaattttggtagtttgtatgtatttaggaatttatacttgtctcccaggctttacaatttattgggatatagttgcttatcatagtctctaatgattctttgaattcctgtggtatcaattgtagtgtctttttttcatttcttaattatgttcatcttctcactttttttcttagtgtagctaaaagtttataaattttagttattttttcccaaataacttctccttttgttgatcttttatatatattttttagtctataacttattcatttgtgctctagtctttattagttcttctcttctcctaagtttgggtttagtttgttctgcttttttattttctaagatgcactattaagtgttcttatttgaaatcttttttgatgtaggcaacattgtttttgtggtgtcccataggttttggtatgttgtgattctatttttatttgtttcaagccattttaaagttttattcttaatttcttaattgaaatttaatgttttcattccttcagcagcgtattgtttcatttccatatatttgtatagtttccaaagtgtcattattcatttctagttaattccactgttgttagaaaaaatacttgatactctctttgggaggccgaggcagctggatcacctgaggttgggagttcaagactagcctgatcaaaatggagaaaccctgtctgtactaaaaatacaaaaaaattagctgagggtggtggcacatgcctgtagtcccagctactcgggaggctgaggcaggagaatcacttaaacctgggaggtggaggttgtggtgagccgagattgtggtgccattgcactccagcctgggcaacaagagcaaaactctgtctttaaaaaaacaacaacaacaaaaaccaacttgatattattttgacatgtaatactttgttgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaattgttgcactagagcaagcttgtctaacccgcagcttgtgggccacatgcagcccaggacagctttgaatatggcccaacacaaatcagtaaactttcttaaaacattataatttttttttagctcatccactatcattagtgatagtgtgttttatacgtggcccatgacaattcttcttctaatgttggactcttctgttagagtattctgaatttgtctttgttcttaccttttccactgaatttcatgctttcagatgttttcttgttatatgttagcagcctttactttcagattgataaaatctcttcagcatttttttttgtaaaatctcttcagcattcatctggtgatgatgaatttactcagcttttgtttgtctgggaaagtctttatttctcctccatattgaaggatatctttcctgtatgcagtattctaggttggaagttttttccctttagcacttttaatatgctatcttgctcattctggtctataaactccccactgagaaggctgctgccagaaatatcagagctcctttatatgttatttacttttttcttcttgttgcttctaggatgattctttcatctttgacctttgatagtttgattattatatgtcttgtggtagtcttatttcagttgaatcttcttgatgttctttcaccttctttacctaaatgttcgtatctttttctaggtttgaaaagttctcttattactttctttgaataaactttctaccccggtctttttctttgtatcctctttaagaccagtgactcttagattttcccttttgaggctcttttttagatcctgtaatcatattttattcttttttattcttttaaatctattttcatatagtatgtcttgaactaaatatttccgtttttgcttgatcaattttgtttttgagagattctgatgaatttttcagtcagttgactttttcagctcgagtgattttttattgtttatttcagtgtctttgttaaatttctctgttttatcttgaaatgcatcatgttttctcaaaacaggtgtattgaattctttgtctgagaatatatgtatctgccactctagaattggtcatgggtgcctcatttactccgtgtgatgaggtaatgttttcctgaatgctcttgatgcttgtggacatttgatgatatatgagcgttaaaaatttaggtatttgttccagtctttccagtctggcattgtttatacctgtccttgagaaagttttctgagaattcaaatgggattgagtgttaaattacttatttctgtggtccttgcagttgttttagcactagagggagccctaagcccaggtatgctgtactcttgcagactctaggtacatagcctgggtagacttctgaaagtgaagggagaattccttttgttatcaggcaaagtccctttctgtcttttccagaagcataaggagcccttctctaccctgaactgtctggagttggggaacgggtggcatgggcactttttatgtacatatttgtttatccaattatttgtaaaacaaaagatgtactataagaaaaatatgtcttcaaatcatgaaatatacagacattaaaaaaaattccaatcctatataactaatagtttcctccatttaggtcttactcttttgggttaagtttattgcaaggtgcttaatgggttttgttggtattatgaatacatttttttcctttaatattacatttgtaattggtaatgtctgtttttatatctgttatgtttttagttcattttgttgatctttttataggtttttgaatagtaggcttatctgattttcttaatttctctctatattttaagtttttaacagtgataaactttaatttttcagttttggggaaaaaagagttctttcaacataatgacagttctatttttaccttatgtttctctttttggcatactgtgactatctgttcatagcagacttttacagacgtgtttaatactttaatacacacactaggatgtgacccaaacattctctgagactcaagggtagtaaaaaggaagatgaattacctttttttctctcttctaagatgaggaaatttttcattttaaaccattctcacacattgtagattattcagagaagcagaaaatttattaccaaatgaggttgagcatttcttaaaataagtgtaggaagcttaattctctcaaactaggaacattgaaaaatctcaagctgcagatacatgaaaatagcttgagatggaaatattggttctatttattcttttgacacaacaatgttaaaagtttgtattctctcagtacatactacgttctgtgttgcacaggaaagccaacttgagattttgaatattccaaagagaggccatccttttgagctgttttcattctttttgttttcataaaaggaatttcaaaggtgaggagaactgaggctatgaaaactgtttggccctgatgtcagatattttagcatgccttcattatgggttactggaatatgcagtttattacttatttctgttagatgcttttaaaaagaactatctgtgggctaattcccaaagttcccctggggaactttgccatggctttatcaaacctactcccttcctcaggatctcttcttctaatttttatttgtacaaagttttatgttctacctcttcaaactttgactaagcattacttcaacttttgctatttgaatagtgatttttaggcccttagatctgatgttatagaatatcttcacctctggtttacaagtttttgacaatgaagtgtgtcatttacttgctttcttttcaggaacaagtggactaatatatctctatgtaattttgaaaactattcaatagtttcagttctgtaggtagaatactatttatttggggccagagagaaactattattttgtctaagggttcaatatttctctttaattttatttgatgtgatgcttagcccctataatgtattgcttgaggtttgcattacaagaatatggcactatttggttttttaaaaagtgatataagatgttatgattgaacttaataataaaaatggttcttatgccaactcacaagtgttgtagaattcctactggcttgaaatgacaggcctagggtgaagaaaagataaatttaaagtggggcatagttctacttatattctaatacgtataaaacatttatttagtacagttcagaagattataggttaacctaagaaactttaaacatacttttggttttattctgatatttgtacaattttttcaaaaggcaaaaccaaactaaattccaatttggacacacacttttgcattgctcaaatagtgcatgaatactaattagtgatggtggagaagttaattatattttagtcatgcctacagcaggtgtaggaaagcttcagcataaatattgtttataaatatttcataaacacattaaaatcctccttaatatattatttaggaagaagtgcctttctctcaaagacccatttttatatgccataggacatggatccaaatatttacttttctcttagttacacatacttttatctatatcttttatcttacctttactttatggccaatttattgattttatagtaataatttatgtttttaggctttaaaggaagtatataaacatttaattatatatttgcttaacagtacagcctattttattaggcaatttaaaatttttaactttctgctgaacatttccaaagtcccactactatacaaattaattagttaagaaatggaattcattgtcgttattattttaaatatattctctctccatccctatcttagttaatgatactatcactcttttaggctcaatttcaaaagcatcttcttattccatcttttccctctgccagtatattcaattccaaactgatcctggctctgcactatctatgatatttattcccttcttggagttcattgcccttattagtttaggcctccatgatcctgcttctcttgtgttcttgttagatgttacagattacctgacatgatataagttctcattaaatatttgttgaattaatgcatgaatgctctcactatgtatttatagactctctccatttacaatccacctttatacttccttcataggaaaagaaaaaagagacaattttcttcctaaaatcattcaaaaaacttattttgttactatttctaaaatatttgttgcctgcaaattatctatgaagtacatttaaagctcctttataaggcttgtaaatccttttatactgagcccagataacttttcttgctttacgtcttaccatatttttcatattctatcatatctttatttttttattttttgcaatttacattttactcaataatacattttccttgtcagttaagctccaagcattatatctaaaaatgtggataatgtttattgattataccaggtacattgctaaaaagctaatctaaatgtttttcgattaattctaagcatttaataaagattttagtatacctattttagttattatttattatacctattttacaaatgagtaaaccaaggacataagcctaactcctttttgaaaggttaagtcattaagtgctagaatgagaattgaaaccttgaactacctgattctaacagtggtctaaaccagtatgttcttatattttctttgactctcacatgcaactagtggccagctcttatccattttaaggccataatattgcacatccattgtcctacttatgtctattattatttagccttgactgttacattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataaatagaatcttgatatctgacttttcagagcttaactatcttacattttgactcactaacctattaattctggagtcattttagcagaatgtattattctatacaataagttactagataacttcaaagtactaatatttcactttaccataacatatgtattttatgtgatttttaacatacattttgtgcattcttctagctgtaagcgtccaacttctggaatttcaaagtagtataagactatgtaactcccattatttgtaacagaagatatttgagtaattattcacatatgatattttatatattttaaaaattaagcactagtgttttcttgacaaatggaataatcgtttatttcatatattcctaacaacatcccaatacccaaaaagaaaaaaataactacccttaatatatgtaggaaaaacaaagaactcttcaaataaagttgttacacataatgttattattgatttacaagtcaaaagaataaaaatgcattttattgtctatttctaagtgtagaaatgtttagtatttataaaatggaaaagttctatttaatttgtttgttttgacataagtccatgtgaaagagctataaagaaaatacaaacagttcccccaaattgcctttctctcttcatggctttcagttaaacattgtaaacttaaggtctctttaccccttaaatactttagtgcatatttcttaaaaactaggaattctcttaaccacagtataattattgaaatcagaaacttaacattgatgcatattgttattaaatatagattttattcagattgtgccaattgtctcaatgttgttttttaaagcaaaaaaaaaatccgattattagttgtgttcatttttgaggccttcttagtcttttttttttaaaaaaaaatttattttactttaagttccagatacatttgcagaatgtggaggaggtttgttacataggtaaacgtgtgccatggtggattcctgcacctgtcttagtctttaacctgggtaatttcccaactctttcattttgtttaatgtcatttgacattttttaggactacactatattatttttgtgtatggatagaatgtgctacaatttgtgtttgctatgtcttcatgattatgttctgattatgcacttttggcaggaatacctctgaagttatgttaaattcttaccaacgtatcaggagccacatgctgtcatcatgctcttaatagggatgctcacaatgaacctttggttacagtggtgtctgccagacttcatcactgtaaaggtgctattttatcctttacaatgaatgagaatcttatgggagatactttgagactatgtgcatgttgtgttagtcctcagtctttcacccgctagttctaacatatattgatagttcttctgtaatcaatgattattatgatttttaccaaatggtgattttctaatttctttattctttccacattgattagttggctttctactataatgagaagcttgcttttctctcttttgtctacctgtctatgtatgtatgtatgtatgtgtgtaatcctttcattctttgagcatttccttatagtttcggcatttatcttgtacttttccagccataactgtggaagctagcatttatcaagcagctttggtacttttagtgggctctgagcatcattgtttgtggatcacctcagcagacaaactagagaatacatgtatgtgtacagaaatgcttacataggtgtctactcacagacacatgtattttcatacatatgcacaacctcacctacatcaatattcatttcttccttcttcacaatcctttaaaaatgcaataacattcttagcttgagaatcatagaaaaattggacatgggctggatttggaccccatatcatagtttagtgacccttagaatatatggtttgagtttcctctcattttttaatgtggtatacaatgttggactgtaaaatgtaaattttatagcactcttggccctttgagtctccaatttataacttaaatttttgaaacagtgctattttctggaagattccagttacttaaggtttaaattattgtttatgatcatgttcacgtactggagcactgctttgaaaacattcagtaagtactggatcaaagaatgaattactttaccttttttatcgaagaaagaatcatttcttgttttcccactctttaatataggcaagtacaggtgcctaatatcctaaataaacaaagtaatctgattaagtcatatggccttttctaaattgcaagagctatcatgtatccaaaagaaaaaaaaatttacacttctcataacagcaggttaatatatggcaatggttgtaaatctagggcttttttgtgagaaaaatcagatagtgaagatattgatatcagcatttcatatttatttatataaaaaagaaacagctatattgttttcctttttcataaactataaattgatgaaaatttgggcttagagctataaataaaaatgtaagttaaaaaatagaatgaaaatttatttttcatatttttaattgaccagtgaaaattatgtatatttataatatacaacatcatgtttggtttatgaggatatattgtggaatgcttaaattaacttaacatatttatcacctaacatacttatgattttttgttatgagaacatttaaaatctgctcagcggtttacaagtatgcagtacattgtttttttttttttattatactttaagttttagggtacatgtgcacattgtgcaggttagttacatatgtatacatgtgccatgctggtgtgctgcacccactaactcgtcatctagcattaggtatatctcccaatgctatccctcccacctcctcccaccccaccacagtccccagagtgtgatattccccttcctgtgtccatgtgatctcattgttcaattcccaccaatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaaatggtgtgagatggtatctcattgtggttttgatttgcatttctctggtcagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttagtccatcttcaattgatttttgtataaggtgtaaggaagggatccagtttcagctttctacatatggctagccagttttcccagaaccatttagtaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggtgatgcgggctcttttttgattccatatgaactttaaagtagttttttccaattctgtgaagaaagtcattggtagcttgatggggatggcattgaatctgtaaattaccttgggcagtatgggcattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttattgcccattcagtatgatattggctgtgggtttgtcatagatagctcttattattttgagatacatcccatcaatacctaatttattgagagtttttatcatgaagggttgttgaattttgtcaaaggctttttctgcatctattgagataataatgtggtttgtgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaaggttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgagtattgccacaatttcagctcccgttattggtctattcagagattcaaattcttcctggtttagtcttgggagagtgtatgtatcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatgaattttgttgatcctttcaaaaaaccagctcctggattcattaattttttgaagggttttttgtgtctctatttccttcaattctgctctgattttagttatttcttgccttctgctagctttagaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacagctttatttctgccttcatttcgttatgtatccagtagtcattcaggagcaggttgttcagtttccatgtagttgagcgattttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctgagtctctttgtaggtcactcaggacttgctttatgaatctaggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcctttttttgttttccatttgcttggtagatcttcctccatccttttattttgagcctatgtgtgtctctacacgtgagatgggtttcctgaatacagcacactgatgggtcttgactctttatccaatttgccagtctgtgtcttttaattggagcgtttagtccatttacatttaaacttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatcggttagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgatcgttggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctccgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaactgcgtccctttggaggaggagaggaactctgccttttagagtttccagtttttctgttctgttttttccccatctttgtggttttatctacttttggtcgtcgatgatggtgatgtacatatgggtttttggtgtggatgtcctttctgtttgttagttttccttctaacagacaggaccctcagctgcaggtctgttggaataccctgctgtgtgaggtgtcaagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcagttggagctccctggctgctttgtttacctaagcaagcctgggcaatggcgggcgcccctcccccaggctcgctgctgccttacagtttgatctcagactgctgtgctagcaatcagcgagactccgtgggcgtaggaccctctgagccaggtgcgggatataatctcgcggtgcgccgttttttaagccggtccgaaaagcgcaatattcgggtgggagtgacccgattttccaggtgcgtccgtcacccctttctttgactcggaaagggaactccctgacccttgcgcttcccaagtgaggcaaagcctcgccctgcttcggctcgcgcacggtgcacgcacccactgacctgcacccactgtatggcactccctagtgagatgaacccagtacctcagatggaaatgcagaaatcacccgtcttctgcgtcgctcacgctgggagctgtagaccagagctgttcctattcggccatcttggctcgcagtacattgtttttagctacagtcaccatggctgtagatctccagaaattattcttcctttctaacaaaaactttgtacattttgaccatctcctcatttcccatccccttttccacaccagctcctggtaaacatcattctaactctctgcttttgtatattcgattctatttttttttttttttgaggtgaattctcgctcttccgcccaggctggaatgcagtggtgtgatcttggttcactgcaaccaccgcctcctgggttcaagtgattctcctgcctgagcctcctgagtagctgagattacaggtgcccaccaccacgcctggctaatttttgtatatttagtagagacggggtttcaccatgttggtaaagctggtcttgaactcctgacctcaggtgatctgcctgccttggcctcccaaagtgctgggattacatgcataagccactgcgcccagccgtaaatttgagattttagatactgcatacgagtgaaatcatacagtattagtctttttttaacctggcttattttcacataaaataatatcctctaggttaatccatgttgttgtaaaacaccggatttgcttatttttaaggctgaataatatttcatttttaaatatatatattataaatactatgtatataatgtggagaaaatatgggggatggaggattctgtgatgaggataggggttgtgtgagggggatggggtaattctttgaaggggattggggttctgtgagggggaagggggttccatgaggggatgggggttctgtgaaggggataggattctgtgaaggcgatgggattccgtgagagggatgagggattctgtgagcgggattggggttttgtgagaggatgaggcttgaatgagttgatcacttttgtgtagtattcatccattgatggatatttaagttgattttgtatctttgctagtgtgaatactgctgcagtaaacatggggagtgcatatatctctttgaaaattgatttcattttccttggatatatatacacagtagtgggatttttggatcatatgaaaggtccattttcagttttctgagtaaactgcatactacattccataatggccttattaatttacattccccccaacaatgtacaaaggttccctttttttccacatcctctctaactcttgttatcttttgtcttcctgataacagccattctaacagatgtgaggtggtatctcactatggttttaatttgctattccctgatgataaatgatgtggaatatcttttcctatatttattgaccattttttaatcttttgagaagtgtcttttcatgtcctgatatggtttggccatgtccccacccaaatctcatcttgaattggagctgctgtaattgccaggtgttgtgggagggatctggtagaagataattgaatcacaggggtggatctttcccatgctattcttgtcatagtgaataagtctcccaagatctgatggttttataaaggggagtttccctgcacaaaatcttttatcttgtctgccaccatgtgagatgtgcctttcacattctgccatgattgtgaggcctccccagccatgtggaactgtaagtccattaaacctctttcttttataaattgcccagtctcagtatgtctttatcggctgtgtcaaaatggactaatacagtaaattagtaccagtagagtggggcacttctgaaaagatacctgaaaatgtggaagcaactttggaactggttacaggccaaggttggaacagtttggagggctcagaagaagacagggaaatgtgggaaagtgtggaactccctagagacttgttgaatggctttgactaaaatgctgataatgatatggacaatgaaatccaggctgaggtggtctcagatggagatgaggaacttgttgggaactggagcagaagtgactcttgttacgttttagcaaagagactggcggcattttgcccttgccctagagatttgtggaactttgaacttgagagagatgatttagggtatctggtggaagaaatttctaagcagcaaagaattcaagaagtgacttgggtgctattaaaggcattcagttttaaaagggaaacagcataaaagtttggaaaatgtgcagcctgacaatatgatagaaaagaacatcccatttttctgaggagaaattcaagccagctgcagaaatttgcataagtaatgaggagctgaatgctaatcaccaagacagtggggggaaatgtctccagggcatgtcagggaactttctggcaggctttccaaccacaggccaggaggcctaggaggaaaacattttttgtaggccaggcccagggtccctctgctgtgtccagtctagggacttggttccctgcatcctagccgctccagccatgaataaaaggggccaaggtacagcttgggccatgggttcagagagtgcaagccccaagctgtggcaactttcatgtggtattgagcctgtgggtacacagaagtcaagaattgaggtttgggaacctcttcctggatttcagaggatgtatagaaatgcctggatgtccaggcagaagttcacttcaggggtggggcactcatggagaacctctgctggggcagtgcagaagggaattgtggggtggtacccccacacagagtccccactaggtgtgatgcctagtggagctgtgagaagagccaccatcctccagaccccagaatggtagattcaccaacagctggcaccctgcatttggaaaagccacagacactcaatgctggcctgtgaaagcagccaggagggaagctgtaccctgtaaagccacaggagcagagctgctcaagaccatgggaacacacctcttgcatcagcgtaacctggatgtgagacatggagtcaaaggagatcattttggagctttaaaatttgactgtcttgctggattttggagttacatggggcctgtagcccctttgttttggccaatttatccaatttggaacaactatatttaccgaatgcctgtacccccattgtatctaggaagtaactaacttacttttgattttacagtctcatagacagaagggactctccttgtctcggatgagactgtggacttttcagttaatgctgaaatgagttatgacttgggggaatgttgggaagacatgattggttttggaatgtgaagacatttgatttggtaggggccaggggcagaatgttatggtttggctgtgtccccacccaagtctcatcttgaattgtagcccccgtaattcccatgtgttgtggaaaggacctggtgggagatagtggaatcatggggacaggtcctttccatgctatttgagatagtgaataagtctcacgagatctgatggtttgaaaaaggggagtttctctgcacaagctctcttcttttgtctgttgccatgtgagacatacctttcaccttctgccgtgattgtgtggcctccccagccatgtggaactgtgagtccattaaacctctttcttttgtaaattgctcccagtcttgagtatgtctttatcagtagcgtggaaacggactaatacatgttctttgtccattttaaaaatcaggttacttgttttcttgctattgagttgtttgagttccttttatattttttgatattaacccctcatccaggtatatgatttgaaaatattttctgcaatttcctaagcgtatcttcactgtgtggattgcttctttggctctgcagaagcttcttaattggaaacaatcccatttgtctatattttttttgtctatttttaagctttaattatctgtgcttttgggaccatgttcaaaatatttttgccaagagtaatgtcaagaaggcttcctatgtttttctctaagaattttcagggattacctttaagtcgttaatccattttgaggttatttttgaatatggtataagataaaatttcattttcattcttatgcatgtaaatatccagtgttcctaacagtagtcattgaagaggctatcctttccttattgtgtgttcttgccacctttgttgaagatcaatagactctatggttatggatttatttccagtctttctattttatttcatcaatcatatgtctgcttttgtgctggtatcatggtgttctgattactatggctttgtagtttattttgagataagatagtgtgatgcctccagcttcgttctttttgctcattattgctatggctatatgagctattttgtggttccataattttagggttgtgttttctgtttctgctaaaatgccattggcattttgatagggattgcattataccagtagatcactttgcgtaatatggacatcctgagaaaatgaattcttttagtccatgaatacaggatattgttccatttatttgtgtcctgttcaacttttttcatcaatgttttataattttcagtatataggtcattcacttctttgattaaatttattcctaagtattttatttttcatagctattataaatgagattatttcttgattttgtttttagatagttcactgttagtgtatagaaatgctgctgatttttgtatgttcattttgtatcctggaacattcatgaatttgtttgttatttctaatgggtttttggtggagtctttgcagttttctgtaagaacttgtcatctgcaaacagggacaattttacttatttctttaaaatttggatagcttttatttctttctcttttctaatttttgtggctaggacttccagtattatgttgaatagaagtggtgagtgtcggaaaccttgtcttatttattgttctagaagaaatgcttttgacttttcactaatgagtatgatgttagccatgggtttttatctaacttctttattatgttgaagtacattcaatacttaatttgttgagcattttttcaatcatggaagaatgttgtattctgtcaaatagttgttctacatctactgatattacgtgatttttatttttcattctcttaatgtagtatataacagttgttgatctacatatgttggaccattcttgcatccctaggataaatcttacttgatcttgatgaatgattttttttcattaaaggattattgaaatgattgagtttgtttcataatattttgttgatttttttcatctatgtttattagagatattgactggtaatttcttttatcttagtgttcttttctggctttagggttagggtaatgctggccatataaaaatgagtttggaaacatttcctattttaatgtttttggaaaagtttcagaagcattaatatttattcttctttaaacatttggcagaattcagcagggaagccatcaggatctgagcttttctttgatggtagacttttcaatatttatttaatcttctaaattgtttgattctgtttatattttctatttcttcatgattcagttttggtagattgtatgtttctagaaacttactcatttcttataagtgattctatttgttgatataaaattgtgcatagtagtctcataatcttctatgatattagttgtaacacttctttaattttctttatatgaatcttttttgtgttttcttagtttagttaatggtttgtcaattttgtttatcttttcaaaggaaaaaactcttagtttcattgatcttttttatttttttctagttcctatttcatttatttatttatttattttgctgtgatttttattatttctgcctcccttctgctcactttggactcaactttcttttccttctcattctccttctccttctccttccttcctttccttccttccttccttccttccttccttccttctttccttcctttcttcctccttcttccttctttctttttttctttctttctctttcttcttctttgtttcttgagatctaaagttaggctgtttatttgagaacgttcttcttttttgaagtaaccattaattgcataaattttcctattagtattgttttgttcaacccataacttttggtaggttgtgattccatgtttatttttgtcaagacatatttaagtttctcatttgaattattctttttgtttaggaacagatagtttaatttccacatctttgtgaattttcaatttttcctcctgttactgatttctaatttactaccattgtggttggcaaagatgcttgatatgatttcagtcttcttgaatttttaagacttgttttgtggtctagcatattatctatcctgaagaaagttccttgtgtgtttgagaagaatgtgtatgctgttgttgttgaatggaatgttttttatatgtcttttaggttcattgatataaagtgtaggtcaaatccaatgttgttttttttttaatagacattttatctggatgatctgttcaatgttgaaagcaagggtattcaagtcccttactattattttattgtagtctatctgtcttttcagatctattaatattttctttatatatataggtactctgattttggtgcatatatatttataattgttatatccatttaatgatttgatcttgtttttattacctaatgaccttctttttgtctactgatacattagattaaggtctgttttgtctgatatagccacccctgatctcatttggttattctttgcatggaatatcattttccatcccttcactttctatgtatgcctttaatattaaagtttgtctcttatagggagtctattgtttgatcactaaaaaaagtccagttagctaatctgtgtctttttatttgaaaatttaatccatgtaagtttaaagtaattactgataaatatttaatcttgctattttgttaattgtttggtgattgttttgtagttcttttgtttctttcctccaaccttgctttttactttgtgttttgttgtatttttatagtggtatgctctcattcttttttctttatcttttgtgcatgtactagaggtttttatttcatgattaccattaagcataaaatataatattctgatttaagctaataataacttgaatttaatcacctacaaaaactatgctttttcacctttccattacattttatgtaattgatgtcaacttattttttatattgtttttagaaaatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataattcatatgtttttatgtttgatggtgtcacatagattccttatgctttcttcattttaaaaagaatcattttttgtttttctaactggttaatttcaaatgatctatctctgagtttgctaatttttttcttgtgtatgattgagtctgctgtttaaactctctattgtgattttcatttctgtcatattttgtagctcttggatttctattttgttctttttattgtttacattttcttattaagcttctcattttgttcatgcattatttttataattttatttaattgttggtatggtttggctgtgtccctacccaaatctcatcttaaattgtagctcccataatttctcatgttgtgggagggacccagtgggagataactgaatcacgacggcagtttttcccatactgttcttgtggtagtgaataagtctcacgaggtctgatggtaccccattcacttggctctccttctgtcttgctgacaccttgtaaaaagtgccattcaccttccaccatgataatgaggcctcccccgccatgtggaactgtaagtccattaaacctattcttcttcgcagtcttgggtatgtctttatcagcagtgtgaaaatggactaatacggttgtctatctatgtttccttgcatctcataaagcatctttagcatcattattttgaattctttttcaggcaatttgtatttctccacttttgggcgttagttactggagcttttgtggtatcatatttttctgactttttcttaactatatagccttgcaccagtatctgtgcagctgaggagcaaacacctcttccagtccttacaaaatttgacagtctgtatatgtctttataagtccttctcctgttgggtccttgggctgatggaattgcctctgaaattatggttgaatggaattggagttggctcatgtggctgatgctgtttctgtggtagggtctgaagatgatgacactgctactggggctctagcaagtatgaattctctccatttcctaggtggactgcactctctccaggaccttggttggtagggcttacactgagatgagggttcagagttaacagacatttggtctgtggccacatatatggactactgtggcttcttctgcattcttgtaagggctgccactggatttctgggtgggtcctttagcagacagacagcacttccctggtctgtatccgagatggactgggactgagtcacagagctgcttcagggtctacacctgaggccaaggtcttcatatctgtctctgggatatcatacgtgtgtgtttactagcacgttctttggtgggtacacctgctctcagattgtagttgacaggggatacaactgatttatagggctgtttcaagatccacagtgggactaatgtcagcaggttagcctgtaggggcagtaacagacacgcccatctgtaggtccctgggaaggcagaactgatttcaggctgcagtcaagatgagccaggcccaagatccagggccatttcaggttctactgtggaactaaagttgataagcctgtcctggggactcagatgggcttgtttcccagtggtgccctgactaggcagaactgttttacaactgtaaataagagatactgggaccaagatccaaggctgtaccaggatgtgctgttggactgagtctgacaagcttctcacagtggcagaggagttagtctcccagcagttccctgtgtgtgtgtgattgtttctaggccacagcagagaggggctggagctgagattggggacctgttcaggatctgctttgggataagaccaacaagcctgtcacagtggcacagatcagcaagtctcccagtgtttttgaagcatagaattttaaattatagggtatttgaacttttgtctttgttagaattcttactatatttgaaatctaatctataacatatctattaaatttctttaagtataattatgctgtaaggatacaaagaaaattaaatttacatgatatcctaacctctaggggttgttacaagtatatgacagttgatgatgatgcaagcaaggaaataatgatatagcaagggatgggcataggaacataaactgattttgaagcaggtactaccattggctactctttggttttatgtttctaaagtgtttttttttataaacaacttctttcaataactttttttgcatctttttttatccttattgtttggttttgcttataagttgatactgcaactttatattctagggggcagaaatatgttggcctcattatgttcctttagtgtatatctagaatataaaatcatcatcatatataaaattttaaacaaaggccactgtataatgccttcataggtgctggttcagcataaaaggatagccacaaatgctgacaacaacagaataatttcagcactgtcatgaagtataaattttaaacaattgaatttaaaatgcatttgtgctattttactctgaaatacagtgccacaagggaattctctcacaatgagctcacaaaaagttagcgtcttagaaattattgaatttactgtacaatggtaattcttttaagaaatgtggcaagcataactagtatccagttttgccataacagataaatgaaaggtttatccatattttaagatattaatatacatcgttttagtgtaactctgaatatgacagtattaatatgaaactttgcagattaatattaaaagacatcatgatatattcattatttttgaagttacatattactaatatatcacggtgtgtctttactacttgatgacagtttcctttattccctgcagctctctgccttgtgtttcactctgtaattctcacatcttatgttcccacagctaattctacaaacttaatgaaaaaactgtgtaggtttatttaaatattctttatgaagtaaactttatacctttttttcttttgagacggagtcttgctctgtggcccaggctggaatgcagtggcgtgatctcagctcattgcaagctccacctcccgggttcacacccttctctcgcctcagcctccctagtagctgggactacgggtgcccaccaccatgcccagctaattttgtttttgtatttttagtagagacggggtttcaccctggtagccaggatggtctcgatctgctgactttgtgatccgcccgcctcagcctcccaaagtgctgggattacagtcgtgagccgccgcgcctggccaactttatatatacctttatgtaaaaatgtcttctagtagaaaaacaggttcttagaaacctttctagtaccaaaagtaattttatgtatgcatatggagatgtgtgtatttattttaatcatctgttttttcaaaggtaataatcataagcaattagcaagaaacttagtgttctacagtatttcataatacggcaagtactgatgatttttcaaacatctctgttaaaatataattcatacatttaaaaaattacaatttgaaagtatacaattcagttgtttttactgtattcaccgggtcatgcaaacataattataatctacctttaaaatgttttcatcacccccctctaaaaagccctcagtcattagcagccattccccttcctcccttgtcccccagccctgcctctggtagccctgggcaatcaataatctacttcctatttctataggttttattcttctggaaatttcatataagtgaaattatcaaatatgtgatctttcatgactgacttttttcatgtagtgtaataaaggttcatccatgttgtattatgtaccaggactgtactaatttttattgccagacaaaattcaattataatatccaattcaaatatggctatatcatattttgtttcttcgttagttgatggacttttgacctatttccattctttggctattatgaataatgctgctatgaacattccgtgtatgttttattgtggacatttaaaaaaatcctctttggtatatatttctagaagtagatttgctgggttatatgtaaattttatgtttaatattttcatggactaccaaattgtttccaagaatagctgcatcattatacatcttgaccagcagttcatgtgtgtttctatttctccatattccacaaactcttatcattatctgtcttttttgttatagccctcccagtatgtgtgaagtgatctcattggagttttgatttgcatttccctaaggagtaatgattttaaatatctttttctgtgcttatcagtcatttgtaaatctctttggaataatcttctttggaatattcagatatttttctggactttttttagttgggtatttatctttgttttttgtttatttttattattactattttttgagacagagtctcactctgtcgcccaggctggagtgcagtggcacaatctcgactcactgcaacttctgcctcccaggttcaagcaattctcctgcctcagcctcctgggtagctgggactacaggcacatgccaccatacctggcaatttttttttttttttttagtagacatggggtttcttcaccatgttggccaggctggtctcaaactcctgacctcaggtgatccgcccgtctcggccttccaaagtgctgggattacaggtgcaagtcaccgtgccaggccatgtttttattatttaatagaagagttctttatattctggatacaaataagaaatacaaattgcaaaaattttattccattctttattgtcctcttatttttttgatggtatcatttgtagcacaatatttttaaagactgatccagtccaatttatatttttgttttttgtgtgctcctagtactaaaacaattacctaactcaaggtcacaacgttttattcatacatttttctggagagctttataattttaactcttatatttaggtgtcttatgtattttgagtgatgtttagggcatggtctgatgtgtaggagtccaagtctattttttttaaacatgcatatctagttgtcctgccatcatttgttgaaatggctgttcttcccccatttacttattttggcacccttgacaagaatcaattggccataagtgtaatggtttatttttggactttcaattttcttccatttatacacaatttatatttataccagtattatgtagttttaatattgttgctttgtagtaatgtttgaaattgggatggctgagtctccaactttattcttcttttaaaaatgttttggctgtttgagactccttgtaattatatgtgtattttagaatcagcttgtcattttctacaaagaagacagctcagattctggtaaggattacatgaaatctatagagtaaatttatatatcatcttaccaatattaattcttcttatccatgaacatgggctgtctttcaatttatttataccatctttaatttttaaacattttataattttttacagtacatcttgtacttcttttattaaattatttcgtgagaattttattttaatactattttatatgaaattatttttttaatttcattttcacattgtttattgctagtgtatagaagcacaatagacttttatacattgattttatatcctgcttacacattgatttggtatccttgcttaattaatctattagttctaatagactttttgtggattatttaggctatccaagatcatgtcatatgtgagtcgtaatagcttcacttcttcctttccagtctggatacttttaattctgttctttgctttttttttttttttttaatagctacttggtttgataagaatctccagtacaagcataaaaataagtggcaagagcaggcatccatgtctcattcctgattgcagtgggagaaaagattctgttttttactgttaaacatgttagatgtgagtttttaaaaaaatgcccacactatttatcaagtacccgtatttgtgcacccttgtcaagagtcaattgtccataaatgtaatggtttgttttgggactcttaatttcattccattgatatgcattgtatatttatgccagtatcatgtgggtttaatagaaatagagaggaagttctttttatttctagttgagtatttttaatgatgaaagaacattggatttttcaaaataatttttctgtatttattcggttatttttgtttgtttttctttttttttttctctctctactggtctttttccttttagtgtggtacattgcatttactgatttttgtatgtgaaaccaactttattttcctaggataaagcccactggatcatggtgggaatctgttaatgtttgcctaaatttgctttgctaatattttgttgaagatttctgtaaagttggtagtgatgtctccctttcattcctgattaaaacatatgttttaaaaaatgataattatgaccgggtgagaaaatcttcatatctttgtgggtctgtatggtttgtgtctgtatgtaatttcagaaaagtaacatgcatgctagattaactatgtgtatagttagatatttgtatatgtgtataagacttgcagacattttcccttactgcgtttatgtttgtaagtttatatttataaaattgaatataatatcaatgaaaaatttccagttgtgctattggcataagattgatacctttccaaatcaagggtcccataagaaaattgcaaaattcagcatcgaatatatcatacttggtgctgcttccaaaaatatacaaatattcagaaatatattttaaattggatatgtgaggcacctatcacaaaatgtcatttataacaaattatgctactttacaaattaagataataaatatttgttgacaaaataaatgaagtaaagacagcatgatgtatgttcaaatactgtaaaatttagttaccttttccaaatacagactcagaaaaaatgcagttttgtttattttatgtaagttttactttctttgatgccctttaagtaattgcacttgagctgacttgatatcaactgagaagcaaggaaaatatcaaaaagtaacattatttaaaatatattattttgcgtttataaataggcacaatttaacagtacagatcttaaaattaaaattatttaattagtattatcttcatttcatatttgaaaaagtgtgagtttgtgtcattaaagcactaaaagatgcaaaacctatgcaaacaaatgaaagtaaatatattaacttttctcaattccctaccaaggaacatcatgttgtcataactatatgtattttatcttcatagaattagttataagtagtaaatgcatgttctttaaaagtgcccttagataaatgttgtcaaattctctatatccaagaaatcactaccacaatcaagataaacattttttttcaccccaaaagtttccactgtatctcctccccatcacttcctcacctgccccaaggtgcagccaaatactactttttaatttcttttggtcacaaatataagggtttttttttcttttaagaaaatattttatgctttatgggccattcggtctgtgtgcagcagctcaactctgcttctataaaatgaaagcagtcatgtatactatctaaacaaatgaatgtggctgtattccagtagaacttatttcatatacacttaaatttgaatttcatgaaattttcatgttatgcattttttcttcatttttttttcttcaaccattaaacattttaaaaatctaccctaagctcatgggtcatacaaaagtaaaagacaagctagatttggctcatgggctatagtttgatgatccttgctgcagactgtatttgttatttctaaagttttgcatacataaaattaaatagaactttcgtttctgatttctttcactcagcatttttaatttctctttttttttttgctgagtagtattttattgtctggatataccacattttgtttattccatcacacctggtttttttctagtttgtaaggagcaatattatttgttaatattgttacttacaatattagtgttaatatttatgtgtttatatttatgtgtaagtgtatgtgtgcatgtcttgcatttctcttgggtaaatactttagagtggaattgctttttgtgctatcataaatttgtaaacgtatgtgtcaccttataggaaattgtcaaactgtttttcaaagtaattgtatcattgcatatttctgtcagaaatttatgaggattttagtgtttcattttattgtcaacatttagtgtcgtcaacctttttacattttagccattatagtatgtgtttgatggtatgtcttgttgatttacaattatatttgtctgttggctaaggacattaaatatcttttcatgtgtttattagcaagttgtctatcttttctgcttgtgcgtatgaagtatctattcagatcttttgtccacttttaaaaactgggctatttttcttctttctgttaaattttaagaagtcttataatatttcacatagaagatctccctcagatatatggattgcgaatatttccctcagcctatgacttcacttttcattttattaagagtatcttcttataaaacgaagatgttttaaagtagataaattatatgtttttttctttgatattttatactttttgtatcacgtacgtgaaatctttacctaccccaaggatgcaaatattttttctctgtttttttcttccagaaattgtatagtgttaactcttacatggaaatttgtgattaattctgagtaaaatttgtgtgtaatgtgaagttgtgatactggttccttttttctcttccagatgtccagttgttctagcaccatttgttgaaatggcaattcttttctcattgaattactttagtacatttgttgaaaactaaattgatggaatatgtgtaggattgtttctgtcttctctattctggtccattgatcactctctttggcctaatgtcattaccaaactttcttaattgctatggttttaaagcacatcttgaaattatgtcttttaagtcttctgtcttcgtcttttttaaatgctttttttttcttcatgttttaagatgtatataagttttagaagtagcttgcaagtctctacaaaaatagccggctggaattgtattgaaattttataaaatttgttgtataaattttgggagaaatgatactttaccaatacgtaattttctaattcatgtgcatggcatatctatttatttagatatttaaaaatcctttcagtagatatggttgtcggtgtatagagcttgctcatattttgttaaatttgtctctaaatatttcacaacctgttgctaataaatgatattaatgtttgcggcagcgctcctttcacgggggcaccagctgcggggggtctgtcccttgcagatccttgacctggcgacggatgaataatgtatacttgacccacagatattctgctttgccaatccagttgagggtgttcaagctgcttacagactccccactgagtgctgtaaacagttgtgactgccttgatcagctagtgagactcgcatttattcagtaagactgattaacaaaggcttgagtcaacaccagtagaaggtaactgacattgtggacttctcctccagtaaaaagcacttaagcacccaaggtacatcaaaggttagtcttttttttttatttttattttattattattatactttaagttttaggatacatgtgcacaatgtgcaggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgaagccataaaaaatgatgtcctttgtagggacatcatgtcctttgtagggacatggatgaaattggaaatcatcattctcagtaaactatcgcaaggacaaaaggttagtcttaagatcagatgagtaaacaagctagctaggtaaactactatgccgtcctttgttgctgctttaatttgtttaaaggtaaagggaccaggctgcctttagccagttctattaccgaagctatgcaaacttctcggcctttcaagatttgtgtgtctctataactatctctgatatttttcctaccagcctgattgaacccctacaaatgttaatttcaatttctagttgcatgttattactctattaatataattgttttctattgaggtacaattcaggtaacacaaaattattatgaaatccacaatccagtggcatttaggacattcacagtgttgtgcagccaacacctgtatcaatttccagccatttccatcactgcaaaagaaaacccataaccattaaacaacccagccctgggcagctacaaatctgctttcagactttatggatttacctgttataaatagctcctataaattgaatcatgtaatatgtaatcttttgtgtttggctttttttcactgcatatttttttaagattcatctatgtagcatgtattagtactttatttcttttcattgctgaattatattccattgtatggatattttatcatttataagttgatgggcctttgggttgtttccacttatggctattgtgaatctgatcactcgtatcactactgtaaatctactacttatgttatgatatatagtatcgtcatcatcacttttgaaggaaatttgtgtttattataaatttttagttttattgtgtgattaagtgttgttaccactttgtgtaaggtactgatgttttcctgtgacataatgcatgattatgttttgtgaatgttttatgtgtagtgggaagaaggcgtattctttagtatcaaggcataagcctggaatctattcagctatcttgttataatatctaacttagtgattattttctttaggccttttacagtttttcatattttatatctactgttttgtactaagagtggtgtgctggtttctactaggtgtggtgtgctaaagtctttctatttgtctccttactccttatgtcttctgtgattttgctttgtaaacatagttgctttgttatttgtcactgaaatattcataactgttatatattcatgatgacttttagctttggtactaaaaaggtctttgtcatatttaatgcttttttggtttaagttttattttaatttaattgataccaggtttgtaatctctgcattcttattgtttccatttgcctggtaaaccttctctatctcttatttttagtttttctgagtcacttggttctaaatgtggctctactttagcgcatgtagttggttgtgctttatgagacaaaatagataagttaagcctattcatcttcattgttattattgataggttattttttctcatttatgttatatatacacattatttataatgtgtatcatattatatttgttgtgcttatttctctgtgatgtgtttctctgctctttaattaaaaaataatatttacattcatggagatttgtaattttgttccattactcacctttgtttttatttatgttttgaattttatttttaattttaattgacaaataataattatatgtattatatgtttgtggggtaaaatgtggcatttacattttgatatatgttttcattttggaaggatgaaactaagctaattatttttgtgttaataacatttaaaatctactcttagtaattttgaaatatatattctgtccagtagattactaaagcttattcctcctaaccgaaattttgtactctttgatcaacctttcttctttccccttccatcgctcctaaccctggcttgtggtaatcatcattctactttcttcttctatgaatttgatattttttagatcccacatataattgagatcatgtagtagttgtctttttgtgcctggtttatttcatttagcattaattcatcttgtctttttaaaagctgaggccgggtgcggtggctcacacctataataccagcactttgggaggccgcggatggcggatcatgaggtcagaagttcgagaccagcctgcccaacatagtgaaaccccatctctactaaatatacaaaaattagccaggcgggcattagtggtggtgggtgcttgtaatcccagctactcgggaggctgaggcaggagaattgcttggacctgggaggtggaggttgcagtgagccaagattgcgccattgcacttcagcccgagactccgtctcaaaaaaaaaaaaagctgaatagtattcaaatgtgtatgtgtatatatatatatatatatatatatatatatatatatatatatatatatatttcatccaatgatggacacctaggttgcatctatattgtagctattgtgaataatgctgcagtgaacacaggagtacgactatctctttggcatacttatttcatttcctttggctatatacccagaacaggagttactggacgatatggtaattgtaattttacttttcagatgacactccaaactcttttcataatgactattattttaaattttcaccaacagtacacatggttcctttttctgctcatccctgccagcatttgttaaatttcatcattttgataatagccacttaaacacgtgtgaggtgataactcattgtcattttaatttacattttcctaatgattagtgatagtgaacagtttttcatatacctattggccatttgtatgtctgcttttaaaaaaaatttatttaggtcctttgtccattttaaaattgtgttctttcttttcttgctattgagttgcttgaatttcttatgtattttgaatattagcctcttaccagatgtatgggttgtgaatattttctcccggtatgtggattgtctctttactctattgattatttcctttattgtgcttaagatttttagtttgatgcagtctcatttgtttatttttgcttttgttttgcatgtgcttttgggaaaaccaagaaatttttgcccagatcaatgtcatgtagcatttcccttgttttcttctacagttttgggacttacctttaagtctttagtgcattttgagttgagttttgtgtattgaataaggttctaatctcattattttgcatgtgaatatctagttttccctgcataatttattcaagagactatcttttctccattgtgtgttcttgacacttttgtcaaaaatcagtagattgtcagtgcttgagtttattgctgggctctatattctgttcctttggttgatgtttctttttctttatgttggcactatgctgttttgtttaatataggtttgtagtatattttgagatcaaatagtttgatgccttcagttttattcttgctcattaatttccatatgaattttaaaattgctttttctctttcagtgaaaaatgccattggcattttgtcagaaattgcattgacttagtatattacttttggtagcatgggcattttaacaatactaattatcccaatccatgaacatgggctacctttccatttatataagtcactcgctatttctttccttaatgttttgtggttttcagtatttagagcttttaagtccttggttaaatttacttccaagtattttttatgctatcatgaatgggattgatgtcttaatttctttttcagttagttcattgttagtgtgaagggatgttattgatttttgtatgttgattttgtattcttcaactttactgaacttctgtatcagttctaacatatttttgggggaatctttagggttttctgtagacaagatcatgtcatcagcaaacagaaacaatttaactttttaattaactttttaatttcctatttggatgccctttatttcttcttcctttctgtctgtttgctgtggctagaacttttagtactacattgaacagaagtggtaaaggtggacatccttgtcttctttttgattatagaaaaaagctaaactttttacctttcagtatgatgttagctgtgggtatatcataggttgatgcagaagtaattgtggaatatatgacctttattgtgttgaggcctggagcctgacaatgcagggactagtctggtagtgggatgggtctggattctgatactgcagtggccagcatggagcttgggactgtggggtcatgcttgaccttgggttcagtgaggcagatctggtgttgcagtccaatgaaaagttgagtgcttatttcattcttccttgacttaggggtatcttgctcagtgttgtgctgcttgggcttgtgggaggggtaatatggataatattaaactggcttttctacactattcaatgcatttttttttttctttcggactgcagtaaggtggtataatctcttgtctggattccttagctgttgggaaggtattatgatgcatggatagtttttcaaatgaatgtttctatgagagatgaacactagaaagtcttattccactatcttcctaacatcactcctctagagttttttttttaatccagatatatgggggttttagtagagttttatttgtttattattcatttttgacttaattgtattgtcatcaggactcattgtatgatactatttttaggaatttgttgcagttatcttcatttgctaatggcaagttaaatattataaatgatttatatatgctggtttttaaaaacaggaattgataaacataaaatttagggtagtggttacttctggtgggaagaggcagtaagaaaggttaagggagcaacacacagatcgatacaagtagtagcattagaaatctagtccttaaattagatagtttaattatcccattatataaattactaacagttttacaagcagaaaatgtacatgctatttaaaatcaccaccataatcttttgtcttcacaaaataataagcagtactttttttcagattttttcttatatagatgtaatttatatcattcccaagcaagacatagagtataatcaaaatacagtagttttctctgtcactgaccctttaaaatatattcagtgcaatacatttttcccttgatcttgtatgaaatctcagactcactcttagttaatataaggaactcctgagaatttaatttgcaaacacgtgtgtaagtaaataattaaacttgtctagatcagataaaagtaagaactctgaacatattttgaagccaaattttctcttctcctctattccatatgttctttcattcttagcctagtattttcctcctttcctggctcaataatttttttgatctttctaggggagaggagaaaattatagtcttatgtgtgaagaatagttgtcatatttagttaaggtcctctgtgtgagagatgcacaatggctgatccattctcacataaatgtctttgggggctcttctgagtcttgacctttctagatgcaattctcgtgatctgtgggagacacatactttcttcctgttctggcaacttttacttcagttttcagttgaagtcctccagcacttccaggcaatcctgttggtcagaatattaagtagatgctggctagctggaagaaacatactttctttttcttgacttcagtgttagtacaaatatttcctaaaagtaactgtttctatttgtccttccacctcagttaaatagccatagctggtcacacctaattcagaatttcctctaatatgccacctagattttaaggggacccacagcagactcttcaaaaacttctgtgaagtcccactcattaggcttgtgtaagaggacagacaaccactcccttggcaggcagaagactggattactaacactgaaatgggcttttctgataatccccatccaatctttccccctttcactctttttgccccttttattgactctatctggttcaaagattactggttttgaacttttgttttagtctcttcttttgaaaatgttcatattggtcttatatttcacttaggtatacagtatctattttctttcagagactcaattgaactagcaatatgattatctggttacatttgtttgcatttattaattcattaacatatatgttagagttactattgatactggaagaaaaataatgaaaaagttgaacattgggaaattttgactcattcacttaattttatatggctctacaattcaggaaaagaccatatcatttcatttttgtcaatagaatggtttagctaactggtagtgtacaagaacagcagtagttctcattaggtgtttttgaaagagttagtgacaccatcagccttgtctgtttagaatgtgttattggattggagaattaattgtaacctggaaatactgaaggcaaagatatctgctatgtgattatattgttgtcagtaagagaaagtggatgacaatactttgtggtggctgttagaatgaaaaggaggggtcagatacaagaaagattatacatgtagaaattaaaatctaccaattgactggatgttggacataattaagtgtgaggtttatgtcctaaataattgaacagtgctctttaagaaaggattgcaaagtaagaaaaggagacaagtttatatgaaccaaattaatcatgcaacttttacaaaatggaaagtttcgtctagtactctaaaaggatgatctaaaaagatctaaaaggatactctaaaaggatgaggatgatctcagaaacttaaaagggtgaatttagaggaaataaatagatgttcttttttaaaacacaatctgcagctatgtttttattattcttaccagtagtaataacagtggaagtaatatctgccaattattaagtgctcaatatgtgttatgtgtcttaaattacattacctcatttaattttcacatcaatcctggaagctaagtgctgttattcttcttttgcaaatgaagaaattaagcataaacaggttaagtaaattgtccaaggtcatatagtgattttagatgtaaattttgaacccaagctgtttgagtacaaagctctggcactaacgctttgaaactcactttattaaagaaatataccaaagtgaaaatggagagaagcccaaagaagaattagataacagttatatccacagtagacttcaggatatcccccaaagactttaaggaatttcacaaaattttcagaaaagtgaatttacttccctttaattaaaaataatttatactatctggtaaccttagtttttggatggcaagaggaagttacaggacataaaaataaggtaataataatacttgaaatgtgaaatgtgcatgtttgtgatgtagaatattcaatatcattttggttttgacttacagcttgtacatgcagtggccatgcaaatatctgtcatctgcacacaggaaaatgtttctgcacaactaaaggaataaaaggtgaccaatgccaattgtaagtaagaatgactttttagaactttcgtggattgaatttgtgttgttgaagtaatttttatgttttactttttaatttagtgttgtgctagttaggcatacctttattacaatttttaacttttattttagatttgagggtacatgtgcaggtttttaacatgggtgtattgcatgatgctgaggtttgggatatgattgatcccattatccagatactgtgcatagtacccaatagataattttaaagtactttttccccttcctgcctctctctctctagcagttcccagtgtctgttgttcccatctttgtgtccctgtgtaccaatatttagctcccatttataagcaaaaacatgtggcatttggatttctgttcctatgttaatttgcttaggataatgtatccatgtggcagaggatatgatttcattttttatggctgtgtagtattccatggtgtatgtggaccacattttctttatccagtccagtgttgatgggcatttaggttgattccatgtccttgctattctgaatactgctgcagtgaacatataggtgcatgtgtctttttggtagaatgatttatttttctttgagaatttacttgcacctaatgaattctctttaaaaattaaaccttttaaagaacaattttgtagaggctttaaaacaaccccatagaacatgttatcttttgcatttctagaaaaagatgcattcttaatcttatgtatcaaatctacattatctttacacttttctttcatattatacctaatataatgtctctatgccgttcttttttcagtcatttattattaattctgataattaattccaattcttgtcctttaaccctttcagctggttccttatattcatcttcttctcttttctctgttctttcagtatgcaggaaccctctactgctactctcctctctgtactttcatgaatgatttttgtcttagcatttagtttttattctaaaattttattttccttcaaaaattaactttaaaaggcagcattttaggctatttaaattgttttttattctttttcttgtttatctatattattaaaatcaaatttttatggttttgaattatatatgtacaaatacatgtttatattaggtatatatgtactgtatttgacacaaataataaattccaaccataataattacagaaacatagggaaagtttaataaagaattcttcaaaactataaatatataaaaatttatacctaaagtctattaagcatggaaaatgatccttttatttttatttaaaataaatatattacttgttgcagagttatcctaaatgtttcaagttaggtgattatgtctttgcttagccacctaagtattacagattttcaaattcagacaaggtaagcacaatcagtttttattccttctctatagtctgaagttaaatacaagttcacagcaaaagatcttgggggaattcctattaaggaaggccattttggtcttaaaaccaacggaattaaatcattgtcttctgttctaagatcaaggatgcctctaatactttgcaacactaaagcttgattataagtaaggccaacttcatgggcacgtggcctgtgaatttatacaggttcccacacttacaagggcagcacacttggtttagtgctctgctatcatcatcttgaaattcttaataacttttaaataagaactctacattcttcttttgcacaatgttctcctattccctgcaattatgtataatagcatgttctggttataagtaatgtttctcttgattaacttctattaaatatgttggttggatagcagtgtgcagcaatgaaaatattttctgtagaccatagtggcagtattacagataaaaataatatatgagattctaccatgatagtaaacactgtcaatcttcttagtatagttttacttaaatagtatagccatataactatccataataaatagttctttgatacagtattgcagtaacatatttttgtttacagacaaaagaaagcagaattttaattcattgaaatagtgagcttgtaagcttagctaaaatagagttataagatttggcatatgtgcaaaatattagaaaatcaatcatatagttcttaatgataaaagtacattttccccgttctcatttatggctttttatgaagaggataataatggaatactaatttgtaaagagtattttgtaggtggtatttgtacacagaattccattcatttacttttttgtttatttagcttttgagtatggagcaataaagaataggctcattatttttagagcaattaattgctataatctgcttatacctgaaaaaaatggtttgttaggaaggagagctactccttcaaatcagtaaacaattattaagtgagtacttgatactactaatgaagatgaataacatatggtttttgttgaaagtatctcagactagcagtgaagacactgaccaaaatacagtataccaatttcttacattagtgatttaatatgcttatgaaccccttccacttcttaggataatttctgtttggttttaagtatttagtcagatatcatatcttatatattcttaataaccatcctaaactgaaatcggttctcttcatatctgttaatttcttttcttgcattatttgtgtacttgtctgtgtcctttactagagtgaacttttggggggaccattgcaacaataccacaatgtaagtgttcaataaatttgtttaatagaatggaatgaagaaagtattgatggagcactgaaaagggaagtattaatttattttggttggataagaaaaatttaagtagaggatgtttgaactagaacctgaaggagtaataaaatcaactttctgggaaaagaaaataggaaacaaggggaaatgcatcaataaaagcaaagaagtagaaatgaacatgatcatagcatttccggtctttgctcaagaatgttgagagctggaaaaatattgcttctacccttacaatgaaaggggaaaaagctggataaactgtaaattcatgagttttcttgaaaccattggagaactgagaaaacagggtaatcaaatgaccacaaatctaaagagagacaagagactgcagagagatgagacatgaacattggcttacctggagcaaaatcatctggaaactgataagaagagatcagctagggtagttgatatttggcggggattaggtatacactgtcaatagtgtgaagctcctgggagccacagaaattggtagagtatggagagcatactctttgtagagttttcaagccacctactgtggctgccattcccttccaccagttgctcaggtaaaaaaaatgaacattttaagagagcattccttgtattgtaccttgtggaagggattggcagccgcagtgggcagggcatcagtagtacagtcaaaatattcatttagatgagcaccaaatgattcattttgctgtagtaatgacagttttcagtctttttttggcccaaaacacagctgatcgtcaaaaattgtaacttaaaaatgaatttccatttgtgtcatctctgatttttttgtgcagtggtttttagttttccttgtagagatctttctcttgcctgggtgttttcctaggcacacataattgtgtggcagttatgaatggaagttctttcctgatttggctctcagcttgactgttattagtgtataggaatgctattgatttttgcacattgtatcctgatactttgctgaagttgtttatcagctgaagaagcttttgggccgagactatggggttttctagatgtaggatcatgttgtctgcaagcagggatagtttgacttcccttctttttatttagatgcctttgtttatttcttttgcctgactgccctggtgagaacttcagatactatgttgaatggaagtggtgagagagggcgtccttgtcttgtgctggttttcaaggggaatgcttccagcttttgtgcattcagtatgatgttggctgtgggtttgttatagatggctcttaatattttgaagtatgttccttcagtacctaatttgctgagagtttttaacatgagtggatgttgaattttatagaaacccctttctgcatctattgagataatcatgtgctttttgtgtttagttctgtttatattatgaatcacatttgctgatttgcttatgttgaaccaaccttgcatcccagggataaagcctacttgatcatggtggataagctttttgatatgctgctgaattgtttgccagtgttttgttgaggatttttgcatcaatgttcatccaggatatccacctgtaattttctttttttgttgtgtctctgccaggttttagtatcaagatgaggctggcctcatagattgagttagggaggagtcccttttcctcaattttttattgaggagagtatatctggtagaattcatctgtgaactcatcatgtcctgggtttctttggttggtaggctattactgcctcaatttcagagctgattattggtctgttcaggaattctgtttcatcctggttcagtcttgggagggtttatgcgtccagaaatttatcctttttttattttctagtttatgtgcatggaggttttcataatgttctctcatggttgttcatatttctgtggggtcagtggtaatacccttcttgttgtttctgattgcgtttatttgaatcttctctttttcctttgttagtctagctagtggtctagcaattttattattttcttcaaaaaccagctcctggatgcattgatctttttatcttttgtgtgtgtgtgtgtctttatctccttcatttcatctatgattttgtttatttcttgtcttctgctagctctgggatttgtttgctcttggttctgtagttcttttagttatggtgttaggttgttaacttgagagctttctaactttttgatgtggacatttagtgctataaatttctctcttaagacttcctggaagacaacctaggcaatgccgtttaggacataggcatggacaaatatttcatgatgaaggcaccgaaagcaattgtaacaaaagcaaaaattggcaaatgggatctaattaaagagcttctgcacagcaaaataaagcattaacagagtaaacagcctacagaattggagaagatttttgcaaactatacatctgacaaaagtctaatttctatcatctataaggaatttaaacaaatttacaagaaaaaaccaaccccataaaaagtgggcaaaggacacgaacagacacttttcaaaagaagacatatatgtggccaaaactcatatgaaaaaagttctacatcactgatcattagagagaattaaaactggacctcttccttacactgttaatgcaaaaattaactcaagttggattaaagacttaaatgtaaaactatataatttgattgtgctgtggtccaagagactgtaatgatttcagttcttttgcatttcttgaaaagtgttttaattctaattatgtgattgattttagagtatatgccatgcagtgatgagatgaatgtatattgtgttctttttgagtggagagttctgcctgtatctatgagatccatttgatccagtgctgaattcaggtcctgaatatctttgttaattttctgtctcagtgatctgtctaatattgtcagtggtgtgttaatgtctcccactatgattgtataggagcttaagtctctttgaagatctctgagaacttgctttatgaatctggattctcctgtataggtgcatatatatttaagatagttagattttcttactgaattgaaccctttaccattatgtaatgctgttctttgcctttttgatttttgtgaatttaaagtctgttttgtcagaaactaggattacaactcctgcttttttctctttttcatttggtaggtagatttttctccattccttagttttgaggctatgtgtgtcattgcatgtgaaatgggtttcttgaagacagcataccaacgggtcttggatctttattcggtttgcctttctatgtcttttaattgggggcatttaacccatttacatttaaggttaccataaaatatttaatttccaacagaatttaacaaagacattgttatgtcttatatgcagtaagtgtactaactaaatgtattttggttggaaaaagataaacattgatttattaggttaatggttcttggtggagatggaatagcaccccctagaacttcataggttttcataattaattattctaataattggggagtgctactggcataagaggatgaatagtcacagcctcttattagaatgggcacttacagagaccaggaaataaataaaatctaagtccaaatatgtttcattgagtacagtagatctacaaactcactctgtagtcattttccctgttccttagttcataattaaaatggatgtatgtagcagccagcagatgtctcatattggcttcctgacctgtggagaaagagccagtaaggtagagaagggccaagagaaagaaacccttgaaactaattccattcattctggacccagtcaagatggcaaatcagagatctcatgtcaagacaaatagcaggctgctgaaatggagaaaatgagggattatgatattctcaaatatgagctggatcctatttataagtgtagtgccaaaataattccctagcttaaaatgtggacagaattgtgataaaatctaacagaaaatatattttctttcttgaaatcctaccacatgtcaatgtatacattctgtttctggtatgtaaaaagactgtagagactatatcatgtcttaggaaacgggacatatttgaaaaggaaatagtaatataagagccagtcaagtcatgttgtagacctctggaacattatcagagtcccctgtttaaaaacaattgcaatctcccccacagtaattttaccatgtagtttctaccgcatacattttatattatagcactatgaaattttaacaaatgcataggacaggaataatatgataattttagttcctatattatgaaattcagtagtactcataatttggcaccaatttaatatgtttttgtttttatctcttaagaggtatctcaaatattctccagacacattgtatactcacagatgtgtgtgagcaggatagctattggtgatgagattttcttaaatgaatatctcttggtcaaattctgaataatattataaaaggtatattttcaatttacatgatagttgcagttgtagaaaattcaatatgtgttataaatatgcaaaactactttgtgtttatatgtaaaatggagttagattccaggctgaaatatttatgagcacatttttcacctacttaaacatctgccatgttattctaaaattatatgagattttgatcccttttttattttgtggaattactttgtatttttgtaggatgtctgcacccctggtttctctttcattccattcagtaaattccagtggaactccataattatggaaataatgaattgttactcacaaatttatccccactcacaaccatgtgccttaaaaattagtgttttcccttatctagccaaaaaaagtttattgtttcactgtttaatataagagctcagatcattttattgatttctggtgaaaagtacatataaatggcactcttagatattttgttggtagattagtcaaaattgatgagttgattcaaaattgttttactctctgttcacagtaaattgaagataaacttctcaaaggcatttggaattaaaaataccatttcctaagatatatggcaatattactaatcaggatcttaattgtgctaattaacttataactggctccccttttctgttccttatacctttcccatttactgatcttacaacttcttcatagctacttacttcaggcttaagaccctggttctcagaattagggcacagaagaatctcctgggatatggtgactaaactcctgggatgggagccaaaattctactttactaatagtaaattgtgaaataaaaattcttgatacattttgagaaatgttgccgtaggaggatcttcctgaacattttttttcctccttggcttacctttaggccagtaatatctaagattattacccatttttctctatcttgttttatcaagtctcttttgtttgtttgttttgtgaaattgccttaatgatgatgccaatgaattcctttccgttttaggaagatcaaagttgtgccttcttttctagaacagattctggcacatactagggactttagatttttaaaaataatgtatcttggatctttatttttcctaattactctcatctttttttttttttttttttagtctgctatatggggaaaagtacatcttttctctatgtgacttaatctacattgttataatagagactacagaggaagaataattttctgtacagcctgcctgcacataggttatcacctttataaacacaattggataagtaactagtgactatggtcttcaaatactgacactaactttttttttgtttgttttgagacaaagtctagctctgtcccccagactggagtgcaatggcacaatcttggctcactgcaacctccactctctgggttcaagcgattctcatgcctcagcctcctgagtagctggactacaggcactcgccaccgcacccggctaatttttgtatttttatgagagatggggtttcatgttggccaagctggtctcaaactcctgacctcaagtgatccgtccaccttggcctaccaaagtcctgggattacaggcatgagccagtgcacccagcctccaacactaaatattgttaagatttttctaggttgttttgttgctgtatttgcaactgcagataagactaatggtttctttgtgataatgagttaagcagccttgatgtctaatatataagatacttgaggaactcttatgcttgctttattctgtaaacatttattcactgagaggctatgagacagtaccaaaagcatacatctgaaaatatcagttcagaacgcatgttactcatgttaaggttggccagtatgaaaccatatatggttttgtccgatttctacccttgaggaatatgttttggtaacaagtctaacttgagcatataacttcctatgtcaggtaaatgtttgagttcttttggagtatgacttaatgaatttaaagctcttggattttaggaatgtactttcaaagttaaatgttagttctcccatcagtctttctataccaacaccttgtccctcaaaactatactagattgaatgtcatttaatcgccaattttgaaaacattctgaacacaactcagctgtatttcgcagcctccattgcagttaggttggaagtcatgttattgggctctgtccggtagacagaagtaacacccaccacttctaggcctggctcttaaaaacctcatgtgccatacaccctctgtttcctcattcagcagttcaatggagaggaagatgaggatctgaaagattgcagaggctaggaatagcccagatcctggaagactgcatggaccaagaccttttctccaaatccattccacactggacagtgtcttcaagctggaatcaaacttattgtatagaactgctgagattttaaggttgcttgctagagttagcatattcttccatgagtaattagtattcccttagcatctagcttgacatccttaattactgtactttcatttaaataaccttaagggtcctgttcattaagtgtgactgctggagtaggttagtgaacagtgtggtggtatttaggtttaatttgttctttaatccccattcatctcttaaaacttgcaaaaacctcccagctttttttttttttttttaaatcaaagctgttctcatttaaagctattgtttgggagactagtatagtccatgatttccaacttgattattacattcacataaggcataaaagttaaatggctttatttaactctagatggtcagaatggttcccaatacatgatagaattgttggaattgctaataaaaaagaaaagtgcacagtaaagaacagagtatcaagttaagatttaggatatactacctacaagttggaagaaattagaaaaagaaacaaatgtgtatgtcaaagaaagagacagcactttaagcatttattttactttgatcagtcttctatatatttattattaagttatcttgaaatatcaggggatgaaataaatagcctagtatgtcccaacttaacattgtatgaagaaataaagttttaacatttaaatgtagaaaatatatctggtatatgtgtaggtgttttatcaaaatatggactctcatgtcaaatgcatgtgtgttataggatgaactactgctatacactagtatgtccttttgatttatttctggagctccagtgtagtggctatgttgtatagtttagcacttctggttttatggaaaaatggtaagtgactgaacatatttcagtgtaatctctttttataacaattttcttttttgtcttgttttggcaatttgccggtgcaaatatgatatcctttctttattgttaataatgtttgtcctctcacctcaacataatgttttgagatttatccaagttgctgcattcagatagctgtaatgtgatcctattcaatgttgtagagtatttcattatataattataacacacttcattcatttgcctgttttctttttttttttaattatactttaagttttagggtatacgtgcacaacgtgcaggttagttacatatgtatacatgtgccatattggtgtgctgcacccagtaactcgtcatttaacattaggtatatctccaaatgctatccctcccccctccccccaccccacaacaggccccagtttgtgatgtcccccttcctgtgtccatgtattctcattgttcagttcccacctatgagtgagaacatgcggtgtttgtttttttgtccttgcaatagtttgctgagaatgatggtttctagcttcatccatgtccctacaaaggacataaactcatcattttttacggctgcatagtattccatggtgtatatgtgccacattttcttaatccagtctatcattgttggacatttgggttagttccaagtctttgctattgtgagtagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgttttctttttttgataattccagttttgtttttcctttttcaccattactgttaatgttttatcagtattcttatatgtttcctggcttacaaatgcatacattttgttgagtgtgtattcattattcatattttcaactttggaaaattaactgttttgtaaagtgattatattaaattatacccattccaagtctttatgaattttattaatgctccacatctttgctgatagttggtattccaaggcattttaattttgacacttctgatagatgtgtaattgctatgttcttaagcttaaaaaattccttagttcttaaaagtttattatgtttaatctttaaaagtttcatctctttaatcaccggtggaattttctctttttatgatgtagtattatctcaagtttcttgtgatttttctgctggattctccttaatcatttttagtaatattttatacatgctatgtacacgtcttttgttggtgatatgtttagtaaatgtcactctgtggttggactttcatgccaatttgtatgtctataatgagacattcttaattttaatataatccagtatatccatcttttccctatggttagtgcttttttgggttctgtttaaaaattctttctgttctccattatcaagtagtattcagatagccagttggtcatggaatttatttttggcctgaaggttttaactttcatccaatttctttaaaagagataaactattcagatttttgtttcttctagtgtctgttttgttcttttcctttaaaatattttcatttatttatttaaattggattttatttttaaattgacacgataatggtacatatttatggtgttcataatgatgtttcagtacatgcagtgcataatgatcagatagggcaatcagcatttataatctgtttgtgttaggaacattaacacaaattatctttccagcgatttgagctatataatgtattattgttaactatagtcctcttaaagtagtatagaacattagaacttattcctcctatctagttgtaatgtaatatgctttaacaaatctctccttatttctctttccctacacccttcccagccactagtaccttctgttctactttttacttctatgagatcaactttttttttttagcttccacatgtctaaagacatgcagtgtttaactttctattcctggcttatttcacttcatgtaatgtcttccagttccatccatgttgccacgaacgacaggatttccttctttttaatggctgaataatattccattgtgtatatatcctacatttcctttattcatctattgatgtacacttaggttgattacatatctttgctattgcaaatagcattgcaataaatatgacgatgcaagtatgcctttgacatactaatttattttcctttgtataaatacccagtagtgggaagtctgcatcatatgtatggtagttctatttttagtattttgagaaatttccatactgttttccatactggctgtactagtttacattcttatcaacaatgtataagagttcctttttaccacatccccaccggcatcttatatttttgtcttaaaaagacacagccattttaacacagccattttaactggggtcagatgatatctctttgtggttttgatttgcatttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagccgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatttgcatttcttgatgattagtgatgttggccattttttcataggtttgctggtgattttgtatgtcttgttttgagaaatgtctgttcagattatttgcccattttacaattagatcgtttgttttcttgctgttgcaatgtttgagttccttatgtattctggctcttaatatcctgtcagatgaatagtttgcaacccattctgtggattgtctttttactctgttgattgtttcctttgctgtgcagaagttttttatcttgatatagttatatttgttaatttttgcctttgttgcctgtgcttttgaagtcttattcataaaatcttttcccagatccatgtcctgaagcattcccctggcgtttttttctagtagttttattgtttctggccttacatttaggtatttgatccatttttccgttgttttttgtatagggcaagaggtgaggggtctagtttaattctaatgcatatggatatccagttttcccagaaccgtttattgaagaggttattttttctccaagtcatctttgttcttggcatctttgtcaaaaatcagttggctgtagatatgtaatttctgtgttctccattatgtttcattgatctatgtgtctgtttttatgccagtacctgtcattttggttagtactactttgtggtatattttgaagtctggtagtgtgatacctccagctttgttcttttttgctcaggattgctctgactactaaaggtcttctgaggttctatacaaattttattttattacttttttctatttctgtgaacaatgtcattggtagtttgaaaggaattgcattcaatctgtatagctttgtgtaatatggccattttaacaatattaattgtgattcgtgggcatgagatgtctttttatttgtttgcattctcctcaattttatcagtttattttgtagttttccttgtagagttctttcacctccttggttatatttatttctaggtacttttttgttagttattctagatgagatttgcctcttgatttctttttcagctactttgttgtttgtatattgaaatgctactgattttttaatgttgattttgtaacctacaagtttagtgaattcattcagcagttctattaaataatagtgttttgggagattctttaggattttctgtacacaagatcatgtgatctgcaaacaggacaatttcacttcctcttttccaatttggatgccttttatgtctttttcttgcccaattgctctggctgggactttcaacactatgttggataagcatggtgagagtggtaatttttgtcttgttttagttcttactgaaaaacaaacaaacaaaaaaacaaaaaccaagagcatgatagtaaaacaggagtagattaaccctgataccaaaaccagacaaggatacaacaacaaaaagaaaactataggctaatatccctgatgaacatgtatgcaaaaatcctgaacaaaacaaaagtgttcagcttttccctattcaaattagtgtttggtgtggtttgtcatgtatggcctgtattgtgttgaggtactttccttctatacctaatttatggggagttttttttatcatggagagatgttgaattttgtcaaatgctctttctgcatcttttgagattatcatatggcttttttccttcattttgttgatgtgatgtgtcacatttattgatttgcattgtgttgaaccatccttacattccagggataaaccccacttgatcttagtgtattatctttttatatattgttggatttgatttgcagtattctgttcaggagttttgaaaatgtccatcagtgatattagcctatagttttctttttgttgttgtgtccttatctggttttggtatcagggttaacctagtcctgttttactatgatgctcttgtttactgctattttttcatttatcagtttggagatttcagaaagtttagccatttctctttaaaaattgctacttttttttttttttaacagagtcttgctctgtcactagactggagtgcagtggcacaatcttggctcactggaaactctgcctctcgggttcaagtgattctcctgcctcagcctcccgagtagctgggactacaggtgtgcaccacacacccagctaatttttgtatttttagtagagatgcagtttcaccatgttggccaggatggtctcgatctcttgacctcatgatctgcccgccttggccttccaaagtgctgggattacaggcatgagccaccgcacctggcctctctctctctgttttaaaaatattatatgatagcattttggtgggtttctttagggaaaaaaagagaaaaataagtgtgttttaccttttatatctttatatcttcatttaaaaagaaatattttattttcagagacagagtctcactcaacttgtcatccaggctggggttcagtgatgcgatcttggctcactgcaacctctgcctcgtgggttcaagtgattcttctgtctcagcctcctgagtagctgggattacaggtgtgcgccaccatgccctgctaatttttgtatgtttagtagagacagggttttaccatgttggccaggctggtctcaaactcctgacctcgtgatccacccacctcggcatcccaaagtactgggactacaggcatgagtcatcatgcttggcctaccccttcatatttaatcataaaaatgcaaaattatttagcagattttcagctgttttaaataatctgtaatattttaaaattatggctgttacatgccccttattttagtctctgagtaaaaaaattatgtatcttgacaaggtatatgtatatatttaaacatttgaatatatatttaatatatttaatatctaagtgttcgtattataaattcaaatatttaaataaattaaatatttaaatttaaaattttaatttaaacatttaaattaaaaatactttaaaacttataaatgtagaattattttatattttgttttatacaaaatgtgtataacaatgttagcgtttacataaatgataatcattatttaggtgacatttaatgagattatttacttcttcaaagtctgtaatacatagttcagcctaaatctgttttccatgaaagtccagctgcttgattagtttgcttagtggaaaaggagtatgattatctctttgcttagacacagaaaccctttgaaattacatttttaattaagccattacagaagacttctaaaggcttttaatgtttttatcagtcttgaagggttctgagtttttaaaatattatttagctcaaatatcagaaatattaacatgatttatgttgtaaagtatcaatttgtttaaggaattattatttatatttaaatgttttacattttatttacctgttgtaatctgaagttgaacttgctaaaataatttatgtctcaatttgcttttttattatgtgaattagattagtggttcatgttcatacctcaagtaaatatattgaaatattttatattataaaattctatctataacaaaaattttatgttgggcagctcctatattgaccattaattatctatgacttctggtattcataccattgtgtagttccatttccttccttgagtgtgggcaggacctgtgcttgcttctaaaccagaaaataatgcaaagttaatgggatattactcctattattttgttacattacatggtaaaagtgatggttttcacttctgtgaatatgctgtgaagtctatgcttcctagaaaacttgctctagtgattttttcttttgctggctctgagaaaaatgtagctgagagtatcctctagcagctgaggatagccaccagccaatagcaagtgaaaaaccaaggccctcggtcctatagtggtaaggaaataaattttgccaaaaacctgagggaaaatagaagcaggcatatgcctagttagtcctctgattaaaaccagtcccagctgacacctgattgcaggattacagtggaccctaggtgcagccaacgtcttgattgcagtctgctgtgactctgaatcagagaacctggttatgccatgctcagactcctgatccacggaaacagtgatataataaatgtgtgttgattatagttaccaaatttatgtatttttattgagcaatagataactagtacaaatattatatccaagtactctgatattttatttactgaattatacaactctacattagatatttttgtaatatattccttaagtgttttcagactaggaaggagatttctagtctttggtagatattttcttgaatggggaaaataatttcaacaatgcagattaagacttttcctagaacagagcatttctgaagaaattttacctttgtgtaaataaacacagtagactgttacagaataaatgagttaaactattttaattgatctgagtaatttacattttatatctgcaaaattgccttaataaggtatttgtaattttgttatattgttttcttcttatgttgaaaatagttagatcctccattctgatttcttaatttgcatttctttgggggatctacaatgaaattgatggattatgataatcttgattccagatcatattattattaggttacatcataatccataacggatatgccaaacattttaatatcacctatttataacaggttagcacagttttatcaatttatttttggcatgtgaggaatgaggtggggagtcattggtttgcatagcattgcattgtgtataagtaatattttatacatttgtttgggatttcatctgttttatcctttgtaatgagatattttcccatgagtggtgactctgctattagaatcaatttgctagcctgtgaggatcttggattttgagtggaagtataacaagtaagcctgcattcttttttctcttttgtcttttttaagtgaattaaacgtggaacaaatttatctgataggacgtgacattaatgaaaataaaaatttgtttattcttgcctaatcttaatttttatgatgatgtttaccaactcctatggtagactccttcacatttaccagacagacctcaacatttttctataaacaagacccttcctttcttgtcccatttatttatctatttattattggaatggactcatgaattcctgtttttttcccaatgatttataattcactaatgtttttaaccactttggtgctcacattgtccaagatttggccagtaggagaggcttcaagctagctcttttgtttatgtgacacacctatcattttgtgaatacttccttactttctggtataagaagatatttcaggctcatcttattcctcttctgcctcagttgtggaatcagctgtatatccttttggagctctagttccttgtaatggaatatcatattagagaccaagatcttggtgctaggtatgctttttgctctttgaggtatctttacttagtgggttgtttggtgaacaaagttaggaaataataatttatttatgtgcacatataaatatacatatgtgcacatacatgcatacatatgcatgtatatacacacatataaatattttagaaagcatttcttcataccaaaacttccaattcggatctatttctgcaaggcttttgtaccttctccggctcagtatttgttccttcttctacagtaaatgaacactgacttccaatgacatcaacatatttacttgtttgctcaattctatattgtaatctaaaatagtttcagatttactttgcttatatcacttcagtaagaaaacctacataaaagattctggaatctgatttcaagcttccctcctccaccttgccctgcaccaattcggagtatgtagtcaaattttgggttcctaagttactttgaaccttccttccctccctcttctcttactccctcccttcctttcttctttcattccttttttccctcttctcttcttccccttacctctcctcctatttccctccttttttactttctttttccatcaatatagagataggattcacttgaagtttattaggctcttatttctacttacttctaattttatgaattttttcctttcccattcttattgtattaaaataattaattaaatatgttgaacattaataacctgaaactacttccagtatactcagagagattattgttcatttctttctccctcttccagtaggtaaccaattttattgttttctggtttatccttcccatctttcctttcataaaagtaaagctgtatgagctgtgtgtgtttctgtctatgtgcgtatcttatatttatatatatagttattatttcaccttcttacacaaaagctgacatattattagatgtattttagatactcttttgagttttacattttttttcttctttataatacttcctggagctcagttaatatcagctcataaaaatgttcatttttttgttctgttttgtttagagatgtatagtattccattatgcatatgtaccataggttaacaaatctattcggggacatttagacatttttctggtattttgcaattaaaattacgctacactgaataaactcgtatgtatgtagttttataatattggaggtttttcttaagagcaaattcctttcaatgggattgttgggtcgaagaatacatgcatatgtagttttttagatattgtcaagttgtcctccatatgaattttctcattttctattcctactagcccacatgggatggcctattcatctacagactcataagcaggatatattgctatgcatctgaaattttgccagtcttgtggagaataatttgtgtagttttaatttatatttccattattataagtgaagttgaatatttttcatgtggttaagagccatttttatatcacttttgtgaattgtctcttcatgtattttgccagtttttctataaaattattagtttcccccttatttttaaagagttctttatgaattagggattatagctctttttcagtgagacataagttgcacatatttcctcccagtttgtcatatgtttcttgacagtactaattgcactttttttttttgctatgcagctttcttaaggtagtcatatttcttagtcttttaaaaattacatttggaattttattcatggttaggaagccttttattttgtaattaattatgtaattaacttgtcctttattatgtaaaggttttattatgtaattaacatcctttttttactatatcgaaaattttattttttacgtttagatttatgcttcatttagagttttattttgtttatggtatgaggattggatctgatttgatagttttacaatagctatcaagttgtcttaatttattatgaggactgtcttactccagtcatttaagacaacttttatcatttactagatttttagcatgtgatagttgagcctgtttctggaatttctattgtacacatttggtctatttatgtgctagtaccatactatttaattatagagactttgagtatattttatatcttttaggtctacctctcttcaaagctcatctttttcagtgtttttctaattattcttgtatgtttacttttgtccctaagcattgagatcaacttttctagctcctataaaatctcattggagttttcattgaatcacattaaagttaaagattatctttgaaattaattgctattctgatgatgttgaggtgtcctacaaaagaataaataatgtctttccacttatttacatctacttttgtctttttcaagctgagtttcatacccaaaatcatattgttatgtttttatagaaagtatttatttcattagctttttggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaacaaaaaagaaaatgttataactttcatattagagaaatgagtttgtatccttgagctttttaagtcaatatctcagtattatcactttgaaaacacttgagggagagtgataccagcaagatggcagaataggagataacctactaatatttcttcacaacaacaagaactctgcacttatctactgacaaaagtcactggcaggagcctcaggagtcaggtaggagggtgtgaaagcccactggagcccaaggcccaaagagggttgttttgagaatgcagactggcacccaggtaatagatgcattaattttgcttccaggttcaagcccagaaatggccctgatccccaagggatttgactacagccctgtttggccttgagcctgcaactaaaatcatcttctaaggggtctaggagcaatcatgtgtactagtgtaagagacttgtttgcccactgatatcagtctctgcagtgaacctagaagtagtcctgtggctcgactccagccctctacagttgagttcccagcacagaactgctcacacaaaaccccagagggagacttgcccatatcctgcagattgtgagtctgagcctccttgataggcttgccaaacttatctttcagtagtacccaggttgtcatctcacagcacatcctgagggatccagtctgacccccagctccccccactgtagtcaggtaactatcatatctgtgcagggacctgctaggagatgtgcaaccatctgaggaattgaggtgggctatccaacctttgtcccacagtagatcctgaggggacccagcctcagatttggcccctcctgctgcagttggtgacatatctctcacctgttcagagacctcctgggaggcatgattgtctggggcactgggatagtcttctgggctaggtttcctggccagctttcccacacagcccagttaccctccttggatcttccctaggtccatctgccctgcagagccctgccaaccttggagccctcctgagacttgtggcagatatgggcttagactgccctctagtgtttagggagttgcagtggtcatgggctcagagaacacaacagtcagtccccttagaaactctggaaggccctctgaagaaggatgagcaaaaacaaaactagactaggaagactggaataaacacctgatctctcagtgcacacacattgttgcatgtccataagcatcaagatcattcagggaaatctgatctcaccaaacagacaaaataaggtgccagagactggccctaaggtgatggagacatgtggtctttcagacaaagaattcaaaatagctgtttttagaaagttcaataaatttactgaagctcaaacttcagtaaaattcagagaagcaatcagaaatacatgaacaaaacttaagagattgaaatattaataataaaaacaaatggaaatcctggaggtgaatgaaatgaatgagtgaaatgaaatacaatgaatgaaataaaaatggaatagagagcatcatcagcacaatagatcaaacaaaagaaagaattagtgagttcaaaggtaggctatttgagaacatagtcagaggtgaaagaaccaaaagaatgaaaagggccaaagaaagcttaccagatctgtgggacaacatcaaaataacacatttgtgttattagaattcaagaaggagttgagagacaaaggggccaaaaacttattaaaaataataacagaaaacttttcaagcctggggaaagatgtgaatgcccaattatagcaaagtcaaaggtcaccagattcaatcccaataagaataccacaaggcatgtcacaattaaactcacaaagatcaatgactaagagagggtctagaaagaagtgagaaaaaagaagcaaataacatttaagagagatctaatataactggcagcatatttctcagcagaaacctttcagggcaggagggaatgtgacaatatattcagaatgtggaaggaaactacctgccaaccaagaatactataggcagaaaaggtgtattttaaaaatgaaggagagaaggacttctgcagacaaacaaaagctgagggaattaatggccaccagaccaattctgcaaaaaatgctgaagagagctcttcaaacttaaagaaaagaatacttacattgattgttaggctaatactgtaattttgttgtataaaccacatttatctttgtataaagaatgaacgacaaaactataaaaaactacaataatttgttaagagatagacaatatgaaaaatataagctgtgacatcaaaattcaaaatatggaaggataatgagttaaaatgtaccatttttgttgttttcttctttcctttgcgatcaaaattaagtttttattggtttaaaataacttattatgactataagatgtttttgtgagtctcatggtaatgaaaaagctaaaagctataatagataacactaaaaaagtaaggaataaaacacattactagagtgaatcacataaccacaaaggaagcctttaagagaggaaaaaaggaaaaaatatctagacaactaaaaaagaagttacacaatcgtgatagtcatcccttacctatcaataactaccttgaatgtaaatggttgaaattattcagttaaaagagaggctgaacggatagaaaaatatgaccaaactatgctgcctacaggagacttactttacgtataaaacaacatgcatagattgaaagtaaatggatgggaaaagctatttcatggaaatggaaccccaaaaagaacagaagtagctgtaattatatgaacaaaatagactttaagttaaaaactgtaaaaagagacaaggccattatataataatagcaggggtcaatgcagcaagcagatacaattataaacatatatgtgcccactagcagaggacctatgtatataaagcaaatattaatagatttaaagggagagatagactgtaacacaataatagtaggggacttcaacactccactttcagcaatgtgcagatcgtccagacagaaaatcaacaaagaaacttcagtgtcagacaacactcttgaccaaatggacctaacagacatttacagagcattcggtctaacagctgcagaaggcacagtcttctcaacagcacatgtaacattgtttaagatagattatatgtaagggcacaaaacatgtcttaacaatttttttttttttttttttttgagacagagtctcactgttgtcacccaggctggaatgcaatggtgctatctcggcttagtgcaacctccgcctcccaggttccagcaattctcctgccttggcttcctgagttgctgtgattacaggtgcctgccaccatgcctggctaatttttgtatttttagtagagacggggtttcaccatgttagccaggctggtctcgaactcctgaccttaggtgatccacctgcctcggcctcccaaagtgctgggattacaggcatgagccatggcggcctggcctcaaatttttaaaaatcaaagtcatatcaagtattttttttctgaccactgtggaataaaactaaaaccaataacaggaggaactttggaaactgtatacgtacatggaaattaaacaagtcaatgaagaaattaaaaaggaatttaaaacatttcttgagaaaaatcagaatggaaatacaacataccaaaacttatgggatatagcaaaaacagtttttagaggaaagtttatagcaataatcacctatttgaaaaagtagaaatatctcaaataaacagcctaatgttgtacctcaaagacctagaaaacaagaatgatctaagtccaaaattatgagaaggaaagaaataataaagaacagagaagaaataaaggaaatagagactaaaaatacaaagcatcaagaaaatgaagagttggtttttgaaataagaaacgaaattgacaaagctttagctagcctaagaaaaaaagaggaatgattcaaatgaataaaatcaaagatgaaaaaggagacatcgcaactgataccacagcaatacaaaggatcattagagactataatgagcaatgatagaccaataaatttgaaaactttgaagaaatgaataaatttcttatagcttatcttaccaagattggatcatgaagaaatagaaaacctgggcagaccaataatgagaaacaagattgaatcagtaaaacaaagactcctatcaaaaaaagttcaggacctgacagcttcattgctaaattctagcaaatatttaaaaatgaactcataccaattactatcaaactattccaaaaaattgaagtagagggcattcttccaaactcattctatgaggccagcattaccctgataacaaaaccagacaaagataaaagtataaaataaaactacaggccaatatccctgatggatatagatgcaaaaacccataatacagtactagcaaactgaatccaacaacatattataaggtcattgaccatgatttagtgaaattcatcccagtaatgcaagtacagttcaaaccacaaaaattaataaatgtgttacattgcattactaggatgaaggacaaaaaccataggatcatctcaatagatgctaaaaaaagaatttgataaaatttaacattcctccatgataaaaccgctgaaaaattaggtgtagagggaacacacctcaacatatgtgcacatatatgcatccacagctaacatcataccaaacagggaaaagttgaaagctttccctttgaatgctgaagcaaatgccatagtatgatggcattcctatcaaactatgacattctttacataattagaaaaaattattttaaaattcatatggaatcaaaaaagagctcgagtagccaaggtaatcataaacagaaagaataaagctggggataccatgttaattgacttcaaactatattacaaggctgtggtaaccaaaacaggatggtacttatacaaagacagacacatagaccaatggatcagaatagagagccaagaaataattctgcataggtacaactatctagtcttcaatgaagctgacaaaaacaagtagtgatgaaaggactccctattcaataaatggtgctgtaatacctggctagccatatgcagaagttgaaactggacccctttcttacaccatatacaaaagtcaactcaaaatggattaaagacttaaatgtacgacccaaaactataaaaaccctgaaggataacctagataccattctggatgtaggacctggcaaagatttcatgacgaatatgccaagagtaattgcaacaacaaagaaaattgacaaatggcgcctaattaaactgaagagcttctgcatggcaaacaaaactaccagcagagtaaacagacaccttacaaaataggagaaaatatttgcaaactatgcatcccacaaggatctaatatctagaatctatatggaacttaaatcaacaagcaaaaaacgaacaaccgcattaaaaagtgagcaaagtacatgaacacacacttttcagaagaagacatacatgtgtccaacaagtatgtgaaaaaatgctcaacatcactaaccattagagaaatgcaaatcagaaccacaatatgataccgtctcacaccagtcagaatgggaattatttaaaaaaataacagatgctggcaaggttgcagagaaaaggggaccttatacattgctggtgggattgtaaattagtttagccactgtggaaagcagtttagcaatttctaaaagaactcagagcagagttaccatttgacccagcaatggaacacttgcagctataaaaaaagaacaagatcatgtttttggcagcaacatggatggagctggaggccattatcttaagtgaactaacactgaaggagaaaaccaagtactacatgttctcactttttagttggagctaaacattttgtacatacgaacataaagaagggaacaacagacaccagaacctactggagaggtggaggaagggaggagggtaaagttagaaacaacacctatcaagtattatgcttattacctgggtggtgaaattatctgtaccccaaacctctgtgacacacaatttacctatgtaacaaacctgtgcatgtacctctagtataacctaaaataaaagttaagaaaaatgataggaaaacaataatttattgtacattttaaaataaaacagtgtaattggaaagtttgtgacacaaagaaatgataaatccgtgaggtgatggatgtccttcttaccctgatgtcattattatacaatgtatgcctgtatcaaaatatctatgtaccccataaataagcacacttactatgtacccataaacattaaaaggtaaaaattggccaggtgcggtggctcaaactgtaatcccagcactttgggaggctgaggtgagtgaattgcttgagtccaggagttggagaccagcctggccaacacggcaaaaccctgtcttaagaaaaatacaaaaagctagccaggtgtgatggtgtgtagacccagctactagggaggctgaggtgggagaatcacctgagcacaggagatgaaggctgcagtgagctgagattgcaccactgtattccagcctgggcaaccgagtgagactgtgtctcagaaacaaacaagcaaatgaacaaacaaacaaacaagttaaaaatttaaaaagacacacaaactaatgaaacagaataaagaacccagaaataaatacacgcatgtataccatctgatttttggcaaaaatgccaagaatacacgttagggagataatattttctttaataagtgatgctgggaaaaagtttcattaagaagaatgaaactagaccccatctgtcaccacttaaaaaaaaatcaaaatggattaaagatttaaatgtaagtcctcaaaatgtgagactactggaagagaacacggaggtaacactttattacatttctctggggaaggtttttgtttgtttgttttggaaaacacctcaaaagcacaggcaacaaaagcaaaaatagagaaatgggattacatcaaaacaaaagcttctgtgcagcaaaggaaataatcagcagagcaaagagacaacctatagaatgggagaaaatatttgcaaactatgcatctgataagggattaatatccagatatgttaggaacccaaagaactcaatagcaaaaaaccccacaagtagtaaagagtggacaaaagatctgaatagacatttctcaaaagaagacatacgaatggctcactgatataagaagaagaaactcaacgtcactcatcattaggaaaatgcaaatcaaaatcatgatgagataccacctcacactagttagaatggctgttatgaaaaagacaaaaaaataacaaatactggcgaggttgtggagaaagaggatcttctatccaccgttggtggaaatgcacattaatacagctgtttgtggacaacagtatggaagtttctccaaaaattaaaaacagaatgaaaatatgtttcagtaatctcactactggatatttatccgaaggaattgaaattcgtattttgaagatacatctgtactcttacttttattgcagcactatgtacagtagccaagatatggaatcaatctaagtctgtatcaagagatgaatggataaaaatatgtcatatatttttggaatgtattttatccataaaaataatgaaatcctgtcatttgggacacaacatggatgaacctagaggacattatattatgtgaaataagcacagaagaaaaatactgcatgatctcacttatatgtagactctaaaaagactgatctcatacaagttgagagtagaattgtggttatgagaattgtggttgtgagaagctgtggaggattttgaaaggcttgggagggtatgaggagggtggaatggggagagattggtcaatttatacaaagttacagttagataggaatcacactttgtggtgctctattgcatatttctaaaactagaaaactaccatcaatgacaaaatcttaaaagtggtgtttggaaatgtcacagaaaacctaacacccaaagttcctttgtttcacagagtccttttcttccaagttagtgttttaaaggattatcatattttgactttaattttataattaatatacagtaaaatttactcttcaactcatttttttccatgaatataaaaactagctagcacatggctgaaaaatgcattgggaatgtaatctgattatttagcctctaatttttcactatttgactcttcattatatatatgtattctactattcctctgttcttatgaatgcttctgaaaaactaaagacattttagactcttttacctctttaaacttttaactagagttgaaatatatgtaatatatttatataaaatatgtatgtaataattacttaaaccatatgcaaatataatttttagtatttaaatattaagtcactttattaagttaccctggtgcataaattttataataatttattttggaggacgttccaagaaatgttatgcaaaaccatgctatatctctattagacattgtcaattttatttggcaaacaaggttttgtgaacttgaaaaattttgaaaatacttatgattttctcccactgctgtagttaactatatttttatgtattaaatataagagtacatgagtatggatgcgcatatgttctttcactttttaaaaatctgtttatgtgaattcaaagtttgagctcctgaatttaatctatattagtcaattttgtttgggttagagaaacctttttttccaattatttaccggaggagatctgtttttaaaaatacagattaattggtgtagaaactggtgtagaaaatttttttaactggtgtagaaaatatgttaatttcaaacaataccacaagtgtgaaaataatgtggatttatgaattccctgaattttcttctacctaaaaatatctctgtatcttatttcagactttcacttcttctgtttattaaggcaggatacatatcccaaagctcataattatatttcatctgccttttaacattccttatatgcctatcatgtatgtttattttctttttcttcactatttcatctctcactttttctcatatataaagctttctacaattaattcaaatttcaaacacatctttcaaagatgtgtttttgaaatttcaaataatggtatagttttaaatatgttttgatgtagaatataaatacttttttgcttgaagaaaaacatgaggcttttgaattgcattgtttaatagtaaatgagtttttgtgtttctgcagatgtgactctgaaaatcgctatgttggtaatccacttagaggaacatgttattgtaagtatatgtgtattcttcattttaaataattggtgcatactattagtttcaaataataaaggtcatcttgaataactaaaattgtcatgaatatcttgcaatttctatttcttaaattttataatacaactttacgtatattgctaagaaatatattctcttaattatatttggtacattttttctactctgagcagtaaaatagcaatagattttgttgtgaacatagaacaaagtatagaacttgagtaaactcatgtgattttaatgtagtccttttcattatgatggatttttgaagaacttgaattttataatagatattttgcagaattttgggcattactaaaaggctgcactgattttgtaccaacagatgctttcattgggtactgattatatggtaggtatatatttaacttttgttttgttttctgagatggagtcttgctcttgtcgcccaggctggagtgcaacggcacaatctcagttcactgcaacccctgcctcccaggttcaagtgattctccagcctcagcctcccaagtagctgggattacatgtgcccaccaccacgcccagctaatttttgtattttttgtagagttggggttttgccacgttggtcaggctggtcttgaactcctgacctcatgatccgcccaccttggcctcccaaagtgctgtgattacaggcgtgagccactgcacctagcttatctttaacttttaaagaaacagccaaatgctgtttccccaaatggttgtaccattttacattcccaccagcagtgtatgagagtttcagttcttccacatttcagaaacttttttagagttagtccaagttttagccattctaataggtgtgtaatggtatctaactctcattttaatttgcactttcctaattactaatgatgttcagcatcttttcataggattgtttgccatctgtatattttattcgatgaagggtctgttgaaatcctttgcccactttttagattgtttttatattaacaaattttccacatacttcattctagatacaagtcctttatcagatatatgacttgcaaatattttttactagtggtaacttgtctttttatcttattaacactattttcttgaagaacagattttaatttagatgaagcttgacttatcagtttgttcttttgtgaaatcttagcctaacaggtcactgtgattttccccaggttttggtagaaatattatatttttaagttttctatttaagtatatggtccattttgaattaatatttgcatatatagtaggtgatggattgaagttctttttttctccatgtaaatatttaaatgttcaagcacactttatgtgaagactatactttaatcaatgaatttctgtgcacctttgctgaaaaacacttgtctgtaaatgtgtgggtctgtttctggactcttttctgtttctttaatctatttgcttatttttatgctaacgtagcacatttataattaatgtgattttataagtcctgaaatcggttagtatttattctccaactttgttcttccttttcaaacttgttttgactactctttttttttttgcatttgcaagtgaattttagaatctgcctttcaattttcaaaaaaattgctataatttgttttgtgattttgtttaacttatagatgaatttggggagaattggcatgttaactatagtgagtctttggaattattgtattttttattttttctcaattctttaatttttactattaatattttatagttataactgtacacatatttcacatttttgtcagatttatccctgtatattttaaatttgtgatgctattgataatgttagcttaaaatatttcattcctgatttcctgattgtttctggcatttataattgattttatattggttttacatcctgtagctttgcaaaagtcacattttacttctactaccattttttgttgactctcagaatttctacacatacaatgtttcctgcaaataatagcagttggatttcttttcctctcttgatggttttctttcttttttctgccttattgctatagctagcacctttaataatgtgttgaaaagatgtgaacatgaaagtattattgtcttgtttctgatctaagagggaaagcattcagtcttttatcattaaatatgatgtaggtttttgctaactgcctttatcagattaaggaaattgccttctattcctactttgctgtacattttttatcagaaatggttgtttatgtccaatgcatttcctgcattaatttatatgattatcagaaatttctattttactttgttaatatagtgattttagtatttttaatttaatgaacggtatacagtataagaatatactaccatttttgtccattcataagttcatggacattgggatttttttctaggttttgtcattaagaaaaatgctgcagtgaatgaacattcatatggtctttatgtgaacatatgtttttattttccttgggtagattcctagcaatgtatagtttggttgtatgataagcttttgcttaactactttagaaactgccaaatggttttccagaatgttggtaacattttttaatttattctagaaaattttgatactagaaatttcattccttgacatcctcatcaatacaacattgtctctttgatcatagacattctagagtgtgtatagtggcattttgtggttttgttttgtatttctttaatgactaatagtgttgaacttgattttatgtgttgatgccttgaaaatgatttgctgggtgtgtaaaatttatccttttttcagtttttgttgctgttttaaattgtatttttcaaaattttgttttctactcttgtttgatatataaaaataaaattcgttttagtatattgatcttatattcattaactttggtgaacgcttactaaattctgtttgtagatttgcttggatttttaaatgcagttaattatattacatgaaaataagcacaattttcttcctttttcaatattttttacccttattgggatgttgagacctctatttctgggctgaatcacagtgatgataatagatatccttatcaggtaggatgtttattataatttatggaatattccttgtatcacattaagcaaattcctatcttattttgtgacaaggttatatcatgaataactttcttttaccttattaaatactaagttaaattaatagattttctcacattaaacatcttttcattctgggctaaaccatacttagtcatggcatattagtatttggatactgctaaatattagttgtttatattttaatttagaatatttttagtatgaaagaagacgatctcttttttgaatgttattttttctgactaaatgacctatgactgcagtttttaaaaattattttctggccgggcgctgtggctcacacctgtaatcccagcactttgggaggccacaaagggcgaatcacgaggtcaggagatcgagaccatcctggctaacgcgttgaaaccccgtctctactaaaaatacaaaaacaaaattagccgggcgtggtggcgggcgcctgtagtcccagctactccggagactgagatgggagaatgtcatgaacccgggaggcggagcttgcagtgagccgagatcgcgccactgcactccagcctgggtggcagagtgagactctgtctcaaaaaacaacaacaaaaaagttttccattctatatatctgcaattgtggtaaaagcttttaaaaatgaatttggaacaattgctatcttcttttaaaacaggaatagttaaaactttaaataaaaattaggtatttcaacaaaaatttttgggtctagtgctttttaattggtagttattttatttttttattttttgctatttcatagcattagcttttggttttatttatcttttctgtggatcttgttttttagttcatcaatttcagattttgtctttaataatttccttctcatatactgtttgttgttgttttgcctatatttgctatagtattttaaaattatcatttttttacagaatttatgaattccttttttatctttaaaaacgtaattattttcttagttcctttcttaagtgattcttattttttaacttttattttaggctcagggctgcatgtgctgcctgttatataggtaaattgcatgttgtgggggtttggtatacagattatttcatctcccaggtaataagtgcagtacttgataggtagtttttagatcctcaccctcctccaatccacaaaacatttgttaactatttttaattttttaaaaatgttactgagaatgtggcatataaaatcccaaattttgttaaggtatttttgccctttatgacacatttgatagggtatggaggcaattttgtttgtcacaacaggggagtgggacgtgggtgccgtgggcatctcatgggtagaggctagggatgctggtaaacatcctgcaatgaaaaggtcaacctccccagaacaaaaaatcatgtggccaaaaatatcaatagtatttaggttgagaaatcctgatttagaggcttaatcaaatttatatctgattttggagaaaataataattgtagatggtttggttttctttgtctagaagagtcatatcatgtctgttagtgtctcttatgttcttggcacacactgacgctcaatgtttagattttaattgatcaagattgaaaagatataatattctgccaggcacagtggctcacgcctgtaatgccaacactttgggaggccgaggcgggcgaatcacctgaggtagggagttcgagaccagcctgaccaacatggagaaacccgtctctactaaaaatacaaaattagctgggcgtggtggtgtgcgcctgtaatcccagctatgtgggaggctgaggcaggagaatcgcttgaacctgggaggtggtggaggttgcggagaactgagattgtgccattgcactcgcacctgggcaacaagagtgaaactaaaaaaaaaaaaaaaaaagaaaagaaaagatataatattccaatttcttcttcatgttttggtttgaatacttcggtaaaaacaaattttcgctcatcagctgtttggttgcttattgctacagttcgcatagggaaggcatgataaatgttacagtttttccctgtattttttatttattccctttactacttttatgtatgtatttatttatttaaaattaaaagttagctcaatatctttcaaaaatgacagtttttgtcactaatgaacttatagatccatacatgttttaatccgtgtgcaattattattcctactgatgctcagactgtccaattactgtgtcatttaaattatctttattctctagcttttccacatcatttttgtttttcttatttcaaatatcctggatttattttatagggatttttttctttggttttttaaaattagaaattcctctttttttgagcctttagtttcttttatctgccaaaggagtaactagttaccattatgaacacattatgtaatctctgtttattacaaatatactaatgtttaacccttttataaaaactagcataatttttcttctatgtcaatgttgtccaatacaaatatgatgtgagcctcatatgtaatttaaaattttctagtagcttcctttaaaaagtaaaagaaaatgagtaaaattaatgttaataaaaccttttttagcttaacacatctaaaattttttcattttaatgtgtaatcagttttaaaagtcattaagtcattaatgagatatcttactttttttgtactagtgtttgaaacaaagtttacattccatacttacatcacattttaattcaaatcagttacttttcaactagtcaatagccacatatggctagtggtgaccttattggacaactcttctctagattacataggatccctgcgttcttttagaaatatcagaagcataatggtaaagcactaggtggcactcttggtattgctgtgagacgtttaaagcttaatatttgaaaagaagtgatgcttaaaaaagaaaaggacaataactcttgtaataatgttaatagaaactattctaattttcaagattagatcgaaatttaagatgcaagtccacactgtaacttaaagcaattgagtgcaatgtggtattaacttaattgaaagtgatatgtcagcagttgtaatctatttacttagtagtttttcaaagttcattttaaaaccaaaaaccaaatatattataaagcatgcctcacaaaggagggaaaacgttcaaacagtgttaactaattttattggcccttgtaaacattgaattactcaatatatttttagtaaatacaaaaagtagtagtcacaaagtatcacaaagtagtatagtttttttttcttaaatgctttcttttaattgtaataacaattttaacaaagaaaaccttaaaaatgaaagactaggctgtagaaatgctatatagatgatatatttcaaaaagtagaatgagagtacataaagtcactttctgcagtcatttactttatttcactattgtgctaattctttaaatacatgtaatttgcaatgctcacacccctaattattgtgttttaatatacttccaagtaattgaacacattttatttcatcttttactctttaaaaaattactgttttatgttgaatttcttttattagagtttcttttatttagagttcatggtggaattttgtagtaataataaactacctattttgagagtaggaaatttaagttgaaaaagatgacttaaaatagtatgtcagtttaattacttaaaatagtatgtcatagaaaacaatgaaaccaattaatacttgaattgacccttatatttaatggaattatcctggtttttgttctaaaactgaataaaataattttcctgttttaaactgaacattttgttagtgaatgttttatatgactttttaactattggctataaattgctatttaagtaggatctggctgtttcatttgcacatggggcagagtgatcttaataaacaccaataatctaaattcttatatttaccagattgcagacatgatggattgaacagtatctgacaagacataaatgagtcacatttttggcattttaaccttgttctttgattcctcagtatttttattaaattttctgaagtctgtatccctgtacttttagatttttatttcagaactatttactcctttagcatagtccaaaatgatggataataaacatgattataagaaaatttaaaatagctaaaaggaaaaaaattgctattaagttaatgtagaagaaggatgaaaatttatttgacttatatattttacaataaaagtgttacattattattttcatgtaaaatcatagactcactgtaaaaaataataaaaaagtttaaggaaggaaataaaaatgtccataaaccttccaccaggtcccccaagttgagttgtgtagtatgtatcctttgtaagggtactcagctgagtggaagattgagagctgatatgctgtacttacctttctcactaagccatgtaccctagtgtggggctgtgtctgccttgagccagaggtatatagttctttatttgtgtgtaaaatgttgaatggtctactgaagggactgcctgccttctaaataaatctctgcatcatgtcctgagaatgattttatgtcatagaggtcataacatgcataatattattgtgaatgtttttcttatagatatatagctcattattagcatttagtaaataaaacatagtttttcccaaactggaaaagaacaaccacctgactttaaaataatgatcatactagttaacatttattgagaacttactatactagactgttctcagctttttatatgtattagcttatgtaatactcaaatgggaagggtatgcttattattcccattttatagataagaaaacagagatagagaaagctgaactaatttgtataagatcacacaggaaatagtaaaggcaggtttcaaccctcttaaccattaaagaagtggaaatcagtggtatatgtaagcaaaaagtttttatatgagtgaaataaaaacattatgctgaaggaaataagaggatctaaataattaaaaaatcatatgccattttttcaaataagaaatattcatccaaagatatcataacttcccaaaattgatataaaaattttatgtaattccattatagaatttcattcaattttttctgaaaggcatgcattccaataaattaccttaaggttcaagttaaataatacacttttagaatatccagttagattacaaacaggaagaatagtaagaaattcctactttaatagatatccaaacaaactgtaactctaactgcatccactggctcccaaacttgtattagaatatgccactaaatcaatgaacaagttggagtataagattaagttcctgataatttgggaatttatatggtactatggtttgaatgtttgttgcctccaaaattcatgctgaagtttaattgacattttaacagtattaaaacctgggactttttttttttttttttttgtgacggagtcttgctctgtcgcccaggctggagtgtggtggcccaatctgcaagctccgcctcctgggttcatgccattctcctgcctcctgagtagttgggattacaggcacccaccaccatgcctggctaattttgtttttgtatttttagtagagacggggtttcaccgtgttagccaggatggtcttgatctcctgacctcatgatccgcccttctcggcctcccaaagtgctgggattgggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactgtgagcccataaatttatatttattataaattacccagtatgtggtattttgtggtattctgttatagcagcacaaaacaggctaagacatatggcaagtcattttatttgtatgtctttaatgacttaatttgcttgttcttagatatctcaaactttacgaagattatggctttcgcatttactacttttctctctcaagtactctatccccagctaatattccaaacctaacaaaaatgactcttccagatatcacaaaccttttgtttccatcctaacacttacatagtataaaattatctcagttgatttctgtttttaacttgaatttaggtttttaagtaaaatgaaattttactagaatcaaattctgtgaacactgtaccttgttttattggatctccatacttagaaatctgtatgactcataacagaccttcagttatgtttaatggtagtagactcatataagttattaatacataagtgaatatacatttattttagctgtatgagcaagcatttttattgttggggtacttgagcaaaaatgtccagagatcatattgtagattatcaagtaaaagttgctttaagtttattacggacatagggtaatactattatatcactgaaaaactttaagtatcagtcttttatttaaagaaaaaatgaatttcaaggtttgttttcttcattgaacatttctttcaaatgaaactaaatagatgaccattcatcattgcaggataattgaaagtttagtgattttgagctattatgaagtaaaaaaaggtggcttctgaataggtcatggcatattattaaaaatcccataaattagaaaaattaatgtatggcattggtgataatcatccattcttatgtatttaaaaaatttatttgtaagactgaatgaatttaaatgtatatcttaggtcatacaattagtagttttcagagtttggattataactgtgttttttctatgatatgatatctagcaaatgctgaacctacaaaacttgtgcaacagattttacttttgaaattgttctaaatgttccagattcagtagaaattcttaataattttcagcatggatagtacagttgagcaaacaaggaaaaactagtatttattaaatatttatgtacaaaacaattttatattaataatttcagtattcccaagggtgacatattttttctcattaaattactttctggaggattcgactgttagagcttggagagactgtcatttacttgcgtttactgacttgtgtttattcattctacatttacttattgactagctactttgttagactccatggataacaaagtgaacaaaatgttttttcctctattgaagcttatacactactagagaaaatagatattaaaccagttatatgattttcataggtgtgattttcgtaagagctctgaatgagaattatagagttttgggaatgtatttccaaactttatagagctttgggaatacattacaagagggcctgacctaatttgtgggatagggagtaggtgaggtaagggaatgattgagctttgatttgaagaaatgacttgataagatgtgatagtgtgagggtagataggaagaagtggaaccaaaaaggacagcatgtacaaaggttcgtgactagaaagaacatgcaatgtttgagttactaaaagaaaaccaatactgaaacacatagaatatacagagcaaaaataggaagcttatgagatctgcaagatccaaacaatgctatgctttatagaacatgtaagatacggtctttatcataagaaagataggacgccattgaagggtatttagaggagagaaaaatgttacattttgcttttaaaataatcagtctgctttcagtatgtaaaacagcttagtggcggcaatagagcatgaaatagaccatttttggtttattttttgaggcatcttcctggagctatctgtaaaatatcattacagcacattgagactgttaaaatacttgtacttttattcacatgggtttttatcatttactaaacaattgtctaagtttgcaaatagttgtatttataatcgtaccattgtttaaatgtttttggactctcgatattgttgtcaaagtctgtatgtatcctttatagactcctcaggatggctgactataagatcataaacatatgtttattaacaaacatatgaatataaataaacatacatatgggaatctgacttttgaaatccttcagaattcattcagaaataactacagtgaataaggcagtgaaataactttatcgaatgcctttattttatcagacagtcttctctaaggcaaatacatactcacacaattacatttaattcacagagcagtcctatgacataggcggttttatccctgttgtaccattgggtctcattaagcttagttaacttgtataaaataacctagttgttatatgggagattacaaccaagatctccttaaatggtatagatgatgctaaattaaaactgaaacgcaatattaactgaatcattaactcagtggaaaagcaaattattaagctgcagtttgtttctcaaaaaattcacatataaaatttcagaaacaattcaaaatttatatctaagaattcttcttcccaaataagttgaaatttacatgagcagtgccattgatacagcatatgcaaatcaggcttatttttatttgtcatcctaacatgcctgccatcttgcatctcagatataaagatatttccagtatacaccttgatgattttttttatcactggttactatcttcttaaaaaatacattatttcctgcagattttgttgcaagagtaaagcaaatcttaaatattcactacttgctcttcatcatcccaagcatgtaatgtactcagaaactttcttcttagtttctctttcaaaatgtctttttatgcatatacattttagtcatcactttccacctaatcattagtttttaatatctgacttctttaaacatcttgtatacgttaaaagccttttctctttatatatttttgcttaaactcctttttcatgcaatgtgttttactcatcagcttcatttagtatataatttgttcttgtagtaaatagaaaacacttttttgcactacggctgctagaccagtattgactaaataaccttaaaaaaatcaacttctgcatgttgaaacttaatcctgggcatattccagtcatataagactaggatgagagactgattatcttgtatgtttttgttagcctatatctaagaagtttgtgtattaagaatgaaatatgccatttttggagagaaacataactacagttgacccttgaaccccctgaggtatagaggcaccaaccccgcatgtagtcgaaaatctgcgtatatctttttactctccctgaacttaactactaataggatactgttggccagaaaccttaccaataacataaacagttgattcacatatattttgtatgttatatacattatatattgtattcttgacagtaaagtaagctagagaaaagaaaatgtattaagaaaataataaggaagagaaaatatatttagtattcattaagtagaagtggaaatggatcgtcataaaggtcttcattctcaacgtcatcatgttgagtagactgaggatgaggaagaggaggggttggtcttcctgtctcagaggtggcacaggtagaaaaaaattcacatatgagtggacttgcatagctcaaacctgtgttgtatagggtcatctgtatatcaatctaattatttaatatgtaagtatacatcatgtgaaaaacatgttgaagatcaaggattaaaacaaagaaactctctgaacattggtttacattttttttggcccaatagtggaaatactgcatgttcattctagaaaagagataaataaaaataaaaataaaaattactaatttttctacctagagaaaattgttgctaaattgtactagttttccagtcatttatttatgtattgatactctgtgttagggtgagtaatgcaccccgaaagatgtctacatcctccccagaacctgtgatacatacttaccttaaatgataagaaggagttacatatgcttaaactaaggattttcagagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgtaagggagagctgttccttctccttcctcattaatttgtttaattatttatttatatcggtatgaactcatggatatctatttaattttatgatttataagaaattactgtcgttatttattttgtagctgaaattgttccagatctggtcattaagatccccctcaatttggcttctgtgttttttaacataactccatcatttgttgagtgcatccttattttctagcactacaagatatttcgggcttaccttgtactttccctcttccatccctgaaatcaactagttcccatttccccaagatgccatggtttcttatattggagaataatatttagaaaccaaaactggggattatatatgctcattggttctggggttttattctttctttcttttaaaaattttatgggtttcctgacccatgcactagggtataacaatggtattacccgataccttgtcattaataacatcacctatgaaataccaaattcaaatatcttacacctttagtccttcttgctcactaagtaccaatgccataattattcaaactcattgaaatttgtaattcattaaccctacttgttttctcattttcaccctttcctagtgccctgctgtcttcttttatacccttaaccatgtgaggttttatgccattatagttatcagtccttagctaaaactgcatattttcttcccactcctgtttcttctatctacttgtgtagcaaaatccaaactggttaatccaactcttcactactctgtgtctgaactttcttcaccctcacgttgctggggggaaaaaaaaatcatatagctgtgttgactgtttggtcttgagctttatcaaaggaaaatgcaaaactacctggtgtttttcctgcatttcctttataatactctccaaataagtgttttaaaacttcatctctattctcaaacctttatctgcaccagctaataattttacctcctacttcattgagaaaatataagcaaatagatgcgaatgttcccatttttttttaccaccacaatcaccaaacttttttgcacctatacttattttctctgcctttagtttattatcgaggaaagaataactctgttcctaacaaaagcctatttttcaatttgttttgctctaaattttatacctttaactctttaagggactttgctcttccatttctgctttatcaacagttgcttagactctactggaccaatttccttagcacacatatacatgttttaatatatcttatgttaaaaataaaatttttctactccccttatacttctccaactattgcaccatttctgtattttctttcagatcaacccttctcaaaatagttgcctaaacttgtcaccaaatccttaccacccatttcctcttcaatccccacaactccatagacattgcttttctaaggaaacataccacagagtcgaacagttgaaacagtctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctctcttctacttctcccaccctgtccaaggcactgtcattttgactctggtcctttttagaagcttccttgtgtagttttcccattttcagttttaattttcttcagacattctccaatcggccaccagggtgacatttaaaaattaaaaatcagaccatctcactacccagcttgagatctttcatggttttccatgatgtggcccttacctgctttctgactttatctcttacaaccctccacaaatcattctaagcacagtggaattatttttttttcctcaaacagcgcagcttcattttcatttgtgtttgctctctctctctctctctctctctctctctctctgtgtgtatgtgtgtgtgtaaacaatcaggaactttttcactgtaaacaatcaggaactttttcactgattgtttacatgatttgcttctcatttttcatttatcatttcagatgttgtttccttttgtgtgccttttgtaaagcaatcttctctgaacctgtaatagggattggtaagcttttgctgtaaagggccaaataatagatattttaggcatgacaggccagatggtctctgttgttcctactaaactctgccactgtagtagacaagcaaccatagacaatatgtaaatgattggttgcggctgtgttatcataaactatctacagaaacaggctgtggaccagatttggtctgtgggcagtaatttgtaacacctattccaaaacattaccttgcgatcttcatagcatatatcactctcttaaaatgtcttgtttatttgtgtgattatttttggctttctcttctattaatagaatgcaaactccataggaacaaggcctttgattcctcacttctatctgtctataattctgattggaattttattaatttaaaagattaatctgaggagaacatatatatattttcttaagtattaaaatttagaatgctccttagcagtctatttatcatgtatagttacatcttcttttatgacctaaaatagattttgtagttttgtaaattaaattttttgtagttttgtaaattaatatttagtttatttctgggatttcatttggtttggagatttttattagtttgctattcagaatggaatttttaaaccattacattttctgttgaatgtaaaacctctattgatgtaaaagaaaagctattgatgattatatgtgtttaaatttttgcatttttttggtgatttgatatcatcaaattattctgttgatgatttatagtgatgccattaatgacaaatttttggtctcaaagtctataattgaaataaatgtaattacacctgtttcttttgattagcatttgcctgatgtgtctcccttcatcctttcagtctgtgggctctctttttataggcatatctcttaaaaatagaagactttgattttgctgttttctaatctgtacatttttgtgattaatgatgagttgaatccatttatttttggtgttattattcatatctgaatctatttataccattttaattttttattttgtatttttactttttatatatttgtttttaagccttttatagcttttttggaaggggaaacatactgatatccccctcctataagataaggattttagcattctgtaactttttttgaaattcttttataaaaccacagtgttttgatattctctagactttctattcttggttattatggatacgcatgtttctttggacatcgcaatttttacaaagataacaaattcaccaaggtattttatcagccccatctccgtatcccttgatatattttttgctacacattctgtatttatctcttctctttttaagtctttaatcaaaaattgttttaacggaagtctgcatgtcaaagcttctgaattctctatgcctcagagtatttattattccttcctatttgagtgtatgcaactaataaagtagacttaatatgtggagcaaaaattgattaaactacaataaaaaattaaacatacctctttagagtatttctagatcaagcagacaaaattcagaaagaatatcaaagatctgaagaacacagttaatagaaatatgaattatagccataaagatttaaaagaggatttaaatttgcatttattttacagatgatataattgtttccataagaaatcgaagtgtctacaggcaaattattagaaataacaggaatgtttgtcaggttgttggatacaaaattaatattaaattgccttcttagacatgttcctctaccagctgttagggctaactagatagttacagtaattaaggcagtgtagagttgtttttcttttgttttttggtgcagggataggcatagtcactgaagtaataagataatctccaaataaaaggtataggtatttatatattaatatttaagtcatatctggctacattactgaattgtttattatttaatagctttttagttgttttatattaatttcttggtaaactgattctaggcagaaaaagacaactttgttttctttttaaaaatattcatatttctgtataattatatttttgtaatttacctctgtcatctattcaccttttttctttgccatttttgtatttgtatttgtctcttagttgtaatgtgtgtgtgagttgattttttttttcaaaactgatatgtagattatgtccttttaggacacctgtttacctgaaattattttattttattttattttatttttgaggtggatagagcaagatatttatatcttgctctgtcacccaggaaggaatacagtggtgccatcttggctcattgcaacttccgcctctcgggttcatgcgattctcctgcctcagcctcctgagaagctgggattacaggtgtgcgccaccacgccagcctatttttgtatttttagtagagatggggtttcaccatgttggccaggctggtctcgaactcctgacctcaggtgatctgcccgccttggcctcccaaagtgctgggattacaggcttgagccactgcacccgaccctgaaattattattatattgttcttgaatggggacagcattgctgagtatatattttccataaatattacttcttttttttattttgacatttatttctgcttaagagcacttggctgctgggcaaaatggcttatgcctgtaatcctagcactttgggagactgagacgggtagatcacctgaggtcaggagtttgagaccagcctggccaacatggcaaaaccccatctctactaaaaatacaaaaacaattagcaggatgtgggggcacacgcctgtaatcccagttactcaggagctgaggcacaagaattgcttgaacctgggaggcagaggctgcagtgagccaagagtgtgccactgcactccagcctgggtgacagagtgagatttcgcctcaaaaaaaaaaaaaaaaaaaaaaaaaaaaagccttggcatgttgcctaatcctactctgtaaataactcatttgtccgtgtgtgtgtgtgtgtgtgtgtgtgtgtgtgtgtgtgtgtgtgtgtacacttacctacatggacatgcctggatgtctgtaattttttttaacaataacttcatagagatatattcacaaaccataaaagtcaccattttaaagtgtacaattcagtagcttttagtatattatacacagttgtgcaacgatctgcaccatctaattttggaacatttttatcgctccagaaagaaagctgtacatgtcagcagtcacttatcattcttttttcaccagctagtggctaccatttatcttctttttgtctgtatggatttgtctattttggacataacaaaataaatcagtcttttgtgactgatttctttcattagcacagtatttttgaagtttattcatgttatagcagaaatcattactttatttctttttatgacaaaataatattttattgtgtgaacatatcacattttgtttaccattcagttgaggtacatgggttgtttttacattttggctaatttgaataatattggtgtaatataatatgctttttatatttatacaagatacttcctttaaatatttaggttttcttcatcaacagatttttttctttatttaatatatgtgctacccttcaactcattatgatctctgctttaactacattagtcatgcatacactgaatttttctgtgtatcatttctcttgagtgattttcatctctatttctattttgggaggctttttcgtatttgacctacatagcactatttcagtcttatgttgtattaattattctgttttctgattctcgtattaactttttaaattttgccattacattattacttttttgttcttccttttgtaatttatttagctctctttttattgtaatctttggtgttattatctcatctttcatctttaattttgtggagtcagtgttttttagattttattttctcttgacatgttccccatgggtattttaaatagctaaaaaaactctgtatttatattaattgtatctacttcatctgttgttgtcaaattgagattttgctctttttctcttcttaccattgcaagtcaaaataatgtaagaaaagcaaaaatgtttactacttttcctatgtttttgtttttatgatttaaaaaacatatgcaattggaatttggagcctgaagtatgaatggttttgtattctcctgaagctctacgaagctcatacaaaaagtgagaagtgtaaataagagaggtctttctttatatctattttacctatttttataaactatttttatataaaattgggaaattaattgtggatctccgattttcttggatttatgagaggtggtttgcttggatttatgaaaggtggtttgctgattgttcgccaaaatatttaaaagcagatacatatatcatttaaagtggttctaacctctgggctcagtctttaaaatcaaaaggttgatttatagatacttacagctttgattcttcaagccttgaaatacagctatttagtatttttttctattaacaaagttttccaaaaggtgttcctagcatatttaaacataaagaatagtttatctttttttaagttatggaaatttaaaatgtgttaaaaagtatagtatatatacttctattcatgtagtatatatatttcatagtatatagaatatacttaaaaattgtgtacctgttaccaagctttaataaagcttaacgccttgctctatttgctttggattttttaaaaagaaagtaaacatcacagatagagttgattttttttgtgtctttttttagatagagccaccaaactgtattttgttttgtccttattatgctaatgttatttgtttgcaatatatataataatcaatatttattgagtactttatatatgtcaaacagttataagtacctttaatttgttagctcacttaatcatccataaaaattaatactataccacattatttaaaatatataaaaattacatactctgtgaatcctacaaattgcttttatgtgcaacatatttgagatttatcaatgctaatatatgcagccatagtgcatttattttagttatgtagaatatttctacaggtataacatttatttccccattctccttttgatgcacatctaagttgtacttaatttttcaaaataatatataattctggaattaaaatccttacacatttctacttgaactggaagttctttgagatatacaagtagaagtggaattgtagatttattagatttttccaaattacactgcaaatatttatattaatttatgctccatcatggtatacaataattttcttccacttcctcaccaacattttatgtttttagtctctttaatatttgccaatctgatggttttgaaatactatcttgtttttacttgcattttctttatgactaattgaaacaatatcattttacatatttattgtgtatttaagtttctcttctttgaattgttgctcttattctttgtctttttcttattttgtagtttgtctttttcatattgttggcattttcttattgatttatactagttttaatgtaataaattctggatattaattttttgttcattattgatacagcaaatatcttctcatagtctatgacttggctcttgatctttgttaaaaatgacatttatacattcttctctttgctacatggcacctaccctaaactcgaatatcaaccacataattggatataaaacaatcctcagcaaatgcaaaagaactgaaatcataacaaacacactcttggaccatgtgaaaatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcattggcaataaaatcctccatattcaccaccctccaatttgttcatgcaacctgattcttcctggatgctgaacaagagctcaggagccatgggtatggacacttgagctatttaacacttaagccttccgtggatggcaaagctaagaagacactgtaacacatgccctctggggcttcaggggttgtgggtaccccccagacactgccatggggctgcacagagttttgcttctgccggcacccagaagcattcatcccagttgctgcacctgctcacttgcatgctcctcctcccacaaggggttatttaagagctgtgggctgagtaagtgaggcaccccttttgtgagacccatgaagggtcagggaaaatgttctgtttcaatgccagcatcatcctcataccaaaacctggcagagacacaacaaaaaaagaaaacttcaggccaatatcttggatgaacatagatgcaaaaatccccaacaaaatacttgcagaccaaatccagcagcacatcaaaaagctaatacaccacaatcaagtaagtaagtaggcttcatccccaggatgcaagattggtttgacacaagcaaatcaataaatgtgattcatcacaaaaacagaactaaagacagaaacaacatgattatctcaataggtgcagaaaaggctttctataattaaaaactataacttaggtattaaaggaacatacctcaaaataataagagccatatatgacaaacccacagccaataacatactgaacagacaatacctggaatcattccccttgaaaactggcacaagacaaggatgccctctctcaccagtcttattcaacatagtattagaagtcctagccagagcaatcaggcaagagaaagaaataaagagcatccaaataggaagagaggaagtcaaactatccctctttccagaagacatgatcctatatgtagaaaatcctatagtctgagtccaaaggctccttcaacttttaaacagcttcagcaaagttgtcagatacaaaatcactgtacaaaagttactagtgttcctatgcaccaacaatagccaagctgaaagccaaatcagaaaggcaatcccattcacaattgctacaaaaagaataaaataccttagaatacagctaaccagggaggtgaaagatctctataatgagaattacaaaccactgctcaaagagaagacacagacaaatggaaaaacatccagactcatggataggaactgtcagtatcattaaaattgctatactgcccaaagcaatttacagattcaatgctattcccataaaactaccagcagcattcttcacagaactagaacaaaactattttaaacttcatatggaacccaaatagagcctgaatagccaaggcaatttgaagcaaaaagaataaagctggaggcttcacgttacccagcttcaaactatattacagggctacagtaaccaaaacagcatgatactggtacaaaaacaggcacatagaccaatggaacaaagtggagagccaggaattaggctacacacctataaccatctgatcttcaataaagctcacaaaaacaagcaatgaagactcccttttcaatcagtggtgctgggataactggctatccatatgcagaagattgaagctggaccccttccttacaccatatacaaaagttaactcaagatggattaaaaacttaaatgtaaaacacaaaactataaaaatcctggaagacaaactaggcaatgccatcctggacaaaggaactggcaaagatttcatgacaaagacaccaaaagcaattgcaacaaaagcaaaaattgacaagttggatctaattaaagagcttctgcacaacaaagaaactatcaacagaaactatcaactatcctgtagaatgggagaaaatatttgcaaactatgcgtctatcaaagatctaatatccagcatatatatggaacttaaattttcaagaaagaaacaagcaacctcattaaaaagtgggcaaaggacatgaacagaaactttcaaaaaaagacatacatgtggccaagaagcatatgaaacaaagctcagtatcgttgattgtagagaaatgcaaatcaaaaccacattgagataccatctcatgccagtcagaatggatattattaaaaagtaaaaaaataacagatgctggtgaggttgtggagaaaagggagcactcatacactgttggtgggagtgtaaattagttcacccattgtggaaagcagtatggcaattcctcaaagagccaaaagcagaactaccattcaacccagcattcccattacttggaatatacccagaggagtataaatcattctaccataaagacacgtgcacacaaatgtccactgcagcactgttcacaatagcaaaaacatggaatcaacccaaatgcccatcagtgacagatcagataaagaaaatgtggtatgcataaaccatggaatactatgtagccataaaaaatgagatcatatattttgtgggaatatggatagggctagagactattatccttagcaaaccaatgcaggtacagaaaaccaaatactgcatgttctcacttacaagtggtagctaaatgatgagaactaaagaacacaaagaaggatacaacagacacgggggtctacttgagtgtggagaatgggaagcgggagagacagctattggatactgggtttaatacctgggtgatgaaaaaatctgtatgacaaatccctgtgacctaagtttacctatgtaataaatcttcacatatacttctgaacctaaaattaaagttttttaaaatcaatatttattgtggaggggttttcaactttattaattttttcctttatgattgagatcttaatgacatgcttttttaaggtcataacagatgctctcttgtatttttgaaaagctataaagttttgcttttaatatttaggtctttaattagctgaaattgatttttatgtttgatataggatataaatccatactgtagtttttcttttttattgtttgttcctgtgccatttattgcagtctccctttcaccacagatttttctaaagtactttattgagatacaattggcatagaaaaactgtacacaataaatatccacaatttgataaattaggaaataattatacatctatgaaaccatcagcacaatcaagactataaatatatccatccaacaccttaagttatttaattaattttcttaaaacttaatataagacctaacttgttagcaaattttaaaaatatacaatacagtattgttaactataagtactatcctgtatagtagatcatcagagcttaatcattttgcataactgaagctttgtaccctttgagtaacccttccccttttctttctccctatcccagcacctggtaaccacctttctattctctgcatgtatgaatttgattattttagatttcttataaatgtgggataatacaatatttgttcttctggtcaggcttatttcacttagcatcatgttctccaggtctatctatgttgttgcaaatggcagaatttccatcctttttaatgctgaacaatatttaattgtatgtatatactacagtttctttatctgtcatctgtcaacaaacactaaggttgcttccatgtcttgtctattgagaataatgctataaggaacatagaagtctagatatcactttgagatcctgagtttagtttcttttgatctgtatatacctaaaagtgggattgctggaacagatggtagttctatttttaattttttgagaagacaccgtactgtttttcataatggcagcaccaatttgcattcccataaacagtatacaagagttttttagagaaatgtctattcagtctctttgcccagttttaattgggttgtttacctgatatatagttgtttgatttccttttatgttttggatatttaccccttgtccaatgtatgatttgcaaatattttctctcattttgtaccattttcttttgttgattgttgcctttgctgtttgatgtaatttcaactttttagtttgatgtaatttcagttgtcaatgtttgcttttgttgcctgtgcttttggtagtatgttcaagaaatcattgtgtactatgcagccataaaaaatgatgagttcatgtcctttgtagggacatggatgaaattggaaatcatcattctcagtaaactatcgcgaggacaaaaaaccaaacactgcatgttctcactcataggtgggaattgaacaatgagaacacatggacacaggaaggggaacatcacactctggggactgttgtggggttgggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaagaaaaaaaaagaaatccattgtgaagttctctgttgataagcatttcttctgtttccttataagagtttgatggtttcaggttttacatgtaagtctttaatccactttgaattgatttctgtgtatggtataagggtctaatttcattctttttcatgtgaatatgcagttttcccaacaccatttaatgaagagactatcccttccccattgtgttcttggcatccttgttgaagatcagttaactctacatgcatgggtttatttctgggttctttaccccgttacatttatctatatatcttttttcatgccagtaccaaactattttgattattatagccttgtaatatattttgaaatcaggggtatgatacctccagccttttttcttcttggtcagaatcgttttgactatttgggttatttggtggttccatatgaattttaggagttttttctttctatttatgtaaaaaaaggcactgagattttgacaggatttgcaatgaatctgtagatcacttttagtagcatggacattttaaccatattaatttttccaatccatgaatatgggatgtcatattatttatttgtgtttaatttcttttgtcaatgttttatagtttttaatgttcaagtctttattctctttggttaagtttatttataagtattttatttcttttgatgccattgtaagaatgttttctttaatttctttttcagatagttcattgctagtgtatagcaatgcaacagatttttgtatgttgattttgtatcctgcaacactgttgaatttatttgttctaacagatttttgtgtttgtgtgtgtgtatgtgtggagcctttagtattttatctacataatatatcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacaccagttagaatgatgatcattaaaaagtcaggaaacaacagatgctggagaggatgtggagaaataggaatgcttttgcattgttggtgggagtgtaaattagttcaaccattgtgaaagacagtgtggcaattcctcaaggatctaaatctagaaataccatttgacctagcaatcccattactgggtatataacctcaaaagtataaatcatactactataaagacacatgcacacatgtgtttattgcagcattattcacaatagcaaaggcttggaaccaacccaaattcccattatgttagactggacaaagaagatgtggcacatatacaccatggaatattatgcagccataataaagaatgagttcatgccctttgcaggtacatggatgaagctggaaaccatcattcttagcaaactaacacaagaacagaaaaccaaacaccgcatgttctcactcataagtgggagttgaacaatgagaacatatgggcacagggaggggaacatcacacaccagggcctgtcatggggtgacgggtaaggtgaagaatagcgttaggagaaatacctaatacagatgacaggttgatggatgcagcaaactaccatggcacatgtatacctatgttacaaacctgcacattctgtacatgtatcccagaacttaaagtataataataaaaaaataaatttttgaatagtaatatatgtaatactctctaatgaatatattctcaacttcgttgccctgtctttacttcatcctctatccacagacaaaactctaatacagtatcaactaatttctaagctttttttgaacactctgctgtagaaaaacatacgaatatactgatcagtctcacttcagatgcatgctcaccaatctcatactgtttcagcttcttcattcctgtagttcagcaagtgggagggagtggcatccagtggcttttttgctcccgttgttcggtgagcaggaaggaatggtgtgcaatgacttttttgctcccattgttcagcaagtggaatgaagtgttacagctcttttgttcctaccatctgcagcttggtgaatgggagggttacaggtcttttgtttccaccacccacagcttagtgagttctgagttcttttctcgtgaccatgaggaataaggtacgtggacaccggagagtgagtaaggcagaaaataattttgttgagcaacagaaggaaagctctcaagctctcagtggagagagggaccctgaaagtgggtagccctctgtgaggctgagtctggggtttttatgggcttaaaatgggggcaggctggtacttgctaattggtccataggtggtcttggaaaaagcagcattcaattagttaaaaggcatcatacaccaggaaccaatcgagagagtgggtgggttggcgatagaagttctcactctggttgtggactctatccagaactggcagttcaatttttcaggctttaggctgtctttggcttgaaggttggctttcaccggggacctgtccctgtccacctaggaatttgtctgtctcctgtcactacaaatactatatttcctcagtctatttactttccctctttttaatgactattttagatcttttctctgcccgcacatttcccaacccctcatcctccattctctttctcagctgatggcctttctgattttattgagaaaatggaagcaatataaagggagcttccaaatgatcccgccaccacatgtccctccctgctctctgttcagtatgatctcctccctgcatgttgtgtatattcagtctttatgtttttttcacaagatctcatcaccttttacctacctcagggaatagttccaaattcctcctccctctcctctctttgcaatttttccttttctaataatttttttccaattggcataaaatgtgttatttccccaatctaaaactgaagttttcttatgtgtcttgatcatacttattcttcatgctaatttttcatttctctgtatttatcaataaagcaataaattatttgaattgatttatagtcaatcatgttgtaatttctttataccataatagagtagttcattaatgcagcataaaaatttattttcaagttatgtacatttatggataaactagagacatgttttaaattttaaagttttatatcctgtaccctacttagctaagaagttcagagcatatttcagcattaagttacatgtttaagtgccaggtaaattttccattcataaccaaacacaccatcatgatttttgaaattctgaggagaaatatatctcctagttaagtggaaaattgtgcagttggtttctggagtactttcattctaagcagctttaaaaggaaacattttgtgtagaagtctaaattttctttctttatagtagtgcacattcattcattggtattcttattagacacttgaattgattaatactcctactaattttgttctagatctcagctttgtatttttagcctgattgacattaggattgatcattaccatacacaagatacttcatactgatctagtattttcaactctattaaatataagaagagagaaaatcatgcttgaatgcctggccaagaatgtggttgggcatatttgtggcagatgctggagtccatatagacagaaaaatgtctgtaggtctggggcattacagcctttactcaggactgtccagggtctgaagtctcccagttcctacctccaaaagggcatttatttcctggcttattaatgcttagttgcagtcttgaaaaaagaaagatgcttgagcagacaaatttgtggaaatagttttgaagtgcttgcttttccttcgtgatatttttttcttcattctaaatagatattctctttctcaagactgcagccctactttttgttgtgggaagtcagggaccccaaatggagggaccggctgaagccatggcagaagaatatggattgtgaagatttaatggacatttattagttccccaaattaatacttttgtaatttcttatgcctgtctttactgcaatctctaaacataaattgtaaagatttcatggacacttatcacttccccagtcaatacccttgtgatttcctatgcttgtctttgctttaatctcttaatcctgtcagctgagaaggatgtgtatcatctcaggaccctgtaataattgcgttaactacacaaattgtacagcatgtgtgtttgagcaatatgaaatgtgggcaccctgaaaaaagaacagaataacagcaattgttcagggaatacgagagataaccttaaactctgaccgctagttagccgggcagaacagagccatatttctcttctttcaaaagcaaatgggagaaatatcactgaattctttttctcagcatggaaagtccctgagaaagagaatgcgcacctaggggtaggtctctgaactggccctcctggggcgtacctgtctcttatggttgagattgcagaggtgaaataaactccagtctcccatagcgctcccaggcttattaggaagaggaaattcccacctaataaattttggtcagactggttgatctcaccctgtctcctgataagatgttatcaatgacagtggtgcccaaaacttcattagcaattttaatttcgccttggtcctgtggtcctgtgatctcgccctgcctccacttgccttgtgatattctattacgctgttaagtacttgatgtctgtcacccacacctattcgtatactccctccccttttgaaactccctaataaaaacttgctggtttttgtggctcatggggcatcacggatcctaccaacgtgtgatgtctcccccagacacccagctttaaaatttctctcttttgtactctgtccctttatttctcaagccagccgacgcttaggaaaatagaaaagaacctaagtgattatcggggcaggtcccctgataacttttgaatctcactcagctgcatttgtccaaggtgatcactactcagtcttttaaacattgtatttacttgatgtctatagcactaaattctgggtttctttttctctcctgagtagccatttctcagtctcctttgccagtttctcttcaggctctgattatttaacattggtctgcctcagggctaatctcttggacctcttgtctatctacgaagacaatttcctgccttcctggctttcaatcctatgtaatttctgataacttacaaattgttatctactacgcatgctcctgagcttgacttaacatctggctattcaataaatttctctaacttaatatctttaaaattaagctcctaattatttccccaagttccatcgcagtcaaacctattctccatttaagttaatggtgatttttgcttggtcttaggaaaaaattaaaaaaaaaaataaaactttgcctttctttcttaaaaaggctgcattcttttatagctaatcctgtttgctgtaccttcaaaatacattccctgtatttgaccacttcctgtggccttcactgctgttaccctggcctccattacctccttgcctgtattactggcacaggctttacgagaatcacagttaaggcttgcttttgctttgaggtttctgtacttgtcctctctgcctggaatatttttttctggtaaactccatggcttattctcttactagctcaattctctaaatgtttcttctgaaagctggaagcatactcctacctaacagtatctccctcctcttcactggtttattcttctccaaaagactgatgttcattcagtagagtattacttgcaagaggacagaaatttttatttttttattgtatctctagggcctagaacactggcacattgaattttcctctgcaattttttggcagtcagatgaaaattggaactatgacctactgcataattctcattatcagatataaggatacctataaattcttatacaaaatattgccttacactaaattatacaataaatatataggttgaatcttataaagtatacaagtaagcatacgaataatgccttaatagttttaaaaataaattcagttaatgtaatttaatctgtatgttctatattaataatttttaatggttaagggtataatatgaaaggtatgtatccaaaagacagaagtaatctatatttatttaaaataattggaaataatttttataaaagtagcagtttaatgttattagcaatacatcaccttcatgtaatatgcatagccactcatgacttatgacatttaaatgtttcaccttggttccagcattatgtatggacaaaattaaaaatatcttttcccagaattccttgtatcattgtgaataaaggtcatatctgtaaaatgatgtttatcatagaatcattttaaaattactaaaagtagaagtgaacacaatggaaaaacaaataaatacattatatgagaaatattatttagctatcaaacttcatgttttcaaagaattttgagtttgtgaaagttacaaagttttatgaaaatgtctatctttacagctacagaattctaactggaataaaatgcaccaaaatgttaactgtatttccttctagttataaaattatagataatttttattttattcacttacttttgtatagtttccagaatgtctataatgttttaactttgtaatagcatcagaaataataaataaaatttttaaggaattagtacttcttccataactatgttttgctttttgttgattgaggacaaagatttgtattttgttatacttaaatataccactagtatttaacaataatcatttttaatatcagtgtacaatatattgtaacctaaattttgctttttagacagtttttaaagtacatatcaggattgtactttttttcctccctacagacagccttttgattgattatcaatttaccttcagcttattacaggaagatgatcgccaccatactgccataaactttatagcaaacccagaacaggtgaggaaaaattgttatcttttaaagtataattattggacacaatttttttttcatatttcatttgattttacctcttctcagaattatcacattgtagggcctttgtagaaactactaatcctattaattttttctctcttcgtgattcaataatttgtgaatttgatatttcagattttgcaaatagccctatattttaaattaaatataatttgtcaccttatatatcttgtgacaaaatttatgcctataattatacaagcacggactgttcttatttaaaaataaaactcgttcgggcgcagtggctcatgcctgtaatcccagcactttgggaggccaaggcgggcagatcatgatgcccagagatcgagaccatcctggccaatgtggtgaatccccatctctactaaaaatacaaaaattagctaggcatgatggtgcgcgcctatagtcccagctactgaggaggctgaggcaggagatttgcttgaacccaggaggtggaggttgcagtgagccgagatcacgccactgcactccagcctggcgacagagtgagactccatctcaaaaaataaataaataaataaaactaatgaattcaaagcatactatattaaatgtattttactttcctttataccattccacagtaatatgatttgtcttttttctcagtcagtagtttatctgagttatatgaatgatggctcctttaatgaaattaccacatcactgatatattgtataagcttttgaagtttaaatatatgaaagattcattgtgaattttaatttcaatccatcaattcaggtaaagactcttaggttgtgtcgaaataacacacatattttgctatccatctgagactttattaatttgaaaatcctgagaatggaaatatcaaccatagggtttattcgggttgaattttagttcttttaaaactaacactcatacatttgaaatgaagttatgttaaatatatatattattattatgaattcatccatattgttaaatgatatgttaaatccatatcatatatttaatggtttttcaagtaggtgaaatgtctaaatatattaatactatgacattttgcaacttctttccttttaacgtagttcactggacttgctgacaactaatataatttcttaaatttttcttttccagtaaaatagcattctgtctcccccatcaccaaaaaaaagaacagttcattttacattttatgttactctttattccctagactttatgaatgactgtattcttggggaatacatttaaagttttgacttttaaataatgattttaaagatattttgtttcaaatacaagccgtccttcactgattatctgtttctacatagatatattaacaatctcagaaactacatttatcaatgtgataaagtttttatacctgcattataattaccattgactttttattgtagtaaaatagacataaaataacatttatttaaataattttaggtatgtaattcaatggcattaagtatatttacagtgtggtgcaatcatcaccatcatccacattttcattatccctaacagaaactctgtgattattaaacaataatgcctcattccacacttctctgcagcccctggtatctttattctactctctgcctgtattaattggcttactctaggtacctcatataaatgtaatcatttgtccttttttatctggcttatttcatttagcatagtgtttccaaggttcatccatgttgtagcatgtatcggaggtcattctttacctttagcttcttgattaatagtaattccaaacctgtggggttctttgaagatctaagaaatttgatgtaagagagatatctgactcaaaatgtgagagtgaataatattcctccacagtattgtccatagtgtcatatacttatgtccagattagccacaattctagtttgcttgtctttttgccattttctccttcaatttccagcaatcccaagtgctttccaatgtcccagctttgttttactttctactatcttgtccagttgaagccaagaaaccagaaaagtgttctgtgaagcttaacgatgcataactgtcatgagaggcatcgctaagaattcttataatatcattttgtgtaaccctctttaattaaagatatattcacctgggaataatctctgaaattattatgtattattggccaaggcttcttattctataagaaaataataataaaaagtagataattatttatacatttcctacattttgaaaaacagatttaattttaactcgctatccatcacttctagccagtgctttcatgtgaacaatttctgaataggtttctgtataacattattttgccaaacttatccatatctaacaaacaatgttctaaatcactgattttatcacttactggaataactacagtgtcactttttcagtacagctttttaaatcctaaatgctttttatatggctttagttatggtaccatataattcagcattgcctaaacttggaattgatagagaatgaactaaaaattcaaaaagagttttataggttttttaaatatcaattggaaattttgtgtgaccttttagcgacaacagttatgctcatattaatctcatccagcataaggtacatgtaattaagagacaatttcaaaagaaaataaagatttaagcctccttaagggtacgctgatttcaccatcctttactttcataaaaaagtgactttttggatccgtttcattaatagtaaaaaaatccactcctcagagcatgtcctttttttgagttcccagtcctctgggtgaagatgaagatgaagaaagagaagaaaaagaatataccctgtcactatacctaataacgataacactacaattataagcactatgggctgaaaccaaagttttttttccagaaattatttcatttaacgctcacaagagcttcttgagggaagtaattacatccccattttagagattagaaaaatgatttttggaaaggaaaagtaatttccccctaatcaatcagtctgtacattaaagacctgaaatttcaatctaaggttatctgactcttcactaattcttttcattgcttcatgaaaatgatttactgtatatgaaactgttattggattcaagtctggttactttattatgatgacataaatcaacatttgctaccagatatctacctttgatatctggattttccttaggactacattgtgtatatttggaagtatattttgtataccacaactgaacaacataatctattgaatagtccctgtctgcatgctgacataaaagtattctgcatttattgctacagtcaaagagttgctcagttatttttctggccttccattgaatttatgcccactctgtgttcacttatatcttaaaagaaataggaaaatctcaatatgtttgacagttttgtggcatgtactgcagaagggttcttaacagcttgtcaatagaattcagtattaattgataatcaatagaaaataagaaggaagttaacttccttcttatattcatgggcatttatgaatatcactatgatgcataatataatagccttctgatttactctatgtatttaaaatccaaggttttatttttctttgactacttcaaattctcagatgctttctccacaatattactatgtactactctaaaaatatgcatgacaatcactcaaccttattataacaaattttattttacatgctctttcaagatgatcattctttttgaaatcttatttgcctcctggaaactgtgacaatatcatttgatggatatggaacactgttaagagttcttcatagagaataagctgttcttccatgtagggaaatcattaagagtagatgttatttggaggtataagattggggcttatacgtctgtcaaatggtatggccatcacacatcatccagcagcctttgctttttatgatgttccttatttctcctgctattcatcagggaaaggccattttccttgtcagttttcccctaagactgttatatcagaaaaggggaatttagttgcttccatatttactttctcctaagagccacttagaaaattgggaatatattttctattggcttacctgctttatcatatttagaaaaatagtaaaacgaaggaattaatatattctctatctctcttactccgtttcactagctagatcttagcagtatagaattttctacaagtctttgtagagaatatttaaaataaagcataatacactcagtatctgaagctaaacttacccattatgactatcattctttgcctttccacaggaacaaatagttgtaaatatacctactttctgcttcttacgtcttggagtaagaaaatcacaaaaaacatttaaagaaatctcttagtcatatttccctgaaattaaatgtaaagagtctgtactccactaatgaatgacaagaagcgggttgaatggcataaaattaaattctcagtgttcctctctataactgtgtaaacaatgtgatctgctgtttttttggagtaggttcatcatttttacctgaaagttttaggttatgttatttttcccactagaaaatatgggtttaataataaaaatgtacacctaagaagaagtcttttaaaaaaataatcttatattgttataaaattgcttgggactaatccaaacctgtttcatttaaacctagcaaaaagaatcaaaatacaaatatcaaatttaaactaagtttagtctacagctaagcaaagagaatccaaataaaaatattaaattacaggagcctctggcttacatacaaaagaccaaattataatagagaagataaatgaggaacttgatatctacctttgaatttattacacattttcttcattaaaatgtataaatggcatctacatatattcagttgaatatttacaaaatctatagagtttaaggaataaaacagacataattaaatcagtagactaaatcatatatatctagtgtaattttcgttttttaaccttaatattttcttttctggtagtcgaacaaaaatctggatatatcaattaatgcatcaaacaactttaatctcaacattacgtggtctgtcggttcaacaggtaaaaaaatgttgatgtcatatctcttttacatgtgttcctatctggaagttgttctaacatgatctactgttaattaaatgtttgaaattttaaaaatgttatatgacaggattattttgctgttactggtaaaaataataagtagaaaaatgaatagagcttcattattttgttaactttctcctttattcaattaaaattagattggtaacaaatattatacactaaattaaatttttaagtggcagtgttataaaatgtgattttaattaagataaattgcttctttaatgactaaagagactgaaatttcaattatttgattcactattaaaactataaatttaattattaaccttaatatttatataaaacaatgaaattcttctgtacatgctgattacagtaaacatctattattgtcaagcttagaaaatataacccctcttgtcagcttcagtgctcagaggagttaaaaaactgatacataatatgtctttcataataaggttaataaatttaaattactgacttaaaaagtatatctgagaagctgttcagatttttatgttgaattatgaaatgtattcttactttaattttagttttacttttattctaaaaattttattggtatctattttctgtatcaaaggtatactgttgcataaatgtgctggaaattgtttcttttttatagaaaatttatggattcttagaaatttatatttgatttctgaaaattaaatcattatgctattttaatatgtagaatattatggatacatagaattcaagaattaagagctcttttgcaattcccaaatttatatattacattcaaaaaatgaaaattcaggcaaataggcattttgttactattagtgccaaacatacagtaaaatgttggcactatgggtttcattaaggaaaaattcgtaataacttgtactgttaatttgatagttatttctgaccagtaagaaaactgtaagggtttaaaaatgtgtctacaaaaatgtctataatacatttctaatcactttagaacaataattttagtatgcaagacatcacgtgttctttcagattcccagaccaaatctcagaaatttttatttatcagatttggagatgaagtcatggaatctgcatttaataaatgtacacaaggtgattatggaataagtggttagttaaaaattcaattacgcagtatactaattctaattatttttactattgattaaggtgaaagtattgctaagattgttggaaatgctttgttctattttattaacttcagtaaatatttattcagcactctatgtgtttaaccaattgagcatttagctcatgttttaaattgtggcctccacccaatttatttaaagcagtgatggttcaatttgtggtaagacaaataaattgattttttcccattttttaattggattgagacacacgaaaatatggtctgatttctttttaaatgctctgtggcattgtaaacagaatgagctcagtttctagagccacatatacctgagttccaactgcttagtagctataaacttggggcaaatgctttaatctttctgaggcttaggttgaaatctgaaaaatggaggtgataatacttctgggatattattggttttaaaaaagaatataaagtctctaagctagtgcctagtacatagcacttaatcagtggtagcatttttaaaaataatttttatactaaatttatttccattatatttatggcaaacttattttccttcattcaaaattataaacagtatattttgataattatttttataagagcaattataaaaaactataatatgcatttttaaattcataaagatatttcctaatattaattatttaaattatttacattttagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacaggtaagtgttaagagtatttacttctaatgaccataatatcattaagaaaagaatggtgcttttgtccaaagtgatgatatatgtacatttcctgacttgactaatacaaaaacatgcattgacctttgataaataaaggtctgcgaatgtctgtgatgatgaatttctctgtaaaaaccctcatggaaccaacaaactctatacttaaatttttcagtgattattatgtactaagcaatgtagccaactgaaatgttttggttttctgattaattatatactttaactgagggttaaataaatactgttctcatataaccccacttgaaattattttccgtttgagtagtcttatttttactttagcacattctgaaaataatctgatctttcattaaagattttgagttagcagtatttcagttacctctttaagtaattacctctcatcattaatttcctaatctgtactacatgtgtgttttacatttcatttttgttatagttagaggtagtctacttaagacgtcagatttacttctaggaaagaattggaatattctttctatcttatagtcaaggtttgtgttcttaatttatgttttcctgaaagaaaagcctatctattgggatgctgggatttgttcattcctttacaactgattgattagattgaatttacattagttattcgaatagcttatatatatcaatccttgttcatggcttttatgttttaaaatcttttaaagattttcagatcatcccttccctatatattagtaaattatagcatatgctctgtaactagaaatgtttgcaggttttatttatattaatttctatgtgatttgtggaaagaatgagtgatttttaaaatcatatgtttactggaaaaaatttttcttcttatttttaaggttgatgtaacacttaaattatggaaattattcaactgttcaggaaatatgaggataaattactattcagttcacttttgagaattaatttgagaaatttacttcttcattgtatagtgattgatttagatgctggtactgtcagaaaaatgccataaatatttgtttttaaaattttaacattaaggatgtgtaactttatttcctaagattcatagagaaatatttatcaaatttcacttcatttattcaattatgattgaaagggaaaagggttcatctatagcacttagtaattagttattaaaattgatatgattatattttaaattgcttcctatccttatttcttgtttatatacttttgaaaaaaaattacatagttattttagaatgtttttgaatacttaatggttaggaattaactttctaaattgggtttttttgagaacttactcttttggaagcaaaatcaaaatttgtgtaacgaggttgaaatactccactctcaaaataatacagtgtggaaaataattgagatggacaagatacgtaggcctaatttctcctctttattaaactcattatgcctatggaatatgttatattaaagcatggaagtattaatatatgtgtttatttataagactagaataaactttaaattataatattatacaaaacacagtaaaattattttaattatgattttaaatactggcagccatcattgtattccctttcaataagttcataagttttttagattccacctataagtgatatcatgcaatatttgtctttttgtgactgacttgtttatttagcatcatgtccttcagtttcttctatgttgtcacaaatagcaagatttcctgctttttaaaggcttaataatattccattgttatgtgtgtgtatgtacgtatataaatatatacatattatgaatatgaaacatatagatataaatcacgatttctttatgctttcatctatccatggacacagcttgcttctgtatcttggctattggaaataacgttgtaaagaatgtgagagtgcagctgtatctctgagatactgatttcacttgctttgaatatatccccagtggtgggattgctggatcattggtagttttatttttaatttttgggggaatcttcatacggctttacatgatggctataccagtttacattccaccaattgtgtgtaagaatttcccttgctccacatccattctaacacttgttatcttttgtatttttgataatggccatcataacagctatgaggtgatatcttattgtggttttgatttgcatttatttgatgattagcaatgctgagcaccatttcatatacctattggtcatttgtgtgtcttctgtggagaaatgtataatcaggtcctttgcccattgtttccattgagtttttgttttcttgctattgcgtttcatgagttccttacatattttggatattaacttcttattgaatagatcatttgcaaatttattttctattctgtaggttgccttttcagtttgttgattgtttcctttgctgtgccaggaagctttttttagtttgatgcagtcccacttgtttatttttgcttttgttgcctgaacttttggtattatatccaaaaaaatcattgataaagccaatgtcaaggagcttagtccctttattctgtttaggatttttataattacaggtcttatatttacatctttaatccattttgagttgatttttgtgtatggtataaagtaagaatccaatttcatcttctgcatattgatatcccagtgttaccaataccatttattgaagagactgtgtttcctttactatttattcctggcactgagtcaaagatcagttgacgctgtctatgggtttatttctagcctctctattctgctccattggtattagtgtatttttatgccagcaacttcctgttttgattactatagattcataatatagtttgaaatcagtaagtatgatgcctccagctttgttcttcttttataaaatttctttgactatttgcagtcttttgtggttccttttgaatttaaaaatttttttttctatatctgtgaaaaatgtaattggaattttgaaagcaattgtattgactctgtagaacactttgggtagtgtggccatttaaacaatgttaattcttccaatcaatgaacataggatattttccatttattattgatgttttgaatttctttcatcaatgctttataattttcagtgtacaggcctttcatttccttggttaaacttattcttaagtattttattctttttgatgctccagtaaatatgatttgtttacttaacttctgatttggagagttcattgttaatgtatagaattcaactgatttttgtatgttggttttgtatcctgcaacttgactgagttttttattctttttaacagtttattggtggactgtctagggtttcttgtgtatgagaacatgtcatctgcaaacagagacaggttttcttcttcttttccaatttggatgccttttacttttccttgtctaattgctttttctaggactaccagtcctatgttgaatagaagtagtgaaactgggcatttttgtttctttgctaaaattagaggaaaaaccttctgcatcttgccattgtgtaggatgttagctattggcttgttgtatgtgttctttattgtgttgaggtacattccgcttaaacctaatttgttggaagtttttatcatgaaacagtgttaataaactttgtcaaatgctttttcagcatctattgagatgatcatataatttttgtccttcattctgttaatgtggtatatcacattttgattcatgtatgttgaaccatccatgcattcctgggataaatcccacttgatcatgttttatgatacttataatgtgctgttgaatcaaatgtggttggctagcattttgttgaggatatttgcatttacatttatcaaggatgttggcctgtaatttttcttttttttccttatgttccctatggtaagctgtggtacaatagtattcatttttatttatttgttttccctcttactgttgctattatatttattttttaaagaacagaatacagcattattaactatagtcaccatgttgtacaatagaaattttcaacttagtccatctatttaactaaaattttgtgtccttttaccaatgtctctgaaatgccattgattttcttttcttgtagtctccttgcctgacttgggtgtcagggaaatgcttgccttacagcataagttcggaagtgttcactctacttcatctttttggaagagtttgagatggcttggtgttaatgctttaaatgtttgttagaattcaccagtgaagtcatcgattcctgagcttttctttgttggaaagctttttataattgattcaatcaccttagttatttttgatgtgaccaagttttctattttcacatgattcagtcttggaaagatgtatttttctaggaatttattcattcttttctaagttatttaatttgttggcatacaattccccacagtcatttcttatgaccttttggtatctatgatgtcagttgtaatgtctccttatacatttataatttgtttaagtcatgtctcttttttcttggttagtcctgtgcaaggtttgtcaatttttaaaattgttttaaaaaccaactgtttatcttttctattgtttttctattctgtatttcatttatttccaccatgatctttattatttccttccatctgctaactttgggcttcacagtttaacaattctattgccatttattgtaaggtagacctagtagtcatgaagttcttcagcttttgtttgtcagcttttatgtctccttcatttctgaagggcaacattgccaggtaaggtattcttggttggtagtacttttcttttagcactttaaatatatcatctcactcctcacctgtgaggtttctgctgagaaatctgttgatatccttagaagtattctcttatatgtgatgggtcacttttatcttcttctgcaattttctttttgagtttttacgattggattatgatgtgtcctagtgaagtcctttttagattgaatctgtttggtgatgttcagcttcatggatctagacatctgaatctctcataagatttgggaagttttgagccattattttcaagttaatagatgcctcgagtttagggactgttgtgggtgaaatagagcagggatggaagggagatatagaggtttttaaagagtatcaccagggatcttggtggtgttaggactcttcactgtcttgagtctggtggtggatgaatacatttttaaagcatccactaagtaaaatcaagtgttatataaacacaaagtaattatggatagttttcagcaaattttgacaaacaatgaaatttaaatttggtgatacaaacaagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattgcatgttgatctcctatggaaagacatctgctcttacaagtcagatatgaaattagttccatcatttatttcatatgccttcataaatcaacaatagtttatataatgaaagaagtcaccagaaacttgtattgcgtaaagaactgttctcaaactttcacgctgggaaaaaaattgtttagaaagagagggcatcttgactgaagctttaagcaaatttaggaaattataatgatgttgtctaataattactagagatatagcaaatatagattttcattgcttatattttatttaattctttcattccttcaactttcagcatacattttattggtcatttgtgcatatacaattttggcttattgccaaatatatttaatataatttgatgtaacaacaaaatataccacatgactatatgtacagacctaatttacaaattgtaactcagttatttctttagatttatcaattttattatacttaattttcataaaatctagatgttagaagaaatcgtgtaattatatgtatatgttgttttaattatttacacatggtactttaaagttaatgcaaatgtgattaaatgtgagtgttatgattccattttacttatgatttttaaagcattttatatgctaggtcaatgtttttgatagagtctacatgaaataaacttattgaaatattcattatttttgcacactctaagaaggaatcaatctcatatttgcccatgtttttagagtttgacatgcttttaggctaattgtttgtgagactgtaagaagcagagagagggccactactcaagtgaaatattcaggaagcatttgtaagaatttgtaagaatacagttgaataaacctacactaggtctctcaaaagcagagtgccttatactccctttcttgggataatggtaataattttgaaatgcaattgaagagactctgtttctgattatctttttttttttcagtaaatgtcaaatcttagatctttttcatatcttttaaaattctaaatctatatctcattgatattaggttatgaagtattctgcaaattaccaaatgctgttattaaatattatgttttttcattttgttttatcatattttgaataatcttccaattcactctctacttacagattatgctattttatattttaattttgagattttatctcaggtcttgtttgtgttcactcttttacagttaaaaaaaccaagaatcagtgtattaatatatatcaaatgcagtggcagaatatttaatttatcttaaataaattaaataggataaggtatcaagttacagtcttcatacttttattatatacagtatactttttaggactgtgtgtatttaaataagtcatacaatttttaagggtcatcttattttcccaatgagtgcttctttaacaccactcattgggcaaatgccttctttgaattcccatagcatcttagcttatatttattcttatagtatttgaacataaactctacacttaatatttgaatatataatatgtgaattgcctgtagttgtcttctgaggaatactacaaatttctctcagagttaaccatattttacagttcaaaaatctttccgtttttagactattcaaataatatgtttgttttagtgctttaaatttgctctatctatgctaattatgtgggggagactaagaagaaatgtaagatgtttattgacctaaagaatttaaattaggtaaaaatcaggagcatgcaatagggagaagattaattatgaaattgagagaaggagttggcaagaatcactatgtgagcgaaaatgagtgtaagctattaatgagccatcacttgatcatggtctgtttttttgtgtggtgttgctagtatttagtaggtgtgcattgatattaataagtgatattgataacttttttcctgtactgtctatgtcagatgtggcatttgtgttataatttcttcataaaaagaattaaaaagtgttccttcatttttattgttttataaaaatatatataacatttaaactacctggtctttgaaaccatagtagaatttccctatgaaacctctggtactggtattttttgtagagtaatttctttataacttcctctatttcatctacagaatcttttccatttaagctacttttttctaaatttatttatttctaattaacagataaaattgtatttataatgtaaacatgatgttttgaggtatatatacattttggaatggttaaatctagctaattaaaatatgcattacctcacatagttgtcatttctgtggtgcaaatgtttaacatccagtctctcaacattttttgagaatacaacatattatcattaaccttagtgaccattctatacaataaatctgttaagtgtattcttcctatgtgactaattttgtatcctttaaccagtgtccctccaaaccccctcctcaatcacccaacgtctttattttttttaagtttataaattattttattgtaagcattgctacaattatttgaatcttctagtgttacacattacaaatgaagatctttctttttttattatactttaatttctggggtacatgtgcagaatgtgcaggtttgttacataggtatacacgtgccatggtggtttgctgcacccatcaacctgttatctacattaggtatttctcgtaacgctatccctaccacagccccccaccccccaataggccctggtttgtgatccccgcccccactcctgtcaatgtgttctcactgttcaactcccacttatgagtgagaacatgcggtgcttggttttctgttcttgtgttgctttcctgagaatgatggtttccagcttcatccatgtccctgcaaaggacatgaactcatcattttttatggctgcatagtattcgatggtgtatatgtgccacattttctttgtccagtctatcattgatgagcatttgggttggttccaagtctttgctattgtgaacagtgccgcaataaacatctgtgtgcatgtgtctctataatagaatgatttataatcctttgggtatatacccagtaatgagattgctgggtcaaatagtatttctagttgcagttccttgaggaatcaccacactgtcttccacaatggttgaactaatttacactcccatcaacagtgtaaaaagtgtccctatttctccacatcctctccagcatctgtcgtttcctgactttttaatgatcaccattctaactgccatgagatggtatctcattgtggttttgatttgcatttctctaatcaccggtgatgatgagctttttttcatatttttgttggccacagaaatgtcttcttttgagaagtgtctgttcatatcctttgcccactttttgatggggttgtttttttcttgtaaatttgtttaaattccttgtagtctggatattagccctttgtcagatggatagagtgcaaaaattttctcccattctgtaggttgcctgttcactctgataatagtttcttttgctgtgcagaagctctttagtttagtttcccatttgtcagttttggcttttgttgcaattgctttttatgttttagtcatgagtctttgcccatgcctatgtcctgaatggtattgcccaggttttcttctagggtttttatggttttaggtcttacatttaagtctttaatctacctttagttaatttttgtataaggtgtaaggaagggatccagtttcagctttctgtatatggctagccagttttcccaataacatttattaaacagggaatccttcccccattgcttgttttttgtcaggtttgtcaaagatcagatggttgtagatgtgtggtattatttctgagtcttctgttctgttccattggtctatatatctgttttggtaccagtaccatgctgttttggtaccatagccttgtagtatagtttgaagtcaggttacgtgatgcctccaactctgttcgttttgcttaggactatctgggatatgcaggctcttttttagtcccatatgaaatttaaagtagtttttttttccagttctgtgaagaaagtcaatggtagattgatggggatagcattgactctataaattactttgagcagtatgtccattatcacaagactgattcttcctatcaatgaccatggaatgtttttccatttgtttgtgtcctgtcttatttccttcagcagtggtttgtagttctccttgaggaggtccttcacatcccttgtaagttgtattcctaggtattttattctctttgtagtaattgtgaatgggagttcattcatgatttgactgttattggtgtataggaatgcttatgttttttgcacattgattttgtattcggacactttgctgaagttgcttgtcagcttaaggagtttttggacggagatgatggggttttctaaatatacaatcatgtcctctgcaaacagagacaatttgacttcctcttttcctatttgaataccctttatttctttctcttgcctgattgccctggccagaacttccaatactatgttgaataggagtgatgagagagggcatccttgtcttgtggctgttttcaaagggattgcttccagtttttgcccattcagtatgatattggctgtgcatttgtcataaatagctcttattattttgagatatgtttcatcctagtttattgagagtttttagtatgaaaggctgttgaattttgttgaaggcctttcctgcatctattgagataatcgtgttttttgtcattggttctgtttatgcgatggactagtttattgatttgcgtatgttgaaccagtcttgcatctcagggatgaagctgacttgattgtggtggataagctttttgatgtgctgctggattcaatttgccggtattttactgaggatttttgcatcgatgttcatcagggatattggcctgaaatttttccttttgctgtgtctctaccaggttttggtgtcaggatgatgctggcctcttaaaatgagttagggaggattccttctttttctattgtttggaatagtttcagaaggaatggtaccagttcctcttggtacctctggtagaattcggctgtgaatccatctggtagtggactttttttggttggtacgctattaatcaatgcctcaatttcagaacttgttattggtctatttagggattcaacttattcctggtttaatcttgggagtgtgtatgtgtccaggaatttatccatttcttctagattttctagtttatttgcatagaagtgtttatagtattttctgatggaagtttgtatttctgtgggatcggtggtgatatcccctttatcattttttattgtatctatttgatccttctctcttttcttcttcttagtctggctggctagcggtctatgtattttgtggatcttttcaaaaaaccagctcctggattcatggattttttgaagggtttttcgtgtctctatctcctttagttctgccctgatcttagttatttcttgtcttctgctcactttttagtttgtttgttcttgcttctctagttcttttacttgtgatgttagggtgtcaattttagatctttcctgctttctgttgtgggcatttagtgctataaatatccctctacacactgctttaaatgtgtcccagagattctggtatgttgtgtctttgttctcattggtttcaaagaccatctttctttctatcttaattttgtcatttacccagtagtcattcaggagcaggtttttcagtttccatgtagttgtgtggttttgagtgagtttcttaatcttgagttctaatttgattgcactgtgtctgagagactgtttcttatgatttccgttcttttgcatttgctgaagagtattttacttacaatcatgtggtcaattttagaattaagtgcaatgtggtgctgagaagaatgtatattctgttgatttggggtggagagttctgtggatgtctattaggtccacttggtccagagctgagttcaaatcctggatatccttgttaattttctgtctccttgatctgtctaatattgacagtggggtgttaaagtctcccattattattgtgtgggagtctaagtctctttgtgggcctctaaggacttgctttatgaatctgggtgctcctgtattgggtgcatatatatttaggatagtcagctcttcttgttgaactgatccctttaccattatgtaatggccttctttgtctcttttgatctttgttggtttaaagtctgttttatcagagactagggttgcaacctctgccccttttttgctttccatttgcttggtaaatatttttccatccctttattttgagcctgtgtgtgtctttgcacatgagatgggtctcctgaatacagcacactgatgggtcttgactctatccaatttgccagtctgtgtcttttaattggggcatttagcccatttacagttaaggttaatattgttacatgtgaatttgatcttgtcattatgatgctagctggttattttgcctgttagttgatgcagtttcttcatagcattgatggtctttgcaatttggtatgtttttgcagtggccggtaccagtcattcctttccatgtttagtgcttccttcaggagctcttgtaaggcaggcctgttggtgacagtctctcagcatttgtttgcctgtaaaggattttattttctccttctcttttgaagcttagtttggctgtatatgaaattctgggttgaaaattcttttctttaagaatgttaaatattagcccccagtctcttctggctcgtagggtgtctgccaacatatccactgttagtctgatgggcttccctttgtgggtaacccgacctttctctctggctgcccttaacatttttttccttcatttgaacattggtgaatctgatgattatgtgtcttggggttcctcttctcgaggagtatctttgtggtgttctctgtatttcctgaatttgaatgttggcctgcattgctaggtcggggcagttctcctggataatatcctgaagaatttttcccagcatggttccattctccttgtcactttctgctataccaatcaaatgtagatttggtcttttctcataatcccttatttcttggaggctttgtttctttttactcttttttctctaatcttgtcttctggctttatttctttgagttgatcttcaatctctgatatcctttcttccccttgattgattcagctattgatagatgtgtatgcctcacgaagttcttgtgctgtgtttttcagctccatcaggtcatttatgtttttctctaaattggttattctagttagcaattcatctaaccttttttcaaggttcttatcttccttgcattgagttatgctcctccatgctcctttagcttggaggaattagttattacccaccttctaaagcctacttctgtcagtttgtcaaactcattctccatccagttttgttcccttgctggtgaggagttgtgatcctttggaggagaagaggtgttctgttttttggaattttcagcctttttgggctggtttctccccatcttcgtgtatttatctacctttggtctttgacgttggtgaccttcagatggggtctctgagtggacatcctttttgttgatgttgatactattcctttctgtttgttagtttttccttctaacagtcaggcccctctgctgcaggtctcctggaatttgctggatgtccactccagactctttttgcctggttatcaccagcggagccagcaaaacagcaaagattgctgcctgttcctttctcagcaagcttcgttccagaggggcacctgccaaatgccagccagagctctcctgtatgaggggtctgtcagcccctactgcaaggtgtctcccagtcatgatacactgggggtcagggacccacttgaggacccacttgaggccgtctgttccttatcagagcttgaacgctctgctgggagatctgctactctcttcagagctgtcaggcagtgatgtttaagtctgctgaagctgcccccacagctgccccttcctgcaggtgctctgtcccagggagatgggggttttatctttaagtccctgacttgggctgctgccttttttttttcagagatgtcctgcacagagtggaggaatctagagaggcagtctggccgcagtagccttgctgagctgcagtgggctcagctctgtttgaacttcccagtggctttgtttacactgtgagggcaaaatcacctactcaagcctcagcagtggtggacgccactccccccaccaagctggagcatcccagttcaacctcagactgctgtgctggcagcgagaatttcaagccagtggatcttagcttgctggggtctgtccgggtaggaccagctgagccagatcacttggctccctggcttcagccccctttccaggagagtgaatggttcttcctggctggcgttccaggtgccactgggatatgaaaaagaactcttgcagctagctcagtgtctgcccaaatggctgcccagttttgtgcttgaaacctagggccctggtggcatagacaccagagggaatctcctggtctgctggttgcgtagactgtgggaaacgcacagtatttggcctggagtgcgctgttcctcctgtctctcatggcttcccttggctaggggagggaaatcctctgacctcttggcttcccaggtaaggcgatgccctatcctgcttcagctcaccctctgtgggctgtacccactgcccaaccagtcccggtgagatgaacggtgtacttcagttggaaatacagacatcactcaccttctgtgtcaatctcgctgggagctgcagcctggagcagttcctatatggccatcttgctagcaaatcgtcaagctctttatttttaacaggatttctgaggtttttgtttagaagtctgcaaagtgatccctcattctattaacttgtattgtttcaatggttatttctttttttggaggtgggcattcgtccttgccttcttgatcattataactgacaatttacttacattgctaatgttttgaaaaattagagtttgatttaattaggtctctcattcttcatattcttgcatcattaatgcttactttcatctttgttatagtatttccttttttggctttctattagtttactttgaggttccttttatcatttctagagctttatatttcatttattttagatattttatgtgtatattttatatttatatttcatttactttatatattatatatattataattcatttcttttaattctttcatttttactaaagtgatttttttttttttttttgagatggggtctcactctgttgcctaggctggagtgtagtggcacaatcttggcccactgcaagctccgcctcccgggttcacaccattctcctgcctcagcctcctgagtatctgggactacaggcgcctgccaccatgccctgctaattttttatatttttagtagagacggggtttcaccatgttagccaggatagtctcagtctcctgaccttgtgatccacccgtctcagcctcccaaagtacagggattacaggcgtgagtcaccgcgcctggccttactaaagtattttttgatggaaatgttcattagcttcattttgtcattcatatgtatatgtaaaacaacatcactttgtactccataaatatatagaattataacttgacaatttacaataaaataaaaaataatctttttttttgctttgtgaaattgttatttatttcttatcaacttttattttagatttagtggtagacatgccagtttgctacatgggtaaactgtgttttgtggggatgtggtgtacagattatttcattgcccaggtaatgagcatagtacacaataggtagttttcaatcctcaccctcctcttactctccatcctcagataggcccttgtgtatattgttcccttcttcatgtctatgtgtactctatgtttagcaccttctcataagtgagaacatgcaatatttggttttctgctcctgcattatttcgcttaggatattgaccttcagctccattcatgttgctacagaggacatgattttgttctttttatggctgtatagtattctatagtgtatacgtaccactttttctttatccagcccaccactgatgaccatctaggtttattatgtgtcttttctattgtgaatactgctgtgataaacatacacatgcatgtttctttatggtagaacgatttatattcctttgggtacatacccaataatgggattgctgggttgaatggtagttctgtttaatgttctttgagaaattgccaaactgctttccacactggccaaacaaatttacatttccaccaacactgtataagttttctcttttctctgcaaccttactagcttctgttattatttgactttttaatagtagatattctgactagtgtgaaatggtattattgtagctttgatttgcaattctttaataattagtgatgtttagcatttttttcttatgcttcttggccacatgtatatcttcttttgaaatgtgtcagtttgtgttctttgcccacattttaatggggttatgttttttttggttgttaatttttaagttccttataaattctggttataaatccttagaccattgttggatgcatagtttgcaaatattttctcttattctataggctgcttaatatgctgatagtttcttttgttggaagctcttcagtttaatttttgtcaaaaattttgtcaatttttgtttttgttgcaattgcttttggcatcttcatcatgattttgtatcctgaaactttgctgatgttgtttatcagatctaggagcttttggtcagacactatgaggttttctacatatacaatcatataatttgtgaagagagatagtttgacttcctctcatcctgtttggatgcatttcattcctttctcttgcctgattgctgtggccaggacttccagtactgtgtcgaacaggagtggtgagagtaggcatccttgttttgtcccagttctccaggggaatgctgctattaatagcttttgcccattcagcatgacgttggctgtgggtttgtccttgatggctcttgttatttcaaggtatgttccttcaatgcctagtttgttgaaggtgttaacatgaaggaatgtttggtttaattgaaagctttttcttcatatattcagatgattatgtggtttttgtttttagctctgtttatgtgataaatcacatttattgatctaggtatgttgaaccaaccttgcatcccaaagataaagcctacttaattgtggtggattggatttttgatatgctgctcaattcactttgctagtatttttttgagaattcttgcatcaatgttcatcaaggatattagcctgaagtttccttttttcattgtgtctttgccagattttggtttcagaatgacactggccttgtagaatgagttagagaggagtccctccttctaaaattttggaatggtttcagtaggaatggtgccagctctttatacaaatgatatattttgtctgtgaatctgtctggtcttgggttttttctggtaggtagactttttatttctgattccattttggaactcattatttgtctgttcagcaatcaatttcttcctcgttcaatcttgggtcgttgtatgtttcaaggaatttatttcttctaggttttctagtttgtgtatatagaggtgttcatagtagtctctgtgggtgttttgtatttctgtgggaatggttgtagtgttatgtttgtcatttatgattgtatttatttggatcttttttctttagtagtatagctagtggtctatgagtcttatttatatttcaaagaatgaagtgggtttgttaattttttgtatgattttgtgtctcactatccttcagttgagttctgattttggttacttcttatcttctgctagctttgggttttgtatgcccttgtatatctagttcctctaggtgtgatgttaggttgttaatttgagatcattctaactttttgatgtggacgtttagcactaaaaactttcctcttaacactgctttaactgtgctccagagattctggtgttttgcatctttgttctcattaatttcaaagaattttctgatttctgacttaatatcattgattaccccgaagtcattcaggagtaggctgtttaacttccatgtgattttatagtttcgagtgatcttctaagtattgatttttatttttattgcactactgtctgagaatgcagttggtatgatttcagttttttttttttaatttgctgagaattgttttatggccagttgtgtggtcaatatcagagtatgtgctatttgcagatgagaagaatatattcttttgtttttgagtggagagttctgtagatgtatgttaggtccacttgatcaaatgtcgagttcaggttcggaatatttttgttagttttctgccttgatgatctgtctaatattgccattgggatgttgacatcacccactattattgtgtggttatgtacatctgtttatatgtctctaagaacttgttttatgaattgggtatttttgtgttgggtgcatatctatttaggatagttagttgttctttaattgtaaccactaccattgtataatacccatctttgtcttttttgatcattactggcttagtgtttgttttgtctgcaactataatagcaacccttgctgttttctgtttttcatttgctcggtaggtttttctccatccttttactttgagcctatgggtgtcattgcacgtaagatgggtcagcatgtaagctggttattatgcagacttgtttgtgcagtttctttatagtttcagttatctatgtacttaagtgtctttttgtggtggaaagtaatggtcttttttctccagatttagcactccttaaggatcttttataaggcaggtaatgaattccgttatttgcttgtgtgaaaagtatcttattttcccttcacttatgaagcttatgaaggaatatttggtttaattgaaagctttttctctatatattcagatgattatgtggtttttgtttttagctctgtttatgtgataaatcacatttattgctagatttttctccatccttttactttgagcctattggtgtgatgtgaggttgttaatttgagatcattctaacttttcgatgtggacgtttagcactataaactttcctcttaagtttggttggaaatgaagtttttgatttgagtttttattctttaaaattgctgagtatcagctcccagtctgttctggcttataaggcctctgctcaaaggtccactgttagcctgatggggttccctttgtagatgacctgccccttctctctagctccatttaacattttttctttcatttctaccttggagaatatgttgactatagtcttagggatggtcttcttgtgaggtatctcttggggttccctgcatttcctgaagttgaatgtggcctctctagcaaggctaggggagaaagttgctggctttctctccctgtctttcagcgacaccagtgagttgtagatttggtttctttacataatcccatatttctcagaggatttgttcatttttttaattctttaaaaaacattttttttctgattgagtttgtttggagaaccagtctaaaagctctaagatgtgttcctcagcgtggtccattctactgtgaatacttgtgcttgcattatgaaatttttgtagtgtgttttgcaactctatcagatcagtttggttctttcttataacggccattttatctatcggctcctgcattattttattgaaatccgtaaattctatggatgggtttcatctttctcctgaatctcctgaatctttatgatcttcataggggatctaagtgcagagtgcaaaaagcctgtggcagatatgtgagtccatggggactatcactcacttatcatttccccatggtggaggacatcccttggctcaatgccacttttgggcgggcaatagttctgtctcactcttttctgttctccatgggtcacattttttccttgatgaatcccaatgtgttcacctagatgttctagttgaagggctagtgttgctcaccactctcttctctccatgaaagtggtgcacactaattggttctaatcagccatcttgtaaagtctcagtgtaagttaagtttactcttttttttcttttttttttgagatggagtcttgctctgttgccatgctggagtgcagtggcgcaatctcggctcaccgcaacctctgactccctggctcaagcaattctcctgcttcagcctcccgagtagctgtgattaggggcatgtgccaccatgtccagctaatttttgtatttttagtagagacggggtttcgccatgttgtccaggatggtgtcgatctcctgacctcatgatccacccgcctaggcctcccgcagtgctgagattacaggcgtgaggcattacacctggcctactgcactttttaaaaatcatcaaagcatgaaattatctatgagtgagtgaaaactcattagaaagagtcttctcaaagaataaattactttatgccattaaattgataccaaatctgaatttgactagtgctcagcaacatcttatttcccacattagatttaatttaaatatagtaattacccatgacttaagaaaataatattttaaataccatagtaaaatatatgtccgatatttattttctttgcctattattattattttgcctaatatactctggtataaaaggccttccaaataccacagggtagaaaagatttttaaagttacaaataaattcctataaactatatatggcattacatgattttcaactttgtttttagctatattggataatcataagatttcattttttaaaaaattgaaaagccatgatctctcaacttgggttttaaaatttatcatgttttgattataatgagtcttaagctctatgatgccatttttttatgtagttaattaatggaaacctatgcttatcagggaaagacatcagcaattgtggggtacctaataaatcacctttgtaagatttttcttctggaaagcacctcactgttactacattctgtttcattagtctaacagtgaaaacagaatagcaactatctcttaaaaattagatactttctatatataagtatatactttaatatacaaaatataaatatggatatcaatattttaaaattttagtcgttttgtttccttaactattaatgtatttttataatgcaaatgttttattactcatttaataggaatatatatgcattaaaaaattaatgttttgggtagtagaacatgctttactcttagactgttggaaatacttgctactttcagcttttagacataacccaaatttctaaagttttaaagataagactgaatgataaagtcaatttagtgcatttcctttacaaaatgagtacctttggttacttaacacagtatgcagaaaaagataggttatgaaaaaattataatttctataaaatggtgttaaaagcaaaaattgctattatgaatctttgatttgtgaattgaaatctgagaatcttcaagaaatctcataaatatgcaaatactataattaaatacaggtatcattataattactaatttttatcttgtcattttaaaggttccgttttgttttctaacatttataacaatatttttttgacaaaaataggttttaacttcaagaaattatactcttcaagaaactaactgaagagattgggctcaattttaatgtagatataaaattctacatattttaactggtataatctttgtgaaaaagtaatgcttgttttctagtacagcttgacctttagctaaaatgaaactattttaagagtttttactttgaacattgagtgtgtgaacaccgaaaagatgagacaggtgtcagttaatttagaaagcttatttgccaaggttgaggacatgcacctgtgacacagcctcagaaggttttgatgacatgtgcccaaggtggttagagcacagtctggttttatacattttagggagacataagacattaacatatgtaagatgaacattgattcagtctggaaaggcaggacagctggaagcaaagatgggaagacttgaaggagggagagggttctaggttataggcagataagagacaaatagttgcattcatttgagtttctgattaacctctccaaaggaggcaatcagatatgcatttatcttagtgagccgagggatgacgttgaatgaactgggaggctggttggccctaagcagttcccagcttgatttttccctgtagcttagtgatttggaggcatcaaggtttattttcctttcacgtttactcctttttccttttaatcatcttttggagaaagcatttcagaagaaaataagtttctggtctcaggttttgtctgatcttttatggctaggatgctttattcctagacaggtaggtcccaagttattaggaaagctcattttttgcaggtgttgaagacttatgtttatgaagagaaaatagggggaggaagggagaaaaacaaccacaaacaaaggaacaatcctggataattgacgtaggccacagtactttgaagtccatccatcagtaggcatgtatgaatgtggcttatgtatgtaaatagattgctgttacattttctgaagtttaagttgtttagctttagtttgcagggcttcacgaaagcacagcttagttttcagtgactccaaattaggaaatatggggaaaaaataaggaaaacaaattgaaaacattagtttgcagatttgtagtcaagaaaaattagaatttggtccaaaccttagaaaataataaaaattgaaaaacattaggcaagactagaatctaacatcaggtgtcctatagtttttgaaatttttttttctccagtttcccgtgtttattaaagacaaatcatggtaggactgatttgttttattatacttgacctcattatttgtatatagtgcagcaagaataattttttttttgaaatggagttttgctcttgttgcccaggctggagtgcaatggtgtgatctcagctcattgcaacctctgcctccggattcaagcaattcccagccccagcctcctgagtagctgggattataggcatgtgccaccacgcctggctaattttgtatttttagtggagatggggtttctccatgttggtcaggctggtctcgaactcccgacctcaggtgatccgcctgcctcggcgtcccagagagctgggattacaggtgtgaaccaccacgcctggcccaaataattattttttttatgtaggcttttaaattggctttgatggaactttgtttcatagcagaaatttcaggtaagactttttttttttttttttttttttttgagatagagtttcgttcttgtcgcccaggctggagtgcaatggtgcgagctccacttactgcaacctctgcctcctggattcaagcaattctccttcctgccttagcctcccaagtagctgagattacaggcacccaccaccatgcctggcttatttttgtattgtttggtagagacagggtttcaccatgtttgccaggctagtcttgaactcctaacctcaggtgatccacctgttttagcctcccaaagtgctgggattacaggcgtgagccactgcgtctggcccaggtgagacttttttaaagctgtgcccagccatggatttgtaccattaaatacctatgagttgggtgaattcctcttctcttgaggtttcaggataaacttggggctcatgggcctattagaaagtgacattattttacttaccacaggttatgaaccctgttacagggactgtagacaaggtataaggccagtttttccatggggctgttattggctccataagttgtttgattccttaaaagaaagtacatcattcctgttaatgctttggtaaaaataacccatttcttcagtcatgtactgttacaaattaaaacagattcttattgcacattccatagttatatggaaataactatattgccataagttaagaatactaacaagtagtttttaaattctgtagaaatcaggtagagagaaacaaatgttgtttataggagtatactaaattattagaagctattaatagctttaaagaaaagttttcttgacattgaaaaaacaaaacaaaggattagcaatgttttaagcaaaaagttaaaaagagtactgtagtcatctattagttcagtccatgcagttaattcctgttctgcttgacatttatgaacatatcagctctccctgtgtcctgaaattttttcctctatttacatatcaaaatcttcaaagttatcagagattgcattcaagagcacctgttagagttttatagctgattataaaacccccttctaaagaggactaaaagaagacaacaattgtccttggattacaaaagttttaagatagccaaagtttaagacacaattaagtaaatttgttatgtctgtggcacacaataatttaacataacaattacaattattactgataatgtatactaagttatatcagaattatgggagttttccataattttggaatacatatcaataatgtatttatacaaatacagctcaaagaaaaccacgtgccattttgtacttgacaatgcttcttgtataatttttataccaattaagccaaattatgttttttttggactctagggaccctaatatcttaaaggattaattaggttagaaaaagacataatttataatttgattttggaaagtttgttaaatatcaaaggtttaaaacacttgatatagcaggttattgtaaaataagttattcattcaaccaaagtgataactcaaggatttttaaaaagaggcaaaaacccttattttttgagagaggagacttaattttacaaacaagaagccctagtaaaaatagcatgaagccaattaatttttttttaattttataaacaatttataaaattttaatcctgaccataggatataacttccataatcctcttataacctttattaaggagtcggttaatgctttaagaaaaccttgttaatctgacacagctgtacatatgctggtattgccttaatgtgcctttgacattaatgattgatttatagataaactgaactgattttatctttaaaaatggccctatagcattaggagaaatatcaaatgtagatgatgggttgatgagtgcagcaaatcaccatggcacgtgtatacctatgtaacaaaactgcatgttctgcatatgttccccagaacttaaagtataattttaaaaaaaggccctaacagtctcacatccccacctcctctgcgatagtttttgggccttgaggagttgaatagctttaatttctggccctgtatgtctcaggaatacagtttattttgactggcatcttttaccgggcctgaagataaggctgtaactgcttttagtgtttatgctttagcaggacttggtgtcctttttagactcaggatttaaaaccatgtaacttaatattacaaggactttaaaagcacatgaagaaggatacacatatgtaataaccttaattaaaaaaattaattttagttattttcctaagcaaaccaaaacttaataataatggcataggaattgtttcgataaactgtaaaatcttttaggccagttaccaaagggaaaagaaaaggccttttgcactgtacacaatattatgatggaagaaaatattttctttagagctttaagaaaatattgttagtctcaggcaataacaaacaggacatgaggaaaaaaaattatatgagctgaaaatgtgttgaaggagaagttttgctattttacacccttaaaaggggagagaaaacctaaaacggtgagatgcaatacaagttgaacattgtgttaaaaacaaattaaaatctcatataatttattgagtaaatcaatcccttaagaaaatttcattgttttaaccaattatgtagtgtatgagtgtttttgtatatatcaagcccagtctttaaaaagaccattacaatttccctttaattatagacaactttattatgtaaaagtttttatttttatttttttaataaattctcttcttgtgacttacccagactgttcatgacatgcttggactttctggtttgtcctgaacatcactttttcttaaacaaccagttattttattataggactaaatctaccctacaagattttttttcatattaaattatttttctttaagcttttttaccaaaaaaccctttttatttttacaacttcctttacatctttcttatttcctggttccttttaccttcttgtaatataacctttaaattagctttgaattagacaaaatttgttcaccttttcaaaaaggacacactttttttcaagaaagaatgtttttatacaaatatattattattggaaaatgcccaaataatgaaatatctattatttaatttaactttagattttaaattataacacttttgtttacaagtatttatcccattacatttacctaattattttctttttatcatttacctagattgtgtatgaaaactgaaatagtcattatttaaagttattgaactgccattgcaaaattgtacctgagacagtaaaaaagatttgatctaactgacttcatcttgattcttgttcattcctcggtattggctgaacaaactaaattaggaggaatttagtttatagtttagctttgaatcaaagatgaagataacattcccttcccaaaacaaaccgtattgcctgtggactagtccacctaaagccacagaattagaagttatggtaatcttactaaatttaagatgtatctatttttattaaactcatgttaatgtcttatttactaaagattatggaagcaaagattattttctcttgggctgggtttaaagtttatagccaaattttgacactgtatagtatttgaaaggaataagtatgaaattacttgaataataaatacaaagaatgtatgctggcaattcttaacacatttttaatattactttaccaataattttaaagctggcttatttattaaagattttacttaagttaaataaacttgaaaaagcatttgactagccttttcttttttcatgataaagtatttgatttaagcacttttattttcttaagccaattagagatcttttatatattttcagtagtgaaacattgtgtacacaacacaaaaatacatagatgtattaggcatgcctatagaagtacatctttagatttatagatttataaagacctttttttctatcttagacttttagattcttaataacatgttttataacccagagcagttttcagctaaatagccttaaatttgcatattaaaggagacaactcaggtgaaaatcaaattacaaaatttacataataaggtactgagacaaaaagtctggtggtgctagagggagattaaagatggatgccaaattaaacataaaattatagaaatctgtcatagaattgtataaggagaccaattttatttagatacagactacatatattttaactggatctttgagctctgggcagagcccacactgaatcctgggtctccaaaaagggagaataatcatgatcttagactagcatggcatccatgcttttacagtgcacttaaaataattctttttaaacaaagatatttctaagtgtttgaactgcatgcttccttaaaacccaaaagtagcctctgttgtaataggtattttagttaaaaaaatcaggttacaaaatacgaaagcaagcagtttatttaagagctgagacaaacttgtctgtatattcttttggtattccataaaaagcaaacaaacaaacaaaaaacagaagttcctccccaaaagggagctaggtaccttctttgatttctttaaggacccccaagatattttaaactattttaggtcccacatgtagtagatggtgcaagagaaaggagagagagtagatgtaaatggagaaaacagaattcagttaactgagaagaaaaaatattttgctcaaaaaaaggcaaggttctaggagagaaaaaaaaacatgaacgccttttaaatacaaacaggcacacaggcacacatacacacacacacgtcttggataatgacttttaattaagcttaaccactgagctcctttaaaaatttttttaaatctcattatcatatttcagctaggagaaattgctgctatttcagaagtaccaagtatcaaaccagaaagggctggattcaggaaccaaacccagggtgtcctggtggaagaaaaaaaaaaaaagaaggcagaaccttagctgttgaactccagcatgggtggacagccattgttctttcagtttggcctggctagtaaaaaggtggccttgttatgtaaataaagcccctttagtagttaaaattaaaaaaaaaattcatttctttttcccttttgctgtccattttctcccccactacaccacctttgtgtgcatgtgttgtggcagggtgtcaggggtggtggtggggaatttagccacttcagaggccttgttccccataatttggaattttccttcaaattttatcaagtctgatagagttggttaaacccaatgggaaaaagactgaaggaacaataaaaataggaacaaacatacaacaacaacaaaaacagttaaacaaacaaacgacagcaaacaaacacattatgtgattactgaatattgtaatggtaaggagaaattaagaccagctggttcttaaacttagccaagacaaaaccccaatttagctacttacctagggatgggtctcaggctgaagaccgtactctaccagcctagaagctggaaaaaaaactaaaaaacaaaaacctgaactcatcttccctgctgcaaatgagctcaaactccataaaggagttatctgcctttcatcatcatggaaacagaaaatcttgccttccttgttggaagcaagtaaaactccaaaaaagggaagttgtacggcaaaataaactttagatctcgaccaaattttgggagatcagggattctctggacggtatgctcccagacctcagcaaattgtcctattggagccataatgtttgcttatgctgatatcaagcaccaataggagatttgtgaaaggtcagaggcatctccagtcagaattgccttgtggttaccaaaatgtgaacccccaaaatctgagacaggtctcagttaatttagaaagtttatttgccaaggttgaggacatgtgcctgtgacacagcctcaggaagttttgatgacatgtgcccaaagtgattagaacacagtttagttttatacattttagggagacatgagacattaattaacatacataagatgaacattggttcagtctggaaagtcaggacagcttgaagcaaagatgggaagacttgaagcagggagggggcttccaggttataggtagataagagacaaatggttgcattcctttgagtttctgattaatttctccaaaggaggaaatcagatatgcatttatcttagtgagcagaggggcgactttgaatgaaatgggaagcaggttggctctaggcagttcccagcttcatttttccctttagcttagtgatttgggggcccccagatttattttcctttctcaagtgttacatctctagtagatactgcaattcaataagtaaaaatgctaggattttttgctagttactaggaatataataatcaaatgcgtgattgcaaatattataaagtcacatgaagaaaaaggacaggtaacctaataatgatagtacacactgtgactaattgttgttaggaaagtgtagtacttaagaactagagtcagaatgcactgattttcatttcagcttcactacttattgactgggtaaccttctaagccttgatttatcatctataaaatgaaattaataacattacctaattgatgaggtaattcggagtattaagtcagttaatgtacgaaaagtaattagcacagtgcctgggaaatagtaagcactttatgaatatcagctctttttagtagtagtattgtagaagtatatgtagagaaatcaggagtaaaatgaggattgccattcacacaaaatccagaactggtaggcaatgattctagaataagagttacccatgggtggaaggtataagggatgagggaaaagtttgtgccaaacagggttacagaggtttgctaatgtatgtcaagtttttgaaactgctggtataggcataccttgttgtattttacttcgcattattgcacttcagagatgttgtagtttttttactaattgaagttttgtggtaaccataggttaagcaagtctgttcgtgcaatttttccaatatcatgtactcactttgtgtctctgcaccacattttggttatttttaaaatatttttatttttaaaattattactatatagattatggcaatttgtgatcagtgctcctcgatgttacttttgtaattgttttggggtgccaaaaactgtacctatataaaacaagtcagcttaattaatgtggtgtttgttctgagtgctccattgactggaagttctgtctccatctccttaggcctccttttcattgagacacagcaatattgaaatcaagctgtttaataatgctacaattgcttcccagtgttcaaatgaaaagaattgttgcatgtcttgtcactttaaatcaaatgctacatgtgattaagcttagtgaggagggcatgttgaatgccaatacggccgaaatctaggcctcttgtccgaagaattagctgaattgtgaatgcaaaggaaaaattcttgaaggaaatgaatgctactttagtgaacacacaaatcataagaaaatgaaatagcctttttaatgatatggagaaagttttagttgtccgaatataagatcaaaaccactataacattcccgtaaacctaagcttaatttagagtagagcctaactttcttcaattctacaaagtctgagagaggtgaggaagatgcagaagaaaatttggaagccagaagaaggtggtttatgaggtttaagtaaggaagccatcttcataacaaaagtgcgaggtgaagcagtaagtgctgatatagaagatacatgtctaacttaattgatgcagtagctacactaaataacagattctcaatgtatatgaaacagctttctaaaagaagataccacctaggaattttatagcaaagaagacatgtaaatgcttgacatcaaaattcaaaagacaggatgactttcttgttaggagctaatgcatctggtgattatgagccttggtaatgagccagtgctcatttacccttctgaaaatcctacggtccttaagaattatgctaaacatgttctgcctatgttctataaatggaacaataaagccagcatgacagcatatctatttacagcatggtttactgaatattttaagcccactgttgaggcctactgcttagaaaaaaaagacttctttcaaaatagtacagctcattcacagtatacctagtcactcaagagctttgaaggtgatgtgtaaggagattaatgctgtttcatgcctgctaacacaataactgatacggtttgggtggtgtccccaccaaaatctcatgttcagttgtaatccccagtgttggaggtgggggcctggtgggaggtgattggatcatggggatggatccctcatgaatggtttagcaccatccccttcatgctgttctcttggtgctgatagtgagtgagttcttgagagatctggttgtttaaaattgtgtagtaccccctcttcactctctcattcctgctcctgtgcctgctccgccttcacctttcaccatgattctaagtttactgaggcttccccagaagccttgcagatgccagcatcatgtttcctgtacaacctgtgggtctatgagccaattaagccccttttctttataaattacctggtcttgggtatttctttatagtaatgcaagaatggtctaagtacaataaccatttggcagcctgtggatcaaggagtaattttgattttttgtactatttttattaaaatacattttgtaaggctatagctgacataggtgatgattcctctgatgaatctaggcaaagaaaaatctctggaaagaattcatcattctaattgcctttgataacattcatgattcatgggagtagatcaagatatcaacattaacttgagtttggaagaagttgattcccaccctcatagatgactttgaggggttctagatattagtggaagaagtaactgcacttgtggtagagatagcatgagtaatattgatagaattataagtggagtttggagatgtacggaattgctgcaatgtaatgataaaactttattaatgagatgttggtttttatggatgagtaaataaagtagtttctggagatggaaacttttcctggtgaagatgctgtgaacattgttgaaatgacaatgagttggaatatcacataaacttgataaagaagcagctggatttgaggattgactccaattgcaaaagttctgttagtaaatttttatgaaacagcattgcatgctgcagagaaatctttcctgaaaggtgcagtcagtcattgtggcaaatatcattgttgtcttattttaagaaattgccacaatcactccaaccctcaggaaccattaccctgatcaggcagcagctgtcaacactgaggcaagaccctccaccagcaaaaagaaaacatgctaaaggctcagatgatcattagcagtttttagccataaagtattttatatatattttcttctagacataatattattgcacatttaataggctacagcattgtgtaaatgttactgttatatgcactgggaaaccaaaaaaattttgtgacccactttattgcgatattaactttattgcagtagtctgtaactaaacttgcaacatctccaacatatgcctgtactgttatttgactgcagtgttaatgctattagcagagaaagaagcaaggctaagtttctaagattggtatatgatatgttaatgtgattggacgtcataaaagtgagggagaaacactgaggaaatttaagcaagggaattaagaagtgtttggaggagaatcacagaaacctcttttggggttaaagagagcactttgtcagttaagtttgtgtattaaaccatgaggaaagttatgagtgccttcattcattaggcatgtgtttgctatagaaagaacttaaactatttaatgtttataaacaatatccaaggatttatcatcagaataatatgctataatacttatgcagagctgtctggtatatttattcctcatgttttattccagaaatatgttttattttgtcttttacaattgtctattttctgtgtaaccatatttttaaaaatattaccttgtctgaattatatacattattattgtattaattatctgttgaaagtttatatggaatagatttcatcgtggatcttagtaacagctaatttaatctccaatttgaatttatttatattttttaaaagaacaagtaagaatataacctaataagatctcaagttgtttgcctgaaacagcccgattgtctttaagatatgactagttaactagcatcctttatgtaactatgcttttaaatccaaatagtggtttgcaagaccctctctttcccttcagttcgttagatgaacttgataattttagcacattcttttatattacattttccttttttgtttatctgaaatattatatcagagtttattatgtctggcaagctgacgttttgcacaaacacatcaatttatctttcataaaataagaaattttctcccacaaattttgacattttgtagtaaatatcaagctattaatctacttctctgtccaaatgcatttaatgcaacttttttataaaatcataaaatttaaaatattgatcattattattaattcattaaaaatatagcatatcttaaattcaagttttagattttggacatgttttcagtatgaatttacatttacatttgaattgacaaaatgtattatcagggttactgtagtttcagctaacttaatttttagcatgttgtcttatcaattattttgggggttttttaaacagatggggaagatgagaatatgaaattgtgtcactaatcagtctttattttgattattgtttgaataatcactgtataatgaataaaattattaccgaagacagaattacaaaggtgcatttatactggcttaagttttaaaactaactttaaatgtaacttgtgtaaacatgtcatatttttcatgggaataccacagaactaaatggaaaacgttatttgcaagagtcatgttctagccatggcatcaacaaataggaatcttcctaattagaacataatagattttacagtcataaatatcccataccctgagaagatatactttcatagaaaatacaaatttagaatattgttgccgttattgtctcactgttttttaaaagcagttggctaaataatcattcttttaagatggtatcatttttaatacattaagaaataatatttcatgtaatgccacctaattgagacacaataacatctgtaccttcttcctttcatagcttttaataaggatatttgaagtcctaagaatactcctgtgctaaatcttgctattgaatctatttattctataaatttcttgaagttatttatttatatttataaatatttctaaattacattcatttatttataataatttatttatttattcagtagttttattgagtgctttctatatactgtctaccaactactgttctagtcattggaagagtgctgtgaacaatatgaacaaggctactgttctcgaggagcttacattttagtggggaaaagacattttaactaatgatcaaccagtaaaataaaataattttagattgtagtttgaaaagcatagttttatacaatactatagagtaagggggtggtaaattactttacatgagtgtctttaagaagtgcaatatttacggtgagacctacatgatacagagcaagccatgtgaagaccagttgccctacatcacttaagaatgattctcctttgtgcttattccttttcctagaaaccaggcttgtccaacttgcagcccatgggccacatgcagcccaggacagctttgaatgcagtgcaacacaaatttgtaaactttcttaaaacattatgagatttttttgcgatttgtttttttgtttttagctcatcagctatcgttagtgtgttttacgtatggcctaagacaattctttttcttccactgtggcccagggaagccaaaagattgggcacccctgcagtttccagttttattagaaggggcctggaactgctgtatgctattgtagacagagaaaaactgagaatagccagatacacttgaacctaatgctgtgcttcatttctttctgctctctgtatcaaattttcctgtttgatctcagcacttctgcatatttttagatgttaaaaagcgatttcttgtcccacccacgtgagtagtagaagacaggatatttttcatgttcttttttctcatagcacttactgagttccaacatattatataatttattattatcgccatttattatctgctctcccactaagaattttttcactgctagcttttatttttaactgatacatccaagtacctggtacaatgcccagaatataatagatacttagtgatttatttgatatatgcataaatgtataccccttaaggagggaatcttgaaagagaatctgattgagttagtgtctgcttggcattgcttactaattttacaaaatcatccttgtatctgccttccatttccataattaattatatcttatttttaaagtatatacctgacaatggactgcaacagtattttccataggcaatttcctgtggaattttctatggaaagtctcgggtggaggaacattttgaaatatttgtacaacaaattgtagtgctgactcttctgttgaatagccagtatggaatatattcaacctgagcctgtagcctccagctgggactccaagtacaaaaactgcttgtgctgagtctacatttactcttgagtgccatttattttaacagatttgttactctgagtgtcccttgcatcagtttttaagaaagtctgtatttcagatggtactttttatagagactttacccatacacttcatcccaccattaatactcattattgtaaaaggtaggagagtattatctgtagcaggagttggttgaggtcttcaatcagtactttacttaatgttcaagtatcatgtgtaacctaatttgaactgcagctgttatttttgataattttaaaaacagtgttaattttgggaggtccaagtgtctcatcacccccaagaagtggtatttcagcttattctctgaaaacaagctggaatcaaaatagcattcatatttcttatgaaaacttttacatttgtctttattatgtttattaataggtaaagatagataatgtaattatttcaagttttagaatgttttggttctttacttcctgacttttacttgaagaagtagtcagtttcctctggctactttatttattcaaatattctttgggcagatgtaaaaaaaatatatagagatgtttcatgtgtgcctatgtcttgcttacttgcctgaaattatgatctttcttataaggtacttagttatatggacccacagatggcaggtaaaccataataaaattctgcagttccagcctgaatcatgtgcttcatcaatttaagtatattgttagtctgttggttactcccactacttatacaccatttaaattaaagaaatgccaaatcctttatatgttaaagaatggcagatatttgggagtgataatgagttaaatagggattgcacaaggggattagtgaagactcatatttgaatattatatattttaataatcaatgcttttttcccctaaaaatgtgccacttgctctttgaaaattttccatctcagttcctttccccacttttgttggaccttctttgttttgtctatatttattttattctgcttaatttcgattttcacttttagcagtttctcctcattatgagaccagtcctggaatagagatttgactggttgcttttgaaagttcatgtactccaactgttccaggcttctttagaacttcctcaggatcccttcaactaacctagtcttgtattgagcaactctacacttctgttttcacttccttattcaagttggcctggcctagttccagttaatacctttttgaaacttttgagttttcctattgattccctctttttcctgcctcatagacactggtaccttccacagcttgagtttgtcatttacccgtaccagtttatgttttgacatttaaggggatagatagtctgccacttacttttgttagaatagttgttctttttttttttttttttggcttttcaatttagctgctatatattttaatattggaagtcaaggatatcaaaaactatcctgctacgcccactgcccactcagaactctgtcccttggattgcatttgttaatttctaagtagttaagcttgttttggccatatgtgaaattatagttttaattttattttattggaatatgttaatgtaccttataaaagctaccatttagatttttaaaatactttctctgtacaatgtttattgtcttctttttaaaatgttctatggattaaaaatatattttaaatcatctgtgttcttgatgatttctgctctgttttgtaacataacttcttgaaagttcagcctgtagtttgtttctactttgtaatgttccacattctccttatattattctgtttatattaacatccccaccactctgttggaagttcatttgtttaaattactcatgaagttcatgttgtcaaatccagtagccatattttcatcctcgtcttaaccaacaaaatcaaccactactttcttcttgcaacatttctgttctttgatcatcttggcacaaccctttcctggtttcctcccacctacctttccacttcttttttttaagctctaatgatggggtggccctgaatatcctcttagagataatttctcctgcatctattctgtctcctagggactatcaaacaagtacatgatttaagatgacatttatgttcctttgatttccaaatttttaaatctaacctttcctgtgagcttcaagctagtagttactgtctactcttgaacatttaataggtatttcacatttaacatattctaagtaagtttttctttccttatttctcccttgatcctcatggcacttttctattctcaataagtagaaatatcatctttccacttgttcttgtgagagcaaactacaatagtcatgactgattcttctccttcattcacctgtcatatctaatctttcttcattcacctgtcaaatctaatccttcagcacgtctcctcacttctctctctaaattatgtacctaactacttatttttgtcttgatgactactacccttgtgcaagctactattgccttatgactagaaaaatcaaatatcctcttctcttatcttctggatttccccaattatttctttctcacccaacagccagaatgatatttttcttgagagttagatcatgtcattcccatagctcaaaactttccatgggttcccattgcccttataatatattccgaactctttgtcatggccaacgacctatgtgacttgctttttgctttctaatctgaatttatttacaactactctgtcctttgctcacaatactccagatcttatgacttttcataaacatgtctaacctaatcatcatctttacacttgagaaacctctaccaacagatatttgtgtgtttttaaacttcttatttggatataagctcatatatcacccctttagtgaggccagcagctctaaccaccggatccaaattagccgcaaatcctcctagctcatatcatctttgtttttttccactcaaaacaccactgtcaacaattgtgatatccccctacaagttcacctggttattttctccctcctgctattagaacataaaagccaaaataataggagctttgtcttattacaatggtgtagaacagagcttgtttagtgactatttcttgaatatttttacatgatttaaatgatttaagtagatcaattttgtgtctctttgatcagataacttttaaaagagatatgcatgttaataatttcttccaaaattttgccattatcaaattccccttatatgtccagagattgtgtttttacttacttggcctgtatttttggtgcatattgttttattattgttatgttttctttgtctcagtgttttatttgatcaggttttgcctttgaatttcactttgctattaatattggtttatatgttttattgtttttaagtgcctattatatcttcttacagtattttatattttagataaaaatgtgtcactgttctatatgtgttttctgctaaaaacgtaaagctgaattgtatctttactgcaaaaatctctgtctttcaatgtggattcaccctgttgacatttactgcaattgcactgtatcttattcagttaattttatgttatgtttattattttatttgttatttcatctgttctctttttttatatatttgctaatttattcaagcctttgttcaaggtccttatgcccccttttcatttaggtatttatcaacattgcgtaaggtttcctcctattccaatttgtcttaaataaactaattttctttattatgatttcaaaatattatcattttgaagatttttcctgttcttaattattgtttccagaattctgttaccatggatttaagttcttgttgacaatattctttgataagcttcctttctatgatattctatggacaaagacctgggaagaaaattcattcttttaaactttaaaagatgttttttctttaatcttttataatattttcacctataaccaatctcctatgccaattatctttcttcagcctttgtataagtgtttcataattcaatagcttagaagcttgtaggaaatgaatattactatatttaagcttacatgtacatgccaaagaatcattttctcaacttactgtaattctttacataagaaatactgacatcccttattttagaatgccatttaaattccttagtgttctttccttgcactggaagctgggacaattataggattaatttcctttgtttttcttcactcagggatcataatctctggccagttgtccaatgcctgaaattggttgtttcagatacttcacctagttttccagttgtttacagcaggagggaaaactcattccttttagtccattttcagtagaaattctattatgtttttgcaacattttcataaaatattattaaaagaaaaagagattttaatacctgaatggtttagcttcagcaatgtgggaaaactcacttatattgacatctcatttatacatgatacaaaagtttaataatgtttatattgtaacttttacatgccagaaattatggtaaacattaaatttctattcagttagattttctataacattataaggtagatgcttttattattaccattcgcatatgggaaaactgagaaatagactagtttttcaaaatatacagggctagtaattgaaaaaccacattacacaatcagttattctctatccagatgctatattgttgattgatatactataatacacttcctcaggacagatgttacagtatgatctctataatgttaacagaaatggagaacgacttcaactttttggctagtttcaccttttaaaattaacttcttattaacattaacaagttttaaaatgatgtgacatattttattatttgaatggtgtgtaacaaaacatttgtatatatatatgaagcttccccagatgaagttatatagggagaaaattccctgttttcttagctgagttgaaatgtgggtgttttggttaggcatatttaatctgtcatagtatttcacatgaaactcttagcgtgcatccttaaagtaattatataatagtttttaaaatatttaatgtcgtattctacactatgaccatcattagcagttggatatattaggtattctagatgaaattttcattccatcacatatttgatttataatatcatgatccaaatgtcttggtgatttagaaaaactgtatttacaaatgtcatgaaatatcaccacaggttttagagaagaacatactttcaattttttttattttgatttttcagattgcattctcacaacacaatacaatcatggaccttgtgcagttttttgtcaccttcttcaggtaaaagtttgctttgactgactttgaacttttcaagcctgtattctgatatatgtcctgtcaatctgttagataatcgaccaattctaaaaccttaaagtatcatagagtatgtcttgaatagctttatatgcttaaatatatcccacagaggagaggtaacatagctgaaatgtacttgtgcaagattattttgctgttatactatttaatagccaatggattcagtggaaagaggataactttgtgtcccccatcacataaataattatagcctgttttaattaatgaaattaacaatgcatgcaccacatggattagttacatctacaagaactaaaccaatttgtttatttcttagttaattttgttaattgtgtgacatattcgttgtaggttcataaaaagggctccacagtgaagcagctttgtaaaatgctacatgtcctaaagttaaatagtgctcttttggttggttttcaactggcattacttctcaaagcttttaaaatgctaatttgcaatatgtcattctacaagagaggttatagtttgtagcatttctcaaaacatgaaaactgttttcagggaacatttattttcatttccatgggatgtaaatgtagagactctgggttaggagtttaagttataaaatatctgtgttatgagatcgtagatcctctggattggaagagatcttatttttgttaacattattattcacgtgtgaagtttatgctggtcatttgggtgcctttgtacaaattagacaaatatgacttctccttctggcagatacagccccacatcatggcacacaaatttggaaatagtgcagtatgaattttaaccaacactcaccaacttggctgggctgccatacagtaaagacctgcacaactcaatccttagcacagatgatgtatttggaacttgtctaaacacaaagtaaccatcatctttttgattgtcttgtccagatatccataaagtatttgaatttctaataccttcttcactggagtcagcaaacattttccattaagggccagatagtaaatatttcaagatttgtgggctgtatggtcttcatcgcatctatgcaacttttctgctatagtgttaaagcagacaaagccaatatggaaacaaatgggagtggctgtgttccaataaaactttattataaaaacagctggtggattgaattcagcctgtggacataatttgcccaaccactgatcagttttatgcctgaatgcctttaatgacaggaagctcactagctcctcagatggcattttctatcatcagataacaaattgttctttataactgagctgaaatctgcctccctatgatatctctcctaattcctccatgtgggcccatatataacaatttcaatttctcatttccatttacagcccttcagatttgtaaagtattttctacggtttacacattccttgttcatttttctacttctcttgataagagaaacctttgccatattggtcagtttactctgaaaacaatcatgttcatccatgcaccttaaaatattataatttctataatgtatttctataaacatatttatcactaatatgtgtaaaaagtgcattcgtactttaaattgttccttaaaatgaaatttgaggaaacatcttaaatatgtttaatattttacaactttgtacttcagaaaacaaatgaattttaaggctattaacaaagttacagtatggttttagaaagtactagaaattacagttgaacaagcattattgaatgcattaaaacaacttttgttgttgttgttgttgttgttgttgttgttgttgagacagggtctcaccctgtcacccaggctggagcagtggcgctatttcggctcactgcaaccttcacctcccgggttcaagcatttctcctgcctcagctcctgagtagctgggattacaggcacgtgccaccacgcccagctaatttttgtatttttagtagatacggggtttcaccacattggccagggtggtctcgatctcctgacctcagatgatctgcccacctcggcctcccaaagtgctgggattacaagtgtgagccaccatgcctggtctaaaaaaaactttttgatgcagaatagtctggaagaaaattcactgaaagtttggttaagtgaaaaatttcacaaagttgaatatgtatgtaaattatttgaatcttgaggttttttattttaagcttttgaatttgtgtgcatatttaaattcaatagctcttttgttaagtaaaagaaaattactgttaatgtgtaccatgtcttagagatgatcctatttattatgttgtcatcatggacaatgtaaaataaaatattctaatctttgggtgtgataaaatatatttgatgggttttttgtcatttaaattcttccagtagtgaaatgtaaattagatcacttaaaaaactgggtcattgttaagaaaaatatggacaggatattttgaagcttatcaattattaagttttataaagctactgctaaactttaggagattttaaaacaggttaacatttatggagacccctcaatcaggccatttttactgttattgctgttattttggtaacagagctgagtgcgtcagctttgcagtttagccattgttctgtaggggctggttctcaaactctttgttagattttacctctatattgtgtgtagttctgatggtaaacataattgggccagtactagggagatcacttacagacataccctggctctgttcttaatgttttatgccatcttaagtaggtcactattttagtttgtttgtattgctgaaaaggaatacctaaggctgggtaatttataaaaagaggtttatttggctcacagttgtgctggctgtacaagaagtagggtgccagcatgtgcatctggtgagggtatcaaactgcttccactcatggcagaagaggaagcggagctggcatgtgtagcaatcacatggggagagaagaggtgacagccagagactcctttaaacagccagctctcttgggaactaatagagtgagaactcatttgctaccataaggacaccaccaagtcattcacagggagtctgcccctgcaactcaaacacctttcattaggctcaatctccaacgatgggtatcaaatttcaatatgtgctttggagggtcaaatattaaaactatagcattctatccctggcccctcaaatccctggtgttcttctcacatacaaaatataatcatttaatcccaatacttcccagaagtcttaacttgtttcagcatcaactcagaagtccagagtccaaagtctcatctgagactcaaagcaagttcctttcagctttgagcctgtaaaatcaaaatcaaattatttatctccaagatacaatggtggaacaaatattgagtaaacatctcattccaaaagggagaaactggtcaaaatatagtgataacatgctgcatgaaaatccaaaatatagcggggaagacattaaatcttaaagctccaaaattatctcccttggttccatgtcctgcaccctgggaacatggatgcaccatagccctgctctactaggcaatccctggtgggtactctcttcagggcctccaaccgcatatttctgctcagcattgcctcactagcatctgtctgcagggtctccacccctatggcaggcttctgcctgggcactcaggcttttcaatacatcccctgaaatctcagtggaagccgacaagcctctagtactcatactttctagcctccttcagtggcagtaggcacaatacctggggccatttgagcagcgagatgtggggagcactttctagagatggggcatggcaatgttgtcccaagcctgtcatccaaaaccataccatcttccttgggctcttggtctgtgatgggaagcccagaagcctgccagatttgtgaaatgccttcagggtctttcccccattgtctttactaatagtacctggctccttttattcatgctactttctttaacaagtgtttgctaccccagcactcttctgaaaacactctttccttctctgccacatggccaggctgaggattctacaaattgttatcccctgctttccttttgattatacattccaactctaggttatttatttgctcctgcatgtgaacataagctgttaaaagcagccacattacttcttgagcactttgctgcttgtcatggacacaatgtagcaaagttctttgacagggcataacaaaggttatctttgcttcagttccagtgatttcctcatttcagtctgagaccctcaacatggcctttactgtctatatttcaatcagcattttggtcacagccacttaaccaatttctaagatgttccaaactttccctcatttttctatcttatgagcactccagttctaaagccacttttacatttttaggtgtctttatagcaacataccacttcctggcaccaattttctgtcttagtccatttgcattgctgtaaaagaatacctgaggctgagtaatacataaaggaaagaggtttacttggctcatggttctgcaggttgtgcaagaagtatggtgttggcatttgcatctggtgagggcctcaagctgtttccattcatggtggaagaggaaggggagctggtatgtgtagagatcgagatcacatggtgagaaagtaggcaagagagaagacagaagttccagactcttttaaataaccagctgtcatgggaacatgagacacaacgatggcacaaatccatttatgatggatctacccctgtgacccaaacacctcccattaagccccacctctaacattgagtatcaaattttaacatttgatttggaggatcaaatatccaaactatagcagtcacctagcttctctaaatctcagtcctttcatatattgaactaaaggtttttttttcttgttgttgctgtgaaataatatagtaaataattcaaaaattgaaaagaataattttttaaataaactcttcttgtgtgtaaaatggaaaagtagatgtatctgagtcagaaaagtctgaattatttattttaaagaactaaattaaatggaaatttggtagagactactatccctgtgttagacttttagtggtggcattaattttctatatcattggatgacattatattttgtatttattaacttgtccagttgggagtagtttcagagattaccagttggtcttttccactatgactgatcttatcctataagccagggacacagtgtagaggttattccagctaccttgtacatcagttctatttatacacttaaagagtggggaaatgaccaatgggtggatccattgacatagtgggcacactgtgagcaagaatttagtcagaatttgttatgtgcccccaccccatgaacaccccaactctaataagaggacatgatgatattttgaatgcttggctatctgtgtctaatgggagtcaattaggccctcatgtctaatggtagtcaaaatgtctgcttattcctcctgtactgtatatatatcctcatgcatataccaatgtatataatcaagtttatggtgtaggtattttcagggatcattttacccacttttcaaaatgtttcagggaccttccttctatggactcagtcacctgattagttaatcggttttggattttaaaattagctgaaatctgggaactgtgaagagaaacatggccctccattgaagcaacaaccctcagtctcctgttccttcattcttacttaaaatgaaaccagatgttaaatagtaccactgttggctgcccacctattttcccttcagaataccatgccttattaataatccctacaactctttgtgagccaacccccttggcagttcgtccaatcttgttgatctaattatggtaattgtggtttctggattctggcagttaagcgctgacacctgtcgtctattacattgggtctccatctttttatggcaattaacaaacctagccctgtgactatctctcgtattttcgggactgctctgaagaggagagccagctctaagcctccttataatactggtgcctctcttatcagcatattcataacagccttaatgcatagtttgtcctctgagtcctcccatggaacacaacctggtagttcttctggcctcctataatataaaccattccagcatatccccttctctcagtgtttttataactttctcttccataagccaggacaacccaggcatttcaatttcacttgtactggacattgcatttttcaggcttctacgagtcactctagcaacaagtttgctccattccctggaatcctcagtagggtattacatctctgtggtcctgaaaatatgcaccaaaaccaatgagtttttatttatccagtcttaacatttcgttgccctttatcaaatatttaaatctggtcatacttccatggctcctgccagtacgtgctccctaaatcttgcatccgtatcaattgtgtaatccattttctttcgtatcaggctcagttgggtcatgctgtgatttaatccccctaatcagtctggcagccaagaaaagaagtggtgacagtttgtgagggggcacctgttacctaagagagaagagagctctttagtgtcttccagcataacgaaatgctaggtattgctagggaagcggttggtaaaaccaacatcctcagaagcattcattcatatattcctattccatatttcaggttcctaggtctcctgaaccatggccctttttgcataacacaacttctttggcttagcattctgtcatctctggagctctgcaactctacaacaattagatcatcatcctgctggtcattcatgttggcatttctgctatcagtcatcagggcctcatttaaagctatgaaagagacccactggctcttttatttagccagtaaatggtttgttaatggccttcagtctctcattatccctctgcaggtatcaatacaacataatgataatcattctactccactctcttttgaaggtgttttccccatcttccaagcacctgaattgctgtaccttcaagtattttctctatcagtgcattttctcaggtcaccactggtgaaatccagcaatttaagtcttctgccaggaactgtgttccacccaccaacatggatgttgtcctcttagcctgccaatcagtgagtgaatcagttcctcatctccatcttaccttctgtttacttggaccataagtcctctgagacacagaagccaagatgggattagataagcaataaacgtgttaggggaacttctgtgaggggaaattgggagaagggaggggagataatgggagaatttgagaccacaatgcctacctgcctttgtgagggagagaagcaagaaagggaaggtgagtgaaagagcctgagaatgcagggcacttctaagaatgtttaacaccagtggtgtagccttgagcaaaagttacccatcaaaggagtcttccatctcccaggaacaggcccgccttggtatttctgccatgtttagtccttgactaaggacagcccttgggaagcatgggctcagtgtgaataaaatgatggatttcagagtgcagtagctggggccactagtcagttatgctctctgccatcagggatcagagaggcacttttttttttttttcccccccgagatagggtctcactctgcctcccaggctggagtgtagtggcacaatctcagttcactcaacctctgcctcccaggctcaagcgatcctcccacctcagcctcctgagtagctgggaccacaggagcttgccatcacagctgactaagttttttgtatttttggtagagatggggtttcaccgtgttgcccaggctggtctcaggctcctgagctcaagtgatccgctcacctcggccttccaaagtgctgagattacaggcatgagccactgtccccagccagagaagtatatcttagtggttggcacaatggagttatttgttgtgtgatggttgatagaactgacctataaaacctgtaaaaaatgattttggtaatgtgtttgtatttatttttgtgtagtttatatttttgagggtagatttttaaatttgactaagtttcagtaatatttgtgtctatggaggtttttaattttttcctgacctagttggtaattggctttttaatggaagttgtactctttgtttcattttataaattcattgacatatttacaatattaatactctgaagtttgttctatattagaattgtgcctacccttttattgagaattttgcctatttttccttccttccctccctccctccctccttccctccctcccttccttccttccttcctcccttcctccctccctccttccttatccttccttccttctttccttccctccctccctccttccctcccttccttccttccttccttcctcccttcctccctccttccttctccttccttccttctttccttccctccctccctccttccctccctccctccctccctcccttccttccttccttccttccttccttccctccttcctttcttccttccttccttccttccttccttccttcctttcccttctcatttctaaaaataatctgcttcagctgcattctgtagacattaatatgtagtatgctggtctcatagaatgatttaggaattgttccttccttttcactttttgggaaaagtttgagcattggtattagttattttttaaatgggtagaatttatcagtgaagccattgagttcagggcttctttgttgtggtatatttgattactgattcaatctccttactggttataaatctattccattttctattcctttatcattcaatcttggtaggttttatgtttctagggatttgtccatttcacctagcttatccaatttattagtgtataattgttcatagtactctcctataatcatttttatttctgcagaattggcagtaatgacccgacttttcatttctaaattttgtaatttcagttttctttctcttttctttttttttggtcagtctaactaaaggtttgccaattttgttgctctttttcaagaatcaacttttggtattgttgattttctctattgtttttctattttctctattgtttatcttgctctaatatttataatttccttcattctgctacctttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcattgtctaatttttaaacgttttccaatttctaattttaatttgtgttttatttggtgatataattcacatataatacaattcaccaattgaaagtgcacagttattcttcaaccattattgcaatcaattttagaacatatcatcatccccaaaagaagccatgtactcatcagtagtcactccccccttttacatacccctagttctgaaaaatcactaatctactttctgtccatagatttgcctattctggacatcttatataaatggaatcgtacaatatgtgttcttttgtgactggttcctttcattagcacaatgtttcttatccgtaacgtagtatggatcagtactttgtttctttttattgctgaataatatttcatcttatgtgtataacacattttatttctctattagttgatggttatttgagttctttcttctttttcactgttgtgaataatactactatgcacatttgtgtgtaagtttttatgtggatatatattttcatttctcttaagtatataattaggagtagaattgttgatcacatggtaactctaggttaaacattgtgataaactgccaaacatttttttaaagaagatgtatcattttataatcttaccagcaaggatcagacatttattttttccacattcttactaaagtttgtattaactgcctttcttatagccatcttagtgggcataaagtggtaagagatgatgcatatttagaggaattaaaaatgaaagattaaaggaatctaaagaatacaacaggcaaagaaataataagagttaagcgcttgaaaaacaagaacaatcaaagatgactacatggaagcaagcatgcaagtgagcagaataatgcaaagttaagtatagtgttcatgatttgggaaaaataagactttttattattattattatactttaagttttagggtacacgtgcacaatgtgcaggttagttacatatgtatacatgtgccatgctggtgtgctgcacccattaactcgtcatttagcattaggtatatctcctcatgctatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaagggcatgaactcatcatttttatggctgcatagtattccatggtgtatatgtgccacattttcttaatccagtctgtcattattggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgagtaatcgccacactgacttccacaatggttgaactagtttacagtcccaccaacagtgtaaaagtgttcctatttctccacatcctctccagcacccgttgtttcctgactttttaatggttgccattctgactggtgtgagatggtatctcattgtggttttgatttgcatttctctgatggccagtgatggtgagcattttttcatgtgttttttggctgcataaatgtcttcttttgagaagtgtctgttcataccctttggccactttttgatggggttgtttgtttttttcttgtaaatttgtttgagttcattgtagattctggatattagtcctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattaatttttgtataaggtgtaaggaagggatccagtttcagcattctacgtatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgatgcgggctcttttttggttccatatgaattttaaagtagttttttccaattctgtgaagaaagtcattggtagcttgatggggatgtcattgaatctataacttaccttgggcagtatggccattttcatgatattgattcttcctacccatgagcatggaatgttcttccatttctttgtgtcctcttttatttcatcgagtgctggtttgtagttctccttgaagaggtccttcacatcccttgtaagttggattcctaggtattttattctctttgaagtaattgtgaatgggagttcactcatgatttggctctctatctgttattagtgtataagaatgcttgtgatttttgtacattgattttgtatcctgagactttgctgaagttgcttatcagtttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaatcttttctgcatctattgatataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaaggatattggtctaaaattctcttttttggttgtgtctctgcccggctttggtatcaggatgatgctggcctcataatgagttagggaggattccctctttttctattgattggaatagtttcagaaggaatggtaccagttcctccttgtacctctggtagaattcggctgtgaatccatctggtcctggactctttttggttggtaagctattgattattgccacagtttcagatggtgttattggtctattcagagattcaacttcttcttggtttagtcttgggagagtgtatgtatcgaggaatttatccatttcttctagattttctagtttatttgcgtagaggtgtttgtagtattctctgatggtagtttgtatttctgtgggatcagtggtgatatctcctttatcattttttattgtgtctatttgattcttctctctttttttctttattagtcttgctagctgtctatcaattttgttgatcctttcaaaaaaccagctcctggattcattaattttttgaagggtttttttgtgtctctatttccttcagttctgctttgattttagttatttcttgccttctgctaggttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagagctttacttccaagtatgtggtcaattttggaataggtgtggtgtggtgctgaaaaaaatgtatattctgtggatttgggatggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctccttgcaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggcagatcttcctccatcctttcattttgagcttatgtgtgtccctgcacatgagatgggtttcctgaatacagcacaactgtatgggtcttgactctttatccagtttgccagtctgtgtcttttaattggagcatttagtccatttacatttaaacttaatattgttatgtgtgaatttgatcctgtcattatggtgttagctggttattttgctggttagttgatgcagtttcttcctagtctcgatggtctttacattttggcatgattttgtagcagctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgtcctattggcccccactctattctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaccgatcagacgtagatgtggtcttttcacataatcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcaagccttggttttcagctccatcagctcctttaagcacttctctgtattggttattctagttatacattagtctaaatttttttcaaagttttcaacttctttgcctttggtttgaatatcctcctgtagctcggagcagtttgattgtctgaagccttcttctctcaactcatcagagtcattctccgtccagctttgttccgttgctggtgaggaactgcgttcgtttggaggaggggaggtgctctggtttttagagtttccagtttttctgctctgttttttccccatctttgtggttttatctacttttggtctatgatgatggtgatgtacagatgggttttcggtgtggatgtcctttctgtttgttagttttccttctagcagataggaccgtcagctgcaggtctgttggagtttgctagaggtccactccagaccctgtttgcctgggtatcagcagcggtgtctgcagaacagcagattttcgtgaaccacgaatgctgctgtctgatcgttcctctggaagttttgtctcagaggattacctggctgtgtgacgtgtcagtctgcccctactggggggagcctcccagttaggcttctcgggggtcaggggtcagggacccacttgaggaggcagtctgcccgttctcagatctccagctgcgtgctgggagaaccactgctctcttcgaagctgtcagacagggacatttaattctgcagaggttactgctgtgtttttgtttgtctgtgccctgcccccagaggtggagcctacagagacaggcagacctccttgagctgtggtgggctccacccagttcaagcttcccagattctttgtttacctaagcaagcctgggcaatggcgggcgcccctcccccagcctcgctgttgcctagcagtttgatctcagattgctgtgctagcaatcagtgagactccgtgggcgtaggaccctccgagccaggtgtgggatataatctcctggtgcgccattttttaagcccgtcggaaatgcgcagtattggggtgggcttgacctgattttccaggtgccgtctgtcacccctttctttgactaggtaagggaatttcctgacgccttgtgcttcccaagtgaggcaatgcctcgccctgcttcggctctcgcacggtgcgctgcacccactgtcctgcgcccactgtctggcactccctagtgagatgaacccggtacctcagatggaaatgcagaaatcacccgtcttctgcgtcgctcatgctgggagctgcagaccggagctgttcctattcagccatcttggctcctcccaaaaataagacatttaatcatgttgtacataaacatattttgaaagagaaaaaagaagaaaatgtaactccctgaagaaaaaaggtgaacctaatttagtcacaggatctctacatcaaagagatataatcctagaatatttgccaaaaagttttttaaacaatgtgtaaggacactgtgaagaattacaaatacaaaaaagtctctgtttaaaaaaataagattatgatgatggatatggtaatggaaatgacacctgaagatatggattttgctaagtagaaacaataaatgatttcttactgtactggaagttcacttaggaattttctccatggtttttttgtggaatacagtagatacttaggacctaactgttcttgtaaaccaaaatatttaatgcggtgggagtaaactagtgatggtacgttttcttgcaacttagttaaaccagtgctccccatctagtttacaaagctgaggtttatcgtactagacactgaaatagacttctccaagagtcatatcagtaacttcacactttgacttaaatattgctttacacctcaaacttaacatgctttaaattgaatttactgtactgggaaacagtctctttttttccagttttctgtagctcagttataggtatcactatttaactcacttgaatacttgggactcatttaaatcctctttccttaatgacctacatgaacatcagttctaacttctttgtatcaatatattatatgtaaattagccaaagtggtaatttaaacataaattattaactccactgtttaaaatcttccttttacatttataattcaaagtatgagtattctcatacttaaagtataccagtcactttttcattgttagagggggcagtggttaattacttgcctttttttccagcatttttttggtccttattgtttgttttttacttctgttggaagcattttaaaatttctgtgcagtaaaattccttttgcggggagtacagttgtgtgagttttaacacatgcatcatttattataattaccagctctcccaggatacagaacaatgccaaagccccagtgaatacctcatagagccttctttgcagtcagactttctccccacccctacacgctggcaaccattgacctgatctctgttcttgcagttttgccttttccagaatgtcattcaaatggcttctttcccttagtctactgcatttaagattcatccaaggtgcttttttgtatcaatagtccatttcatttcattgctaagtagtatttcattatatggatatatcacactttgtttatccattcacccattgagagatatggattgttacagtttttggtacttataaataatgctgctgtgatcaacatacatacaagttttacacaaacataagttttcatttctctagcataaataccaggaagtagggttgctgggtcacagggtggatgtatattcatctttataatagctgccactgtttttcagagtgactgtacaattctgtgctgcgaccagcaaagctcagggttccagttgttgcacattctcaccagtgcttggtcctgtcaacattttttattttagccattctgataaatgtgtagtggtatcttgtggtaattttaacttgcatttccttaatggctaatgacgttgaatatcttttcatgtgcttattagttatactttcattttctttggtgaagtatttttcaaatcttttgcctagttttaattgctttttagttttgctgtttatttttgaatattgaatgttttttgtatattctggatacaactcttttgccagatgtgatttgcaaatattttccctcagtctttgaattgtcttttcattctcttaacagtatcttttatggagtgaaaagttttagtttttataaaattcaatttaatgcatttttttaaaaacttgattatgcttttgacgtcatatccaaggactctccctaactcaagttaacatagatttctttctaacagttttatacagtcaatgcactacataacattttggtctatgacagaccacatatatgatggtacttataagattatattactatatgtttactgtaccttttctatgtttagatacacaaaaaccattgtgttataattacctacagtattcaatacagtaacatgctatataggtttgtaccctagtaacaataggctataccaatggctttcatgtgtagtagggtataccatcagtgtttgtttaagcaccctctatgatgtttgcacagggatgaaatttgtctaatgatgcatttcttagaacatatccccattagtaagtgacacatgactgtatttttacattgtacctttagatctgtgatccatttcagttattttttgtttatgttgaggtgtaattcaatgctgattatttcacatgtggatatcctgttgttacaccatgatttgttataaaggaaaaacctttccattttgaaatgcttttgcaactttgtcaaacattcaccatagggttccagttccaggtaagattgtgtaaacacacatctctttttctctaagtgaactcaaccatgaaacctggacaaaattcatgggcagctatttggtatatgatatcagcaggcagagcagagaagaacaccagaattcaaagtactggtgaaccatctagaagtttgccatttttcccctttagtgccccctgacctgaagtcaatgcaatttgaaacttggaagtaactactatagtttggacagggtaaagtcctctagttctggcccatgatgtggaaaagggaactcttaagctcagagagaatgagggagacctccctcccattttttctctttttcctgaattcactcacccataccccaggcagtctgaagcaggaacatgggcagcagcaaaatggctcacagtgggaagcagtaagaaccacaatcccaagggaagggaatattcctctaatcatagtggagctctggctacagagagccaagataaaccctgttgatttccttcttgtctgtcctcccagctcaaaacatggtacaataggaaaagtgtgtagtttctgaccacatgatggaaaagtagagcccacaaatccagaaaggacctaggagataatggagatagaaaagccttcccatcaaatgttatggggtggggggagggggagggctagcattaggagatatgcctaatgtaaatgatgagttaatgagtgcagcacaccaacatggcacacgtatacatatgtaacaaacctgcacattgtgcacatttaccctagaacttaaagtataataataataaataaataaataaataaatatatagtgctttataaacttctgggatctctcctgagctgcctgtgtgctgatctgatcctaattaacattatcatacgaaagaattggagaactgagctcatagatagaactctgctttgggcccggactgaacagtgggtagccctcccgctgcactgactcaagaagcacttcaaaagctttggatgcattgtgaccatagcctccagatggataaaacaaattatctctctagagaatatcaacattatttataaataatacctcaatccctttgtaaagtcaaggtagcacaagagagatggattaaagggtacagtggaggccgggcatggtggctcacacctgtaatcccagcactttgggaggctgaggcaggtggatcacgaggtcaggagttcgagaccagcctggccaagatagtgaaaccccatctctactaaaaatacaaaaattagtcaggagtggtagcacacgcctataatcctagctacttgggaggctgaggcagaattgcttgaacccaggaggcggaggttgcagtgaactaagatcatgccattgcactccagcctgggcaacaagagcaaaactccgtctaaaaaaaaaaaaaaaaggggggagggaacagggctctaatggaagtagtcattcttaagttaattaccaagtcaaggactatctctcaatgtttagtgctttaagaaaactttcatcaggtactagatctattacctatgcgtatgggaaaggtgacatttgatccctgctttgaatataaaataaattctaggaggaaaggtaaaaacaatgaaatatctagaaggtaatgtaggaattattcttcataacattagaatatagaatggattcttaaagaggacacataaaatactataacaaaattagactacaaaaaaacctaacactttttcttatcgaaagacaccattagcattatgacgagtcaagtcacacagtagtacgaaatatttgcaaactgtataaaagccaaaggccttatattcacactatgtaactcatataaatcaattaagaatagtctgaaaactcctttctccaaaaatgacaatagactgacatacacttcacaaaagaagacatccaagtgtccaacaaaatatgcaagagtgctcaacttaatttttatctgggaattcaaattaaaaccacaatgtaataccattatatacctactacagtggataaaaagaaaaagacaaataataccaaatgttggagaggatgcagaactattcatacttttagtacactagaaattgatgtaatggctttgaaaacaagttgacattatattctaaagttgaatttacatatactctgtggcccaacaattccaagtcatcaaagtcatgtgaaccatatttatagaagcatgttttacatgccccaaactgggaataatcaaaatacccaaaaataatagaatggaaaaatatactcatataatgtggagcaatgggaaaataaaacgattgccaaaggatcaaaataggtaacacgaacatagtgttgaatgatagagacagaaacaaaaaaaatactatagtgttatatttgtaaaaaatttagcaatagacaagactgaagtatggcattaaaaataaatgtgatagttccttttgagaaggagagaatgaattaagttctgtttcttcaagctggtggtttcaagggtatattgtctttgtgataatttattgagctatatacttagggtttctctattgtgttatacattaatgatttaggaaaggttttcaaaataattaaaatttttgtcctaactatatggttttaaaagatgtgcttcaaaaaacatttaatgtaggaagaaacactgtatacattgtcctttgtcactttttgttgcaagtttggaagaataaggtattatccaagtaggctacttgtaataggacttacccaggaagattttccttattagatattagtctttctaatatgccatcagatgaggcttgagactactccattttctgtagagttttaggaaaaaatttaagagtgactaaagatgctctgtagcctcaaaatctgttacagattttgaggttctgttacagaaccgtggcagggaggttaatttaggtactcttctataaatttttcataaatgatatctagtagattttattctttcccagccttcatttaactccctccacgtggctgtgtagcaaaccatccaatttaaatgggatttatctctcactagcttcatgattgtgccaatgccatttattgcatcgtcaatgtttggtaaggagtgggcatgtataatagtgtattatacaagccttggaactgctgcgttcatttttgttcctaagaattaaagaagcctgaaaataaagttggtgcgtagtgttatgcatagtccagagaatcataagaaaatgtagctaggaccctgatcagaccaaacctggaacttttcttcctttggactttgggaagtgtcttagtgtgcttgggctgccataacaaaataacacagactaagtgggttaaacaatagaaatgtattatctcccagttccagagggtagacagttcaagatcagggtaccagttgttggtttctggtaaaacctctcttcctggctctgcaaatggctgccttcacactgtgtactcacatggcctttcctccatgcatgcaggaagagagggagagtatgcaagttctttggtgtctctcctttaaggacattaattatatcagatcagaatcccatgtttataaacttcatttaaacctaattatgtcctaaaggccctgtcttcaaatacagccacactggggggttagggctttaacatatgaatttgagaacacaattcagttcataccagggagtgtaaacttcatgtagatctcttctttataccagtttgagttaggttttctgttacttgcatttgaaataatcttaactaatagtgctcctaaggtacagtaactcttgcttaacaaccctcagaagtttgaccaatttattctatgcgtgtattatttaccacattcagccactgggcttttgatttttcatctttttcaaactgatgacttgaacatataagcaattttttctttttaatattcatatttttattgcattttaagttagaagtgtattctgttaatatgttcgtttgtaagaaaaaatcctttaaatgtcatgaaggtataaaattgaaagatagtttgtggaataacagttattaggaggtaaatttcttcatttcaacacaatttccctgtttctaacatttttcagtgaaatataataatatgcccaaaccatcttttaaaatatgtacttaagacttgacatttatgatcagttaacctcaaattgctataaaatagcgacaatattatctctttttacaattggccaactagattaccaccagagggtatttatttgtcacagcaacctgcattacaatgtaacgttatagcacactatgttacttatattgaattcttttaattttccctaaatgagattacctaataagttccatttttttacattaagaatcctttcaaaatgaccattttatgaataataaaatcaagttattgaaatatctctccctaagtttttatgcttcccttttttattcctgtagctgatatacttgctttttaatgtttgttttctttctttctttctttgttctttttactccctatttcctttgggtggattgtactgaggggtgttgaacctttcagatcttttgatattattatcgtacagcatatttttttttgaaaaagaaagcccaattattcccccatcaatatctatatcatggagcataaaagcttttgcataatgtgataggaaaagaagacctgaaagaaagcagtagatacttattttttctgtgacaaatttgccacagtaccaaattaaaacatactagtgttcaatgatacccattaaaccctttgatttaagagatagagaaaagctaactggaatacacaaacctacaaatatgtcacttaacataataaaagtttacaatgcttctgtgtcacatcaagtccagtgggcaaaaaaggagccagtggaaggtgtagtaggctgttcttgcaatgctataaaaaatatctgagtctggataaattataaagaaaagagtttaattggctcatggttctgcaggctttacaggaaggatggtgctggcatctgctcaacttctagagcagcctcaggaagtttacaatcatggtagaaggtgaagggggggcaggcttgtcacatggcgaaagcaggaacaagcaagagagttaaggaaggagaagtgccacacatttttaaatgaccagatcttaggagaactcactcactattgtgaagtcagcatcaagccatgaaggatcttttcccctgacccgaataccaggccccacctccaacactgggattacaattcaacctgagatttgagttgggacaaatatccaaactatatcagaagggatagcatggaatacaggacactgcttcacatggtcatttaagaaattcagatgatggaaattctgtcattcttcaggtgtccaagattgtcaataaagacggagactctctagtagtcaccaaaggaagaatataactttttaactatgctgaataaatatgacaaatatttattgtttgcctgtttgttttgctttttagcaaagcaagtgttcttaaactgttttttgtttgtatgtatattttttaagagaactgtcacttttgtttgcaatgtaatttattagaaatcaagaacatttataaagtattaccctatataaggataataatgccaaatgagacattcagtattagaaaaaatgatgttattcaaatcaatttaaaaaccaatttagggaggctgaggcaggagaatggcgtgaacccgggaggcggagcttgcactgagccaagatcacgccactgcactccagcctgggtgacagagcgagactccgtatcaaaaaaaaaaaaaaaaaaaaaaagaaaaatcatttatttagcaaaaatgtattgacacctactatctcccaagtagtaacatatattttactggatttttgatatttactggagattatgagaatattattttaaaaatattttcttacactgtttattgattttagtagccaagtttctacgtcacgttagctcttttactgctaacctaataggaattaccatagaaagcatctgacacaaacccttaaagtgtataactccttgtttcaagaaagtgagattatgaaaattgtatattttatgttgtccttatacatcattacaaaaacgataatcagttgagtcataaagtttagataagaaagaatttaagctcctcatgagaaattcaactagtattcccgtctcaaactgaatctttattatgtaactcttaaggaagaggaatgttgtgaattattaatcatataaaaatacattttggtatttaagttgtatctactgaatataagtaacttttctatatacactattatttgctacgacagattttctgaaagaaactgttgacaggatctggtatctggatgtaagggatgatataattgaaatgtaaattgtttttaacattttagctggaaagtaatggtgaaacagagaagtcaggggaaagggaagaacttgcaatttaatactttgaaccttagacagtttacttcaactctctgtgacttagctttcccatgttttaaatgaacacatgacagtatgcttgatctatcacctgtaattttaggaattaaacaggtaattcatgtaaaacactcagcatagtgcttggtacatattactcaatagatgttagttgcttttctaatcatgaacattattaatggttcagcttggacatggtaggtttgaggtgatattaatatttgtatcacagttcttaagggtatgatggtctgactgaaattcagaaaaatgaacccttagatcatatctaaagtgtccattctcagtaccatattttaagagttacattggccaggtgcggtggctcacacctgtaatcccagcactttgggaggctgaggagggcagatcatgaggtcaggagatcgagactatcctggccaacatggtgtaaccccgtctctactaaaaatacaaaacaaattaagtgggcgtggtggcgcacatctgtagtcccagctactcaggaggctgaggcaggagagttgcttgaacccgggaggcagaggctgcagtgaggctgagatcaccccactgcactccagcctgggcaacagagtgagactctgtctcaaaaaaaaaaaaaagttacactattattccaggtataacaagagaagtataaccactatgataataattcagactagagaagggttcctcaaccttggcaatattagcattctgggctaggaaaatgctgttggaagggcgacctatatattgtatgatatttaagtaacatcccactagatgcctgtcaagtgatgaaacccaaaaatgtctctagatacactgccagatatcgcctggagaacaaaaacattcctggttgagaaacactgtacttgaggcaatcctgcatacaagaaaacctgtatattctttaaatatataaagaagttttagcatacagcagactgattttgtttaacctagaaggcagacacagcactggttgataaaagttagaatattggccaggtgtggtggctcatgcctataatttcagcactttggaaggccgaggccggcagatcacctgaggtcatgagttcgagtgcagcctggccaacatggtgaaaccccatctctactaaaaatacaaaaaaattagctgaggtggtggcatgcacctgtaatcctagctactcaggaggctgaggtgggagaattgctgaaatctggaaggcagaggttgcagtgagccaagattgtgccactacacttcagcctgggtgacagagtgagactccatctcaaaaaaaaaatatatatatatatatataaatatatattttcaaaatttgaattaactagaaagagaatgcactaacttgtcagtcagcaacttctcagctacaatgagtatttaattaggtgctggatcactatcagagctgtactgggaatttccttcctgggagggacttgaaactaagaaatcttttatagccctttcaaggataagatgctctcattttgacaggtgtaaagatgcagatttggaaatcatttaaattgaggtcgtagttgaaatcaggaaaataactgagctttctctttgggggcaagagaaaagaagagcacaattgcatgaagtgaattttaaggaatatccgtaatttaaaagagggaatttggaatgtaacctatattcatttaacctatattaggttaggaagtattaaggaaaacaaaacaaaacaaaatgaaagaaagtattcaggagagagttttaaagaatgaatgattggtattgtcaattgagaagttaaagtctgataatagagaaagcaccagtttatacaatttctagaaaatcatggtgactttctgttgaaagcaaattctgagaaaagtgtcccctaaaatattgaatattacataaagggtgctatgttaaaaaatcacttgtatggttggaaaggttagtatcactgactttttaaaaaatagatttcctttgattctggaggcgggattagagaatggatatggaaacagagtgattatgggatggatagtgggcacacttagagctgccagcatatggaaaggaaaaaagtttgaggcttaagtagctggatttgtattttggtactacgacttagtccgtgtgggactataagcaattaacttcaaaatctctgaggactggattcctcttttctcaaataagaatagtatatactatcttgaaggatttctaagactaaatccaatcatcgatgtgacgtactagcacagcatctggaatgtgcgcagcactcaatggatagatgttaaaattgacattgttgttatcgttgtcattgaaggatattctaaggtcttctgcttcaaatgaggcataggcaaggagaaaaaatatattgaagacttgacaagagtggaaagtgtcaaaaattgccactgcttatgagtgacttaagtgatgaacacaatgattaaggatgagaaccaggtttttcttgtaatgtccagtgaccagcgaatttgtagtgtcccaggtctgttcacttctgggtcttctcatagcataatctatgaccacagagcaaagaaagggaaaataaacagtgatacagggttgagattgattaatgagattcatgtaaatctctgtcattttgagatttgtcaggcttgagttacttctaacaaagtaccctgcattatcatagtttattgcatatagtacctaatatattagaccacatgtatgaacattgtaactgacttatttcttaaagtaaacattagcatatgccagggtttctcagcctcggtactactgacattttgtattgctgatcctttgctgttggggacagtcttgtgcattgtagaattcttgcaacacccctgcactcctctcccagttctgacaaacaaaaatgtctctagacattgccaaatgattgccaaaagggttgggaaccaaaggttattttggttatttaatatgttcatacataaaggttatttaatatgttcatatataatatgttcagatgtaatttaatatgttcatatataaaggttatttaatatgttcatatataaaatagtgataaaaataatataaatgtacatgtgtgacgtttggatttataaaatttccatattttataactcataatagcaattctaaatagattttggttgtgatttctgttgcttcataagaccaatgtaattataaatttacattccttctgacagagaaaattctaaatattgaccataatctatagcaagaaatataaatattttttctacctgtacattttggttttgagagaacattttaagcattggaaatttatcatatttttgattgtttacctagacaaagttattacttatatatatatgtatttgagtctttcatgtactgttttttcattacatagttcaaataagttttgagcaaaaattatttgtgttttattttccagttgtttcctatccttattgctggtggctgctgtggtatggaagatcaaacaaacttgttgggcttctcgacggagagaggtatcagtaatattatttaatcttttgtttaaagatttaagcaaatatatggatctctattgtctgttaattaccatgctctcttggaatgcagaatttcaaatcatttttacatactaatattcaaaaatcactctagtattttttaagctgtagagcaaactttatcactgtaattttaagttagtatttgtaaaagcattggtttgttgcaaacagtttctaaaaatggtattggaatttatagtgaatacaattattatgtttaaaaaattttgtaatatatttaacaggcatttagttatgctataaagacatactttatttttcataagcgtctgttgaaatttaaaattctgagtgataaatatttatttttggtttttgaaaaatattttatctcctagaaatttattataacattctttttttgggaatcaaatcttttccattttctgattatctaataatccaactctgtttaaagagcacatccattggataaatttctgtattagaattatttttctcgtaatcctaaaattgatgaaaacaataatattcttacaaaataacaactgattatataaattgtgtatattcgttaatcgaaaggaacgaagaaacaaaatcatctgaggagcaaaagtatgcagtagatttattgttcatacctcatttattcaaaaaactagtttctgtttttatcagtattcttttattataatgtattctattgtattaatcttaatattttatttgctattgcatttctccatatatttctatatggatggtttttgtaacaatataaaacaacagtataattgcttaccttcttttttccacataaaaaatataatatttaaagacatgtaaaaataatccagagtgttctaagctatagaattagtgagtgatatgggttcttcttagtctatttttaagcacccatcaaagatcagtactatctataatatatttgcaaactggagtccctccctgtcttcaaataaatcattcatcttaatactctctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagcattacatgttaaaacatattttgaggaattttctgaaatttaattttactaaattcctttaaatgtaaaattctaaatgttatagaaactattcatatattgatgtccaaagtaaagatgacattgtctttgatgattattaaagatctgcaattagcaagtaattttaatattacaattgtccccccttatccatagtttcagttagtcaaagacaattgcagtccaaaactattaagatattttgagagaaagaaatggtgggggaggtgggaagtgacagagagagagagaccacattcacataaattttaggacagcatattattataattgttctatttcattattattgtggttaatctcttgctgtacctaatttataaattaaaatttatcattggtatgtatgtatagggaaaaacatagtatatatagggcttagtagtatccacagttttaggcatcctctgggtgtgttgaaacatatttaaaggggaactactgtgttaagaaattgtttttcattttggtcttaagagccctggagatttttaaccacactagttgtagttatgtgataattccatttatagactttatgtgagtggaggtaaaaatgtgtttatatctaatcctctctttattcagttttaaatattagattaactgtaatatttcccaaaggaaaagaacccactattatttctttatgtgaatgttactgtctcttcaaaacattgaagaaatcaattattgtaaagctcagaggacacctttgattagtaaaatgacagtttatctgttacagtaaatgaaagttacttaaaggattcttcttagaaattatgtagttttatttcagcagttatactagttgcttttctaaatgtaatgaaagtttaaaatgaaaataatctttggaaatgttttaatatattgtgttcattcaactagatgtgttactttttaaaccaaagttttgttttctcataaacatagatatactttttgtggcataattttaaattcagaggatagttagtcatgttatgacttttgaataacacccctgagaattcaggggctcttaaacacacattaaaaaaatgaaactacacacaaaaggcttcaattttgatatgaccccttcatacactaaccccaaacaaatttctgtggtgttaaaaagatgaaaactttcttttgggatgcgctaatgaatggaaacaataagtgtatattgataagtggaaatatttacactagaaagatgaattcatttatatagcttgtcctttttacagcggtattaaaaacatttagcttcaatggcacattcagttatagtcatcacattactgaaatatttgtcaggagcaagtatatgtaaaaaggagtctattgagctatttttatgcttgataatcttcattcttaatctgaaatttgaatattaataggtatcataaggcagaaaaatatgaagatattataattgttccctgcaatgaagatatttgatcatatatttggctatcgtgtgaaaatatgatgcatattttaatagttacaagaagttaatttttttccattttgagttgtttaaatgtagcatgtctctgtgaaactttaactgcaaaatctgtagaataatagatccataggcaaaggaagggttatttttacattaacttcatattactagtgagtctgagtatttgaataatctctacatttcatgtgatagcaatttttccatttttaattcttgtaaatttacagtttttttaagtttaaaaatattttaatgtagaactttaccacactactttttaatatttctcacatattacacttctcttctgcttcaaaatgaatacaggaaattttggaggataagacatgcccaatgagggattgaatttatgttcataataccctatctccctgcatattttgtaatcatgaagaataaaacttagatttgcattttttattatcaccctgaaatttgagttaaaaataataaaccaatacccacaagtagaattttagtagctttgagtaacaaactggttttccagaggcaaatacattagttctttccttctatacctgttttactggtacaaatccagacaaaagtaataatattaaactgtactttaataatgacattttatggtgtataaaccaattagttataaaatattctctgacgcagtgataaatagattctcatctaagtaatattaatgcaatgtagcagtgttttataaattaaactactcttttctccttagacactaaatatatttacagaaagaagattcggcacagaataaaaacattaaggaaaatgtgaaagtgttattttaggtggataaattcaaattaactgataaggtactgcctgcaaccttttgtagaatttcatagcacttcaaagttctgtattttgtaaatgtttaaacattttaacatatagataaagctttccattaaacacatgctttttaaaactcgttagtaaatatttcactcaaataaatgcctttgcagttaatggccacaatgtcaacttactgttgcttgtcatttgctttttattgaattgcaaactaaaatgattattattgtattaattttcttcctttatcctatgagactagaaattacaggtcttccgcatgcctattgcattatcatactttcaaaattttaacataaatttactttaaaataacttgagaagtcaaatatgtatgcagttaagatttgaaaaataactgatacttaccttgtaaacctgtttccaaagacttcatggtaaatatagtgctttcattttgctcagttcaacaaaggtgtatcaatttcttgctatattatagacaaattgataaatactgaggatataaagaaaaagatataggccccattattggggaatttgtagttttaaaacatttcaataaggcagacacacacacacacatacacgtgcaaagttcttaggggagcacctggatttactttattgtgatgtcatgcatagggagatagaatatatcgaaaagttttctggaagtcagattagtaatggaagtaaatgtgaactgtttcataattatacacaggattaatttcaaaaaaacccctaaacaaaaaaactttgggcactgtttttactgtatatacaatacaacaaatttgtctaaaatcactttttctttattatatgctattatctttatatttagacccagttacttagactaaaacattatattgatttattctaaaaaatgtagtctcgctaaccacaaaatcttatctgtattatatattcaaacgaatgtatatctcgatatatgtgtctgatgtttatgtgtgtatatgtgtttttatgctaaaaagttcattttttatctaaaatgcaaacttaaccaagtgttctgtattcttatttgctcaatctggcaaccctattttcaacacaaatgctcaccctggagctcaggggtgggttcaacctcataaaatccacaggaactcagagagaagtagaaaggaataattttctaaagttagaatcttgatttgttttcaaaataagggggagttatactgggcaagcaaaaataaaagatgtttactccgtatattatctatcaaaattaaaaactctttgactcaatggttagatttctgaaaatatatcttaaagatatatatctgcctagcttttcaaagtatactcatatatagacacttacagagagatttttgtatatcagaactatttcatatcattcaaaaagattcgagaaagaaattctgtgttcttacagtgggatattaggtaactgaaaaaaagaatgaggcatatttgtgttaatattaaattagtttattccttcaacaaatatttattgaacaactattgttgtttcaagcacatttttagacaaatacagcaatgaacaagccaaataaaatcccagccctcaaaaatgtttacagatcttaaaatctatattattaactggaaaatatatgacatagtttgtatgatgtttctatttgtataaatcacacatgcacaagcataatgtgcatggaaattgtgggtctgttggtatttgataaagaagattgactgtgttatttgataactataatataaacaaatagtcaaataatgggcaagttgagagaacatgatctaacattttaagttaggcacttaataaaaatagtatttaattttcacactaaaaatatatatatttgccctttacctatataaggaatttgtggagactagagtgcaatgctcaaagcttacaactagtaaaagaagaagctgtaacttaaaaccaagtctgtcagaccgaaccatacagagaactttagagatagcctgagtttgaacaagttggtttcataatggaccacttataatgtaacttatgcatctgtttgttgtactggaaatatgttatatttcatctgatattatgacacaatcattatttgatgtaccacttacgaagaaaacacagtacttattcaactattgcacaatgttcacttcccactcagaatatttattttctacttattgaaagagctcttatatgattatttagatataattttgtcatatgtcattcatatttatacagagaggaaaataaaagcaaaataaattgggtaaagttttgctacgacttattcaccttcatagtccaagtttttaaaaatcactttttgagttaagcaaaaatatattgtatgtttcacatagtatcattgactagaataatgaagtttatgtctgtgcagacaatgaaaactacatcacaactgtcatctggccagcagtgattatataatgtcattgattttaaaacacattagagtttagagatattaaaatgtgaaaaaatgtttcttagaatcaatcaaatatggtagaaccttctttataaggtgtttagtactaagcgaattaatgcatactaaggggttaccccactgcattttacctaacagacttcaataaatattagctgttattgatatgtaatataaagaatgatcagcattatacattaatattactaacaacaactcctgtatatcttggactcctcctccatttctactgtaatgcaatggttctcaatctagtaggcccttgagaatcacctgtggatctttaaaatgtgtgtgtgcgtgtgtgtatctgtgtgtatgtgtgtatttgcatgccattctactgttccatccccatcagatatacaaaatcagaatttctgtgagtgaggctcagccaagtgtgtttattattaaagccctcaaatgttctaatatgcactattggcctagaaacactgctttagcttctactctgacagagctgggaaactgtagaagggtttccaacaaacttgtaaagatatctgagttaaaaggatctgattttaagctgatcactgtgcttctgtgttcactccaagtaaaattggtttatggagaggagttaaatttttaatgttaagtttggtacatctactagacatctaattagatctatcgaagaggcaggagttgcatctggcatgaggaaacagagctgagtaggaagctaaatttgggaatctcagcacatagatggcatttgaaaccctgagcctagataaaattacccagagaggaggattaagccctgagacattcaaatttaagaagtcagagagaagacaagcacccagcatgaatactggaaagcagctaccaatgaaggtggagaaaaaccctgagcttctggaagccaaggaaacactgtataaaaaggaacagagttatcagttgtctaaaaaattctggtggttcaagtgaaataactgaaaattgaccattgtatttagccacttagaaatcattgctgaccccaacaacagcaattttagtggactgatggatgcaaaagtttgactgaagtttgatgagaaagaatggaacaagatgacttccagaatggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttagaaatttgctcaaattggccttaagttccctgtctgcagaccctattttcctgcctcaaacttatttaagaaaatctactaattctcagtaagaacagcaaatctatagcatttgagcctcaacttgctcccttcctacccccttctagctcactgtgactagcacttctcatccccccagctcccttttgcagatgctatattccagacaaaatcagctgaggcctgaggctctcttcttctaatgagccccacttgtatggcaagaagctcttctcaaggcatagcagcctgataataacagggacccagtctccctctctccaccttgcttatagggcagaaatttcatgactggcgagataatatgagaatataaaaaagtaacacctctgctcaacaccctgctcatgaagcaggaacattatttaagagagttatgggccactgtccccatcattagctctagagcttgcacaaactagcaaaatcaattcaaaaagataaaatctaaataaacctatagcaagcacagagattgcatttgttatttttaaatttccaattagatacatcaacattctgtttgcaacaagcacatctagcacccagatcttgttttctaatattagagaactctttccagtggttcctccattcctgacatactctcattcttggtgtttgtgtgtgtgtgtgtgtgtgtgtgtgtgtgcgcgcgcgcacgcacgcacatgcgcaacccttcttacgttttggtaccataagaaacttcaggtttagcttgtacacttcttgccccagtcctagaattagctatttctccaaggatctctggttccctttattttagcatacatattgcctagatcttgatttctaaataccattcaccaataaaaggagcttggatgcaaatcacatgagaatctcaatagatatagagaaagcatttgacaaagtccaacaaccttttaccataacaacacccaacaaattaggaatgaaaaggaaatcctcaacctgataaaaggcatctgccaataacccacatctggcatcatacttaactttttttaaatcacttatatcaggaacaagtcaaggatgtccactctctctaattctattcaacattttactgtatatagtagtcagagcagttaggcaaagaaatgacataagagccatctagattgggaagaaagaagtaaagctatctctatttgcaaataacatgttttgtaaataaaattctttagaaatccactaaaaaacctgttagaactaatacacaattttagcaaggttcaggatgccagagcaatataaaaatcagttgtatttctatacattagcaatgaaaaacctgaaagtaaaactaaaaacgaattcaattcaaaatagcatcaataagaataaaatacacaggaacaaacttaacaaaagcagtagaaaacatatgctatgtgtattagtccatattcacactgctaataaagacatacccaagactgggtaatttgtaaagaaaagaggcttaattgactctcagttccacatggctggggaggcctcacaatcatggcagaaggtgaatgaaacttattcactatcatgagaacagtatgggagagaccctccccatgattcagttaccttccactgggtccctgctatgacaggtgggaattatgggagctacaatgcaagatgagatttgggtggggacacagcaaaaccatatcactctgaaaactataaaacattgttgaaagaaattaaagaagacctaaataaatggaaagatactatatgttgatggattcaaagactttatgttgttaagatgacagtactcccaaacttatctacaaattcaacatgatacttatccaaatactaggtagtttatttgtagaaattgacaagtagatcctaaaatccacagggagaggcaaagggccctaaacagcaaaaacattcttgaaaaagaacaaagcttacacttcataaattcaaacttactatgcaagtatagtaatcaagatggtgtgatatggacataagactggacatttggatccatagaatgtaactgagaatctagaaataaactcttacatttatagttgattgatttttacaagggtaccaagacaattaaatggaagaaagattcatctttgcaacaaatggggctaggcaactgggtagccacaagcaaaagagtgaagttggacccattactcgtatcaccatacacaaataaagtcaataggaatcgatacaccaatatgtgacacctaaactataaaactcttagaagaaaatacagaagaaaatcttcttgatctttcagaatcttcttagacatgacatcaaaagaaaaggtgattaaagaaaaaaaaattggaattcattgaaattaaaaacttttgtgcttaaaagacaccatgaagaaaatgaaaatacaacctccagaatgggagaacacttttgcatatcatatatctgataagatatttgtatctacatatgcaaaggactcttccaagtcagtaatcaaaaggcaaattacccacttaaaaatgtataaagaatttgagtaggcatttctccatataatatatgcagtttgccctttgtattcatggtttccacatctgtggattcactcaaggattgaaaatattctgaaaaaatgttgaaaaatataacaataaatataaataaaaatacattataacaactatttacataacatttgcattgtattgggcactataagtaatctagaaatgatataaatgggaaaatgtgcataggttatatgccactatgacaccatttttaaacaatttacttgagcatctctggattttggtatccttgcggggatcctggaaccaatctcctgcagataccgagggacaactctgtgtgtgtgtgtgtgtgtgggtgtgtgtgtgtgggtgtgtgtgtgtgtgtgtgtttgtgtggtcagtaactcatgaaaatgaaaagatgctcaacaatgttagcattagcagaaatagaaatcaaacctacaataagataccactaaatgcttgtgatcgataataatgttattattattcaccaataatcatcaccaattatcaccaaaatgttggtgaggctgtggagaaattagattcctcacacattgttgttgaatatttaaaactgacactttgtagtgtaatacactctgacaattccttgcaatattaatgtttccatatgacccagcaattccactcttaggtgaatactgaagaaaaatgaaaacgtaggtctatataaaacttttacgttaatgtttatagcaccattattcattacagctttaaagtagaaatatcccaaatgcctaacaactgatgaatggacaaataaaaggtgatatatgtgtaaatggaatattattctacattaaaaaggaatgaagtactgatgcatgttataacaaagaaagatccttgaaaacattaggcaaatctaaagagacagtaagtaaattcacggttgccttgtgctgtgcttgggtatttgatggaatgtggggccagatggagaatgattgttaatgggtacatgggttctttctgggatgatgaaaatgttttaaaattagactgtggtaattgttgtacagctttatgaaaaatttaaatattattgaatcttatgctctaaatgggtgatttacaaatttctttgtagaaattgacaagcttctttgttgaaatggtttggctgtgtcccacccaaatttcatcttgaattgtagttcccataattcccccatgtcatgggagggacaagatagagataattgaatcatgagggccgtttcccccatcctgttctcatgatagtgagttagttctcttgagatcagatggttttataaggggattcccccttcactgggcactcattctctctcctgtccccatgtgaataaggatgtgttcagttccccttctgccatgattgtaagtttgctgagtcctcccagccatgctgacctgtgagtcaattaagccgctttaccagtctcaagtatgtcttgcacaaattgggcttaagttcataaccagtgtgagaatgggctaatacatttctagaaattgacaagtagattcaaaaacttacatggaaatgcaaaggaccctaaatagcagaaacatttttgaaaaagaacaaatttacagttcctgaattcaaacttactacaaaactatggtaatcaagatggtgttattatactacacagtatatttcttagttcttttgtgttgctatgaaagaacatacctgaggctgggtgatttataaaggaagaaggtttatttgcctcatggttccacaggctgtacaagaagcatgggaccagtatctgcttctggtgagcgcctgttaaagcaacagtgtaagattctttatattgcataaattactgtggaatgatagtaatatagtttccctgaattttgttgacaggatttgacatgttaaaagttgagtttgcaggtgataatgctacctgcattccatattaacttcattcatcattctgtaaattgttgcttaaaatatagaatttccttcatttaaagaattatgccataatttgcacatccgtgctgagcaattctcttcctaccaccacccacctccccttacaggggaatttgtttgctaggtatatactgttaacaggcatttatatacagatttaaacctaatacagaattcagcagtatgtattttatatataaagtttcttctcatgagcttttaaaatatattctactggttctaatttaaggaaaaaaaagctttaaacaaaataattttattgtgatttgaacatagttataatgctttattaattttctgaaaataaatttagtcatttaacaatacatagttgtcttagtaactattttgtattttatctcagaataaaaatatgtttgcaataatagcatcctgaataattggctttcacaataattcaaccacattgtaaggaacatggaaataggtaatatattgaatgacagatattgtgcatactccatcactagcagtggttcactataacagtgattctcaaccaaagaggatatcttaaaataatataattagaaaaaaaggcctagtctggttgattttgatatcctcattagataagtaattctgttctcctcatgtccaagaatcacatctgtactggaaatcatgctgaactggtgttcgacctgtactgtccttatctataaattacagggtattcctgctgcatagtatatttatttatttttaaattattttgatgccagcataattatggtctaatttagtttattgtcattcactgaaatgattcatgtactttaattgtgatatttaggtaaaccattattagagtatattgaatgaacatggtattagattcatgcatgaatgtaatattgaaaatgttaactattatagtatattaattatttccagtctgaaatccactgttactatattgtaacaattatgaagcattgtaaccagtactttgaacaagggcagtcaatcaaagcttgattctgtattcccacagcccattcaaactcattttctgtggccaatttgttctagttccttgagtagctagaattgaagataatttttttcttatatctctttttaatagatgtatgtttttcctttccttggcaatttggtattataaaattttattctattaatggaagagatttttagaagtcatctcctctttattggaaataaacatggaaagtttgctatcaaatcaagcattatttttataccttgtacatgttttcatatctatttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctattcatgctgaagtagtgacattgtgaactccaatgacatctataattggtaaattatctttgactttcagaaaacacataattgtttaaacaattctatacgatagctatagttttctttttttcattcttttttttattattattggagatggtgtcttgctgtatggcccaggctggtcttgaacacctaggcttaggcagtccttctacctcagcttcccaaattgttgggattacaggtgtgagtcattgcacctgggcaagagctgtagttttctaatcaaagtgcaagaaatatgctattcttagaagctggttttgtgttatatcatttaacatgaaacacgtatctcctgtagatgtggacaatttattattactttcagaatagttatttgcctaacagaagagctaacataaattaagcagtaaatcagttttgcttcctttagataattagtaatttacatataacctttggctattcttttatcttaggttattgatataagttgcataaaattgttttctatgtagaatgttctttgaaatgcaaaatctaattaaaatgcactattttaggacagttgagttgctaaatgatattacggagactattatgaatattttaggaatctgagtggagtatgtaagaaagctaaattataacctctatggactactttaggttactttatcagtcggctgaaacaaggaaaactgcccaggtacttagattattggatttttttacatatactatatttagaaataatgcaattatgactgtattatgatacctagacagtttcacattaagttacacattaatgtttgcaagatacactaaggttagtaaaggaggctaattgtggctgtagttattctgcccaggggctttcacatgcaccccaggaggctgctcaaaacaatgagtatcaacacatttataatcacttaatggcatacttattgatgaatcatattccaattactaacaaccgaaattcagttttgtggaaggcatggtaaatgatatacctgtttgtccagccaggacaaacaatgagtatttgtcaagagcctcctgtttgcttaacaaacattgtttagcaaggacccaatactgggtaaacaactgttgcatttagttttcaaactgaacatttcttaattttatagtgaagattgagtgtagaatcttatggtagctgtgaaatggtatgtagctaggtgattattatctagaatcttaatgtattaaatcacagtttagtgacgttaatattttacaaattaaagataatgcttttttagactgctgtccttcttttcctttaatatgtgtggtaaagtgaactactgtgttttaattactctttgatgtgtattgggataagtttttctaaatgaaaacatatctcattttgtcctgaagattaattcaaaattagagtttgcctaatgaaaacttttccatttaattttgcagatctattttatgcagaaatttatatcaattaaaagtacatatcacatgatttagccagggatggcatgcatgctagcaacctattaaaagatgaagaattgttaagattcatttcacttttgctgtctttgttgatagttttagtcttttactccaaaattttaatcatatactgattcaaattctatgttgatttgtaattttagaataatgcaggaactttttttaaattttgttaaaatgtacttattttgaatgtttcctaattagtgaattacctgctcattagtgaacaactaggaggtattttaatagcagttagtttaatgagaatggtgaaaaccaaatacattctccaaaaaatcttggcaaggagaataatgcataataagtaacagtcacaatgtctatgatctctttttgtttaacctttataaaacctgtatagttttgctacctgatgagtgaaatatttggtggtagcctgagtactgtcatcctttatctagttgttattctacttaatacgtctaattattgtgcttagaattacttattttttcttaatataaatgtttgttggatttcaaatgaaggtgactttgatgctgaaagctgacagttaatggtaacagtggaataacgttttatgaatgtaggtacgtagaatcatgcctggcagaagctattgtcatacatagtaagtggccagtgctcttttgttcaggctattaaatcatagtgatatgtgttatttcagctagaggaaaaagagaagtccttactcaatattgaaattcacaagatacagaataaattataattggtttcatcttttttatgttaaaaatttaatatttaaagttaatttaattatctgaatacaggaatgctaaacaatttaagtatatccattgaaaagaggatgcccaattactaaagctatgttctttttgctttattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacattattttcctaccaactgcatgaagagtgttttgtcaaactttggatttttgctacctgctaagtgggaaatgatgttttaaagtggttctgatttgcacatcttgaagaaaagcaaagccaaaaatattatccagtgttcaagggtggtattttctttttctgcaaactattcatgtcctttactcatttttcaattagattgttaatctttttattctttatttctagaagctctttaaccttgagtaggataactgtttgtctctggtatgagttgaaaatattttttctctgtttaccatttaattctttaaatactttttttttttttttaacaatgtattactctgttaaagctgctgtaacaaaataccataaactgggtggcttataagaaacagaagtatatctcatacagctctggaggctgggacgtctaagatctaggcatcagcagatttggtgtctggcgaggggctatttcctgattcatagatggcaccatacagctgtatcttcacatggtgaaaggagctagctagctttctgctggagtgcagtggtgcgatctcagctcactgcaacctctgcctcccatgttcaagcaattcttctgcctcagcctcctgagtagctgggattacaggtgcacaccaccatgcccagctaatttttgtatttttttagtagagatggggttttgccatgttggccaggctgatctcaaactcctgaccttgtgctccaccagccgtggcttcccaaagtgctgggatttcagctatgagccaccacacctggcctctgccatctcttttattaaagcactaattccaatcatgagggctctgccctcataatctaaacacctccccaaagaccccacctcccaacaccatcaccctgggggttaagatttcagcatatgaaattttgaagtttacaaactttctgaccatagcaaacatgaagatatatttatgcttgatttcaaattttgtaaacttcttttatggtttctggaatttgagtcataggtagaaagactcagcttacttcaagtttacaaaggagtttacccagttatggcttcatttttacattttgtgtatactattagcttggtcaccccccagtgacctcagtatccagattttcatgcccatctgtactctctgtattgactgtagatgggggctatgaatgctttgaccagtcaactgtggttggagtgatgtgttggtagttttatgtttagcccttaattatactgacagttgtttttcttccctctttggagcttactaatgagatgctcctttttggaatctagctatcatgtataaaggcatcctcagggagaggcctatatccagagagctgacactgctagagagtgacctcaactgagccctcagttaggactccacgtgagctctcatttgagccttcagttgatttcagacatcccgagcaacccaagcatagggtttattcataatttgagcagagctcagctgggatagcttatctctccccaacatggcaccggctgggccagcttcactggggatggagaatcttccacccccattaactaagagttcagcacaggctgttggctaaggacctcaattttcctccatatgggcctatccatatagccgctggcttttcttataccatggcaattgttttaataggaggcagcttctagtccttttatagactagacctataatttccacagtgtcacctgcacctgtattatattggcaaaatcagtataggaccaggtcagacataaacgtgtggaaaaatggattgtcctgctttttcatggaaggaaggagtgatgaagaatttctatctttgatctgccacacatttaaatatttgcttcaacttaccgttttccagatagctgttaggtcattccaacactatctattaatacattctttacccccatattttgagatgctgttattactgcatgttatattcccatatacttttgggctttctgttagcttctgttgaattacccatccagacactactactacattgttgtaagtattgagaccttccaatgtattttctctctagtaggctggctgcttctcattttttgcttgtgtaattttgttatgtattattttgctataactattttgctaaatagattttataaagggtttgtgactttctggagaaaatagcttggtatatttattgttagagttaaaattataaattaatttgcagctattacctttatgatattgaaccttctaattcatattcatatattcctattactattcctaataaactaatatttctattataaatgttatttataaaattataaaatattcctattcatataagacatatttctgtgtcttaccgtctgttctacttttgtgtctttagggaatttaaaaatgttttccttaagtaggttttgtatattctctttcaagtttatatacacacatagaaaaagccatgtattgtatgatgtttatatgaaatgtgaagaaaaagggaaatataaagagactacctagagatggatgttggaatgaagaattattgcaaatggacagaagtttggttttgggggtgatggaaatgttctaaaattagattgtgtaatgacagttatattactctaaatatattacaattcatttaattgtacattacagtaaattttactatatatatagtattgcagtaaaaatgttaaaagaaagtcatagctctggctacagtatggagaatggattataggggaacaagggaagaggtagggagaacaatttggagcccagggtataagagaaaatagttgtttggactacataggtggtaatagaggtggagagacagaggaaaatttaggatttgtttttgaggtcaaatatattgtcactgctgatagattggatgcaacgggtggggaaaaaaaaagactaattctcactctacaatctagggttttaccttcaaaaactaggtacatggtggtaccttaacctaaaccataagaactgggagagacaaaaatgtgagggaagttagacagcagtcaagagcatcacttgaggtaaagtttgcaatgcctaaaagagattcaagaggggaaggttcacatagcagttggacataaagacatttggatatacaagtctgagattccagagagaggtctgggattccagagagagttctgggctgaatctataagtttcctaattaataccataaaatttatattcaagatccaagtcttgattaatgttaaatactgtttgtcaggggttgtttttgaaatgggagagttccctgattccccttgcaggacatatgattggggtgtggcttgcctgtttggttgccctgcagctcaaactgcttgagggagggggagcatgcagacgggcagatgcagaggccaggtgagcgctttgggctccaactccactgtagtgtctaggggtgagtgtctgcaaccccagttttgcaaagctctttcagctttgccttccgcagaaggcttgagtgttaatcagtttaatggaccttctgccttattgcaagggtaaagaaccagtgtgacagatttctgtatcctaagctcttgccaggcatcttggaagaattggatcacatgtgggctcaaagggtgagtgcaaggttttattgagtggtagaggtggctctcagtgatacggatggggagccggaagcagggatggagtgggaaggtgatcttcgtctggagttgggccacctagtggccggactctttcctgacttcccccagccaaattcttctcagtgttcagatgtccctcttcttctctctttctcccctacattgttccattgtctgtctgcttgcctcctcatcaatgtcctcacttgctggtctgctctggagcttggggttcagggtttacatgggggcaggatgggggcatggctgggggtaggatagggagtgtggcaggccaaaaggcagctttggggcacaaaaacagaaatacctgttctcatttagggccacaggtatccaggcttgagggtggggtctttgccggggaaccgccctcttctacccagtatttccctgtctcctgtctgtgttattttcagagcagaagtctcagtgtccttgggaatgttacaactcagtgagcaagataaataggtaacacaaagtgttaaattccaataccaggtgaaggcagatggttagaatagccttcaccaaataggtgccatttgagctatcaagaatatgtagccctttgcttgatagataaattggttaggatgttattaaaagtcagtatgggcacagagaaggtccttggaaaatactagcagttatgacagtaccattgctttcaaaatactgaataatcaaatgccaggtatgtaattaagaaaagagttgaaagacaaagctgaaaagatacttctgtgtccgattgtaggagaacctgtgacagacaggaaagaaatgggtaatctaaacttctgtaaaccacttaaagcagaaaattctttgggaagtagttatctcaattatttcttgcaaaatcatgattctgtttgtcttacttacgataaaaagcaaactagcaaactacagctgcagttttatatgtataagtacagccattatatataattgtatatataatacatatatatgtgtatctatatatacaaatataactacagcaatatatataactacagttatatatacataactacatatgtacatgtatatatctataactatgcagatatatatatctacatatgtacaagtagttttgtatatataaaactacatatatataaatgtatatatatatacacacatgaagcatgaatgaaactctttgagaaaaaagcctatagttgccaatgctattccactaaaactaattccttcaaatttacttcacttgtttttaggaacttatatcaaaagacagtaactagtatatcattatcaaaaatatttaatatcaaatctaccatgtatcttaatcttttatattttctgcaacttgtactgaatatttggctgaaattccttgctaaatgtgttaccatctacttcaatctcaatcacatttaaatcctatgttacttgggcaccagatgctccttagttgatttctgcatgctgatttcaggagccctagaaattctctggccattgctgataccaaagccagttaaggtttgctcagccctgttattgactaccaatttcctacacatagggtgctggcacaagactttccatctgtctgcctttttaattttaaacatagcctattttctttgtaaaatattagaaacatctcttaaacaaaattgctaatagacaaatgtaaatcatttggaaatggctataacttgtggaaattggttgagataatatttcaaaacaggttattgcattttaggtctgactcttaatgtgaataatatgatgtaactaaacttatagatattttaaaatagaatcttagtaaacattgttgctttttccttgcaccttttaaactcattgttatagtggaaagtgcttaaacactgtttatcccaagaatttataaaatatattattttaaaatatcagattttaaaaatgatttaagtagagcatgtgatatatattcatcttttaccacttaatgttgagttttagaaaatatgtgttgttaatggaccatcgactttcaagtcattttgtttactaagcttgaactgagatttgagcaattatgtgtgtagtaaaacctttaaaacagaatgcattgcattaaagaatgttcatgttcatttgcaatgaagcagagaatagtgtcagaactctgccctaactaggattaagttgagaagtaaactctgtatactttcttgcatttattatctgaatgtctgaaattttagtgttgttgacatctggagtgtttttcaacatgttttataatgtgttttactttcatttcattgttcatcacgtagtcatttgccgttcctgttagtgttttccaagtgttagaaacctttttctttctgcatgctaatgtcacctacttgccacaattgcatttttgcaaatattcttttttattttttatttatttttcattgcatgtgtttaaggtgtgcaagataatgttttgatatacatatacatagtgaaatgattattataagtaagctcttacctttttttgtggtaagagcacctgaaatctactctcttagcaaattttcaatatacaatacagtatttttagctatatccttctgctatacatcagatctctataattagtcatcctacctaacttcaagtttgtactttgatgaatatctctccttttgctctgcctctctgcccttgaaaaccactgttattctccctatttgtatgtatttgaacttgttttaggtatcacatatagatgagatcatgcagtacttttctttgtgtctggttcatttcacacagcataatatcctcctggctcatctatgttgccacaaatgccagtatctctttttttaagagtaaatatattccatggtatatacaccacaatttctttatccattcatgcgttgatggacacctgagttgtttccatatcctggctattgtggataatgctgcagtgaacatggatcacagctagctctgtgatgtgctgatttcgtttcctttggatgtacgtatacaaagcagagagatttctgagccataggataattctttttttcattttttgaggaatctcaatactgttttcaataatagccatgccaatttatgtttcaattaatagtgtacagggttcacttttctccaaatctttgccaacattttttatctcttttttgtaatagccatcataacatgtgtcaggtgatatctcattatggttttgatttgcatttccctgatgattagtgttgttgagcacttttccatatatccgttagccatttgtatgtcttatttggagaaatgtctatttacattctttcccctttttaaaattaggttatttgctattttactattgagctgtatgaatctcttacatgttttggatatgaaccccttacacgtacatggtttgcaaacgttttctcccaatccattaactgcccttttcttttgttgattgtttattttgctatgcggaagtaacttaatatgatatagtctcatttcttaattttggttttgttgcctgagcttttgctgtgatacccaaaaaaattatttcccaggtttatatcagagagcttttccttatattttcatctaagagtttttcagtttgaggtcttgtgtttaggtctttaattcattttaagttgatctttgtgaatggtgtaagataatgggcattttcatttcttttcatgttgacattcagttttcccaccaccatttatggaagagactatccattccctattgtgtcctcttggtggccttgtggaaaataacttactatatgtgcttgagtttatttctgaagctctcttttcggttctattggtctatgtgttttaatgccagtatcataatatttaattactctggttttgtaatataatttgaaatcagaaagtgatatgtttccaactttgtttttctttctgaagattgttgtggctatttagagtcttgtggttctattcaaattttaatattgttttttctatttctatgaaaaatatctttggaattttaatagggattatgttgaatctgcagagctctttgggtagtatggatagtttgacagtattaattcttcaatccattaacacagaactttccatttatttgtgccttcttcagtttctttaatcaatattttatagtttttattgctcagatattttactttcttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtactatcagtactatgtttaacagaagcagagagagtagaaatccttacattgtaccatatattagaggcaaagctttcagttttttcccattgattatgatattggttttgggcttttcataaatgacctttattatgttcaagaaatttccttctgtacctgtttctttaatattaaaaaaaatcatgaacagatactgaactttgtcaaatgcttttactgtatctttgacttgatcctgtggtttttatctttcatccttttaatgtgttgtgtcacatatattgatttgtgtatgttaaagcaaacttgcttcccaagaataaatttcacttagtcatggtgaataatctttttgttgtgttgttgtatttagtttgcgagttttttgttgaagatgtttgcatgtatgtttagcagcaatattggcccatagttttcttttctcgtgatgtctctgtcagctttgatgtcagggtgatactagcttcataagatgagtttggaagtattccctctattttcattttttggaggtgtttaagaattacggatattaattcttcttttaataatttgcagaattctgctgtaaattcatctgatcctaggcttttgttgctgttaggaggattttgattaccacttcaatcactttttctgtcattggtcttttcaggctatttcttctctgttcagtctttatatgttgcatgtttccaggaatttatttcctctagattatccaatttcttggcatgtaattgttcataatattctttatgatccttttttatttctgaggtatcccttataatgtttcctctttcatatctaattttaatgtcatcttctctctttcttcttctagctaagggtttattggttttgtttatattttcaaaaaaattttagttttgttaatatttcctatagtttttctcttttctgtttgattcctatgctggtctttattagtttcttcattctgctaatttttgattcagtttgttctttttctagtttcttgaggtgaggtatgttgtttgagatctttcttctgttttaatgtagacatttttcactttaagctttcttgttagattgcttttgctgcatcctataagttttcttacgttgtatttccattttcatttctctcaagatagtttttgatttttttcttgatctcatttccaaagcatttggtttcattttcacatatttgtgaactttcccatttttctactcttattgatttctattttcataccattgttgtcagaaaagattcttgatatgattttgatcttcttaaatttgttaagaattgttttgtggtctaacgtgatctatcctagagactattacatgtgcacttaagaggaatgtgtattctattactgttgaatagaatgttctatatatgttgattaggtctaaggtacagcttaaatttaatgttcctttattgaattttcatctggatgatctatccattattgaaagtgtagtatcaaagttctctatcattattgctgtctatttctctctttagttgttaatgtttgctttatatgtttatattctctgatctaagatgcatatatatgtataattattatgtcgtcttgatagaataatctctttctcattatgttgaccttctaaaattatattgactttctgtgattatcgttgaccttctttgtcacttgttacagtttgtgacttagaacctattgtcagatattagcttagcttccctgctttcttttggtttccatttgcatgaaatgtctttttccatcccttcactttcagccaatgtgtgttcttgaatcaaaagtgagtatcttatagatgaatatagttgaatcttggatttttaaaattcatttagccagcctatatctttttattgggtagcttaaaccatttatatttaaagtgataattaacaaagaatgagttactattgccattttgttaactgttttctttttgtgttgtggttcttttgttcctctttttcttgcttcctgcctcttttttattgtttgtattgctagattttaattgctgttcctttttcttttgtgtaacttgtataggtattttctttgtggttatcaaggggcttaaatatctaatagttataacagtctctgcttagctgataacagcttaacttcacttgcatgccagaattcactgcttttacctttcctctcctcacattatacactgctgatgtcacaatttacaacttcttatattgcagaaccattcacacaatttagttatagttgtatttgaaacttttctcttttaccttttatagcaaattaccatgtatctatctaccactcttacagtaatacaatattctttctgttcctatatgtttacctttgctaatgagtttcatacttggtgttcattcatgttgctgtttggcatcctgctgtttcaacttcagtgacttcctacagcatttctcataagaaatgtctagtggtgataaacttcctcagcttttgtatgtctgtagaagtctttatcttccctttgtttttgaaaggctggtttgctgggtatagatggcaatttgtttcttttagcattttgaatatatttttctgcccccttctggcctgtaatgtttctactgaaaaatcaactgatagtctgatggcatttcctgagtaacaagcctttttttctcactgctttcaaaattctctcggtctttaacttttgtcaaatcaattacaatgtgtttcagtgtggaactctttggattcatattatttgatgtacctgaggtttgctgaatctggatttctgttttctttcccaggtttggaaagtgttcagccattatttctttaaatactctttttgtccctttttcttttttttctctttctcatcctcctataatgtatgtaattgttacccataagtcccataaagctgtcttcagtctttttcattattttttctacttagattaatttctaatgacctgtcttcagttttgctgatcaatagagtcctctattgattttttcaattcagtcattgtaatcttcaactctatgatttctgtttgatgcattttaatattttctatcattttgttgaaattctcagcttgtcatgcattgtttccctgaccgtggtgtgaacacccatatgactgtttctttgaattttctcttgggtaaatcacacagctttatttcactaaggctggtttctggagatttatcttggttttttattcggagcatatttctttgtttcctgacttttattgacactctgtgttggtttctgcacagtctgtaagacaactgtctctccctgtgttatcagactagtgtcttttaagaaatgtacctcactaatcaattcagcaagagattctaggtgccccaacttttatgcttatcttaatctcttttttttcagtgatccccaattagtatgtgccaagttttgtcagtgccccaagacagacaagatagaagccagtcccttgagatgcatctggaaaatttggcatgttagatatgtattgtcagggagaagctgaggatgggagtttacctcttactcaatctgcactaagccaggaagaggatctgtgggaaattcctgcactctcatttgaactacacactctgatctagatgcatagttattggaagtgcacccattcaaaaatcacatgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaaattgagtattaacgaaagattactctgttagtcttccacaagaaagatcaggagcccatcatggttagtaccagttttgtcagacagttccattgatgagaggccatcttcattgctcttctttattattttctgtgtaaaaccgaattctatctgacacagctttgtgttggttgtctgtaagttagctttaatatagcagtttgctttagcattgtcagattcacaatgtaaaatatactgtggcaaaataatacaatgttgtgttagttaaattaaaagcattgactcctccagccttaagaataaatctgaattgtagagcctgatcgttaaaagataatgatcatatactgccataggccacagaaatttaaaaggtcttagtgcttctttcagatagagatgcagagactaatttgaaatgaatacatagcctaacaagatgagtaggtttatttaagcacatgactgacttttgttcttcatgttgaagaggcttgaatctttagtgtcaccctgtttttaataatgatcttaaaagttcttttctttggcagtttgctttctttctgtgtattaacctttggttgtctaattattgtttcctttggtacatatttaatattttctgcttgtgctctttattatttgtgttctagatccattgcttgcccagtaagtaaatacatgaagaaaatatactaatactgtggagtagaggaagggaagaggaatatttatgaatattaatgaatattaataaaatctactacagtctattttatcatacatacttcccttccttttgtatataaaatatagtcacttcccacctgcctcctccaggaagaaactcaaaagtctcatctaattgtctaatcttaatagccttgaagtaaaaatgcaaattatctggctccccactcaccacattcaacattcaatgaggaaacagaacaagataatcataataaacacttccattgcaaatagaaagatggacacatatagtagtccctgaatactagcatttctgaactcctgttgatcagaggtttcaccatccctcttcctgtgtgagtggcaaatctttgctgaggttttctgggaacaactccctagttattgttcatgactcttggctctggcctctggcaaatccttctgtttcaatgatctcacttcgttatatctgaacagggcatttgagaatccgtcttttttggatctgagcactgagtctgaaactatgaaaggttctaggtaccactgtactagcacgtacaagatatgcatgtatacgtgtatatattaatacatacgtgtatacacactaacatgtgagtacacatacacaaaaatgcacacacacatagtagcaatatcttgagatctctggtttggagatagactctttactcacatagtaacctgtgtcacttccctatacctcaatttcccacaagataacatagtatcagatatatcctgcacagaaaatggggtttatgacacaggagagttactccaaaattatgaatcttggggcttatatagggtaattggcacatgtggcccttctgccctctggagactagagagggaagcttctctagaatgtaagcaaatcctctcggagaagatggagaggtctctacttcaccactctggaatgtaaataaaactctctgagggagatgtccataaattttcttggaaatttctatctttatcatacaagacttatttgatattcaatcatttttaacccatgttacttggaatttttgttcaggaagctctgaccatgcagaaacatgaaatattcgtggagcattgtctcctgacattgtgtagctttctcaacctttcttctacctataactttggtccaaagaaggtccaaaacgcgtatatactttggtgggaatctcacttatttcagccacatggaaagcagctgattactcaaagaacttacaactaccatttgatgattgggtatatatcccattactgcacatgtatccaaaagaaaataaattgttctaccaaaaagacacgtgcactcttattttcatcacagtactattcacaatagcaaagacatggtgtcaacctaggtgcccattgaaattggagtagttaaagaaaatgtagtacatgtacaacatggaatactatgcagccataaaagagaaaaaatcatgccctgtgcagcagcatgtatgtagctggtggccattttcctaagctaattagcacaggaacagaaaacaaatactggatggtctcacttctaagtgggagctaaacatttgatacacaaggtcgtaaagatggcaacggtaggtactggggactactaggggtggagtgagggatggagaggcaggatttgaaaaactattgggtactgtgctcactacctggatgatgggatcagtataccccaaaccttagcattgtgcaatatacccatataacaatcctgcacgtgtacctcctgtagagatctaaaagttgaaacaaacaagagatcgccagtgatggtgtttcttgaaatataattcatacaccatacattttatccatttagtgtatgattcagcagcttttactatagtcacaaaattctacaactctacaactgtcactccagttttagaacattttcatcatcctaaaaagaaacaacataaccattagcagacccacgcagctctaccttactccaccccgctaagtcctaggtagccacctctactttttgcctccatgagtttgcctattctggacatttcatgtaagtgaactcatataatatgtggtcctttatgactagcgtcattcacttggtgtaatattttcaacattcatccatgtacattttattgccaaataatactagaaatcatctgttttatttctctagcaatcagtttctatttatccaggatggtggcacttttaacagcagagcttcctcaaaacataattgcttttgttgttgaaactctatatatttgattatagtcagctacatgtgcctacttacaattctttttagggaatgtcagttcctgattctctgtttctctctgtccctctttcttatctaactatctgtctgtctgtctatctgtctatctatctatctatctagcttagtccattttgtgtcactataaccacagactgggtaatttgtaatgagtagaaatgtatttcttagagttctggagcctgaaaagttcaaggttgaggggcatgcatctagcaagggctttattgctgcatcatcccatggcagaaggcagaagggcaaaagaatgcaagagtaagggagccagaaggggctgaacttccttttataataagcccattctcatggcaactagcccactcccttgatatgaacatcaatccatttatggggtcagggacctcatgacgtaatcaccacaaaagatgctaaatagccaaagcaatcttgagcaaaaagagcaaagccgaggtatctcacatcctaatcccaaaatctatacaaaactacaataattaaaacagcatggtattggcacaaaagcagaaatatagaccaatggaacagaataaagatcccagaagtaaatctgcacatttatggctaactgatctttggcaaaggtgacaagaacacacaatgggggaaaggacagtctcttcactagttgatgctgagaaaactgtatgcccacatggagaagaatgaaactggactcttattttatcactttaccacaaatgcctacacttatatgtatgtacctcataatacattgttgagatcattgtatgtgtggaaattatagtatttttccaattaaaactatatcataaacattctcaatacatctctattttaatgatataattgaacaattgtatctaaaatttgcattgaaacaaaattggtgtagacacttccttgtaataattctgagatggttgtcaaatgggtagttttgttgtttaaattaaaattttgcttacacttattatcattatcctgttttaaaatgaaaatttaattatcttattttttctacaggtagtatacaattattttcttccaaatatatatactttatttaatctatttaaatgacccaagagagatgggttttcataccttgctagaaaataaactctaaaacatattattaggtcagtaagatttcagatatctttatatttgatctatttatatcagctgtgacataattcatatttcttttattgattcagaagaaataaaactatactttcgtatacctatgagtgatttagaattcttcttggaagagggagaaacacttagttattctttgatatccaaaagcaatagtacttcaagattctaagtactataatctatacatatatatgcatgatatcatatgtgaattctatattataaatacttaatattttatatttctcacatattacagattgtataattgatgtgtttttaagccaaaatttagcagattttatgagcttttcttttttaatctgggaaatttcatctttgctttaataaacttgctcaaggactcagaatttgagttaggtatagtgtgactatgggtgggtcttaatttgcatatcctaatgaggaactgtaggataagaaaataattcttcactaatacttgttttttgttttgttttgttttgagactgtgtctcactctttcacccaggctggagtgcagtggcgcgatcgtggctcaccgcaatctccgccttcagggttcaagtgattcttctgtatcagcctaccaagtagctgggattacagacatacacaactacctgcttaatttttgtgtttttaatggagatgaggtttcctcatgttggccaggctggtcttaaactcctgacttcaagtgatccacctgcctcagcctcccaaagtggtggaattacagatgtgagccaccatgccaggccagtaacattatttccactaaattctctaggtctctaaagagatcagcaggtggtttgtggctccaagtcaaacagagcttttagaggtacatgacatccttcttgagccttcttttcaagtctctagtcataagtttttcattagataaacattctattgaggtgtaatttgcatacagaacagtaaacaaatcagaaatatgtagcttgatgaattttcacagaatggacacttctgtgtaaccatcatccataaacattcatgtaaatcaatagaaacttgctggcaccacagaagatccactaagtctcctcccaatcacaggcctgtccaaaatgatagctgttctggcattttaattaaagtcatctatgggttactttgggtgtttgaatttttttctttccttcctcccttcctttcttccttcatattcttccttccttcccttttttcttacttctttttagctttaaaaggggtcaagtgtgagacactgatataatctatataaaattacgagttttcaactggaaaatatcaagcacacatgaattatatttctgctttgagtgtagactgccatgagatttgtaatattatatattaactagtgaaaatagttattaaaagctgttgtgctttcactttgaatttggtaatttattttccatttacatttttctgttaatatgttaaatttattaaggcagtagttaagagcttaattgttgtgcaaaaagaaaaacagggattttcatttccttgtttgctcttttattacactcccacttacttggagtggctggatctatttattatcttttccttttaagatctgagtgcacaataatatttgattcatttgagtctttttatacatgaaaatagcaatatggcagttgctcagttttttatatttatgactcagtattttatggattgattattattcacttgaaatgttacaatttggtctcaatttgaaaaggttagaattaattataatgaagcattagcgattaatcattagaacttaaaatcaaaatgtcagtatatttattgtgaaattgcttgaattggctgagaatttcactaatatatcagacaatcaccagtcctaactacttcatctcaagtcaaaagataacagcttttaaaggtttgttccaagttttcatctctgtggttttgtaactagaaaacaggtatgagctatagtaagtgttattcgtaaaagttacataatggtttgtatgtatattgtgttggtgttcggaaatgtgacgcccaaattatgtcattattcttttttttgagactgagttttgctcttgtcacccaagcagcagcgcaatgacatgatcttggctcactgcaacctccgcctcctgggttcaagcgattctcctgcctcagcctcctgagtagctgggattacaggcacctgccaccacacccagctaatttttgtacttttagtagatgcagggtttcaccatgttgtcaaggctggtcttgagctcccaacctcaagggatccacctgccttggcctcccaaagtgctgggattacaggcatgagccaccacgcccggcccgtcattattctcatttgaatcagttggtataaattatcatttaaataaatatatgactacatacaattttcaacttatggtaaacacaatgacattcatggattatcatgaagaagttaaagtagtcacaaatggaaaggaagatctttgtgcttttatcttagcaatttcacctgacatcttacagtagggaaaatgggcaaatgtcagtgagctgaagggcgtgtttagttggaactggctaaaaggtagagctaggacagtattggaaacccgtgacagtgagagtaattgacatttaacatgatagactatgggaagtttgtatgtagaaatatactttgttaagccttaaggtaatatgagagtattacttattgttataaatccatttatttttaagaatattagtttaagaatattattattcataaatgtgagacatcaatctttatcaaataggactagttattggtatcctaaaatcaagtgaaatttattgttactacaataattgatttataatgttacatttatttcctatttattttggttgccaataagtatgaacaacaaaaaaggttaaaaaaaatccttcactgtattgttaatttcctttggtattcacagctcacatctaacaaaatatttcagtcctaaatgagtttcttctagtttaaatagtctagtaaaacattttgattatatttactccaaaggatacatcattaaattattttaaatgtaaggtaataatttttctctatgtttactaaaattttttcctcagtagacgaatggttaccaaaatgatttgaggctctagtgaatcatgtaagttccataacacaaatattcatatgtaaatttaaaaactagttcaaattataatttattcataattacacaaaattattgttttatgaaaggttgagaaatgaagtaaatgtaatatacagtaatgtctatctatgtacctgcttatctatgttgatgacacaattttagaaaattgtatttttagatttactaaatatttatctgttgtgtgaattaaaatggcaatcgaatacaaatgtgggttaataatgatgaaatttcaattacaaaatatgagaaaaaactttgtaaacattacatgaaacaattcatttatgggagcttttttttttttttttttttggagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaagcttcacatacaaatccaggtatttagctgctattgaaagattgtaagacataagagcaatagacctaatttgaacatggtaagttaactagaggtgaatagttatataactgttgcatggtaggtgaggaaggaagaaatggggaagcaggctgaaagcaagcccaggcaagcgataaaacaatagcatcagcatattaacagcaatattcctttattcagtatagcagctctcagactgtttggtgtgagcatataactatagatatttactactttagaaatatagaaatttaaattgataaattgagaaatttactactttggaaatttaaattgagaacattttacattatttatttaaaaaaattatttatttatttatttatttatttattttgagacggaatctcgttctgtcgccctggctggggtgcagaggcgtgatctcggctcactgcaacctccgcctcccaggttgaagcaattctcctgcctcagcctcctgagtagccaggactacaggcacacaccaccacgcctggctaatttttgcatttttagtagagacggggtttcaccatgttgggcaggatggtctcaatctgctgaccttgtgatccacctgcctcagcctctcaaagtaaaaattatttttaaaataatgaaaaacccattcctattataataaataacatattctttataaaagtaactatgtcttttaaaaagtgagaagagtggctttgtttcactcttaataagtttctttaatacctgactcaatagaagtcagctaaattctcatacctgattcccatatttaatctgttttaatatgttcatcaggttgaggtgtataaagaaaatccagcctcacacagaaacatagttagaaaagagaggagtattttttaagtttttgcacgtagttgtgaatattttctgttatactttattgaaagttgacaactggtaatttcttgaagttggtttaaatatttttttacccatgcaagatttgctagcatcatgcattggtcctctggaaaatgttgattcactgagttatgcaggtcttctgaatattgacccatttcattttgtaataccaagaaatcaccaccaatataataagaacaagcttaaagtactgtattggaaagctatcaggctcacagtgtactataaaatttttcccaaactatgatttttgctttaccctcctattttatcattgccaacaaatacagtcagttattttccttcaagtgacagagttttttcatttttgtgaaaatatctgtaaaatatctaatgtgaatggtttgtgtgtcacttgtgctttcaacttaaaatggtgcttcatgaaaaaggcagctaaatgagcatgcaactcagtctcataagtgcatttccaggagacagttaattagttacagaaatgctgtatttgtacttcccatttgttatacttgagtcaagatttaataaaattaataattttactgatgcatcaaggatatttttaagtaaagtaaacccggattttttttgttattctacaagggcttggcagtgaaaaattcagtgactactagtagtttgctaacactgctttgatttgtgctaaggttccagcagttttacctatcattgctttttcaccatcactgcaaacatcagcactgtgcaaaaggcaaatggaaatttggaatgactaacaaaatagttttgacttagttgtatcctcaaaaagatgctttagaactcccaaacacccactgtctacactacgaaaactgtcactctataacaatgtgctaacttaaaaaatcaatattataaaaatataacatatacaataacgcaactgattttaactgtacagcttaatgaatttggacaaatgtatgtatccagttaaccaccaacacaatcaagataaagaacatttccataatctcaaaaggttccctcatgacccttttcattcactcctcactcccatctccaccccaggcaaccatgcgtgtgctttctatcactaaggattttattttgtctttcccagagtttcatttaaatagaattatgcagcatgtgtgtgtgtttttttcctgtcttccttctttgacccatcttaacaatgttgagatatatcagtaattttatgtattataccacttcgttcattgatttcaccaagttctattccaaaactgttatgaatgtttgtttagaagcttttgtgaaatttaaaaaaatttaacttgagtaaatgcctaatagtacaatttctggattttactgtaaatatgtttgattttattagaaaatgccaaaccctcttccaaaaggattgtataataccacatttcacctattccatgtgagagttccagtttctccgcatccttgccagcatgtagtattattggtatttttcattgtaactattctagtagttttactctagtacctcatagttataattttcagtttttgttggctaatggtattgaatatcttttcatctgtttctcttttgtcatgtgtgtcttcaattttttgctcatttttaaaattgacaaagtattcttattattgagatgtaaacggttcttatataatatgttctgggttataaatcctttgtcagttttatgcaatgcaagtattttccccaggtctataagcttgctttgtatatttttactacctttcaaagtgcaggtgttttaattttgatgaatttgataaaattttattctgcggtttgtgttttctttgttctacttaaggaaacgtccatttgatggttacaaaaatgtttctcccatttttttctaaatatttatggttttagcttttttatttgagtctatgattagttcaagttaatttcagagtctgatgtaaagtaaggattgaggttttttattttcttttttttttttttttttgccctgtatggatgtccacattttctagaaccattgtcgaaaacattatcctttccgcattgcatttcttacaatctgctctttttctgcttttgtagcatctcacaattttgatatgttgcattttcatttttttcatttcaaaataagttatatttgcccttttaatttcttctttggctcatgacttacttaaaagtattttgtataatttccaaatatttgacattgtttccaaatatatttctgcttttgaattctaattagttctgtattagacctcatatgtagaccacatacgtagaccatatacatatcattgtagtgctattggaaacttgttttatggctcagaatatgatctacattcatgcatgtcctatatatgttagaaaaaatcgtaattattgggttaattattgtaatgtcaattagattagacaatgtttgcttgtagtttcatgtcttctatattccggcttatgttctgtctgcttattctataatgtgacaaagagaagtgttgaaatatccatctataattgtggatgtatctattgctcctttcagttttgtcagttttgcttcatgtactttgaagttttgctattgcttgcatgcagttttaggattggtatgacttgttcatgatttaacatattattatgaatatccctttttattcgtagtattaactcatgttctggtctatttttatgatattaatggagccaactagctttttatgcttaatatttgcacaacatatcatttttctttctttctaacttgtctgcttatttaatttaaaagtagtttcttatagacagcatatagttgtaactctttcgttattccagcacagtaatttcttcctgcatttctaattgcagtgtttagactacatatttttaatgtaattatctatactatgtgtctcccatctggatttttcctctatattttcattgttcactttttcctcatttccccccttttttcaggctaattgagtactttttggatttttttttttttactattttcttactagatctacttttctttttgacaatggctctagagtttacaatatgcattttgaacttattgaagtaaaaggaggcctggcacagtggctcacgcctgtaaccctagcactttgggagcctgaggcaggtggctcaactaaggtcaggagttcgagaccagcctggccaacatggcaaaaccctgtctctactacagatgcaaaaattagctgggcatggtggtgggcacctataatcccacctacttgggaggctgaggcaggagaatctcttgaaccctggggtcagaggttgcagtgagccgagatcatgccacttcactccagcctgtgcaaaagagcaaaattcagtctcaaataagtaaataaagtaaaaggaaaactgtttctttactcacaatacttctgacactaaatgtttgggatttttttgtttacacacacaaaaaaactctctggacaccaacttagtgtcttatatgcttactcaattctgacactgactattcagaattagtgtcagacgctacaaggttagaggctccgtcctacaggcctgcccctcacttgaaatagcaatcatggccgggcgcagtggctcatgcctgtaatccaaacactttgggaggccaaggtgggtggatcacaagatcaggagatcgagaccatcctggctaacacggtgaaaccccgtctctactaaatatacaaaaaattagccgggcgtggtggcaggcacctgtagtcacagctactgaggtaggagaatggggtgaacccaggaggcgaagtttgcagtgagcagagatcgcgccactgcactccagactgggtgacagagcgagactccgtctcaaaaaaaaaaaaaacattgcaatcacaagtccagtcccaaatggctgataatttgctagaatgactcacataactcagggatacactttatttaaatttactggtttattataaggaatgttaaaacagatacaaatgaacagccagatgaagaggtacgtagggcaaggtctgaaaagttcctgagtagcttctgtctccatgtagtgggggtatgccactctcccagcacgtggatgttcaccaacctggaagctctttaaactgcagttttgagatttaatggacgtttcatttcataggcataatgaattaactcaatctccagccctgttcccctccctggaggacaggggataggactgaaaattccaagctaatgataaattagtctttctcatgaccagccctcctgaagttatccaaaagcccaccaagaattgcttcattagaacaaaagatgctaatatcgcctgggaaataccaagggatttaggggctttacattaagagactcctgtcatcccatcaatcaggaaattataagggttttagaaactgttttaggagctagagccagagaccaaacattagagcagacgatgctcctagtacccatatcacttaaaaaattacaagagttttatgggggcagatacatatttattattatatcacaacagtctaccctcataaaattttaagaaacttataatttatttccatttcaatgtataaaacttctgacaatttatttcttatactattgtgtcatacatttaacttatacatattttataagcatcatcataagcaggcatcaaatctcattcaagtgaaattttgagatgaaaaagttttgatatttatctaaatatttaccctatccattgctctccattgctttgtctagatttaagtttttagctagtatcattttccttactcctgaaaaagtttctttagtgttttcattagttcagataggctggcaacagattctttccacttaatatggaaaatgttttattttgcctgcagttttcaaagatatttttactgattatagaattctaggtggacctcttggaggcccttaaaaaatgtcttttctttttcatctttgtctagtttctcttgaaaaatgtctgctatcttgtatctgttcatctgcatataatgtgtcattctttcgatgtcatttctgggtctattgttttttactgacttatttttctctcattatagtcaatttcctgcttcttggcctaataaacttttatttgattcaagacattctatatttttatgttatttttgtaaatttacattactgaggatatgaatttggttgtatttttaataagcattgagttttgttctgctagacagttaagttacttgtgattaggtttaattcttttgaggcttgtttttgaactttattatgatagaacagccttgactgtccttttgtcttagaattcagcctactattaaggtatatccttttcgagttttctactgagtactctgaatgatcagcaaagactccactctagctggttggagctcaactgtcttccagccagccctttctgagctgagaaactgtgcaagtcaccagtttttggtaaccctttgtctgcctttgtgccttttaggatttggtaaaaattcaaagagatatttagagctctttttcagcatatatccatcctcttctgattgacaccctacaactcagcctctccacacttagacctcttactccttaagtcagttcccatttaggatacccttcctacatcacaggctatactatgctgcaagacagacaacaaggccaatttttgactcactttatttgtttcccttctctaaagaatcactgtgcttctctgcctattgtctaatacccggaagcaagactttcatagattttctccacttttctagttatttatggcgggaggttaaatctgatctctgttactcaattaagaccagatgtggagatcttattttgcttgattttttgtatttgcaattttctttctttgttaaatgagtacttgaaatatatgttaccaaagatatttatctcaattgtgagctttatacaggtcctaaataatagaggattgtaacattttgtattatttaaaatattaacttttaatgtaaattaacatgagggacatattagaagatggctgattatgcataacaactacttaccaaatacagattatatatatttagtgtcatttttacacagtttatacgcatacatcaatttaaatgtttttactaccgttattatctccttataataccttgactgccaaagtttttctgcatccagtgttgctatcatcttttgttcacgaggaacaatctgttctgatccctgggaattgagcaggatgtttggtttccctctccatctgatggtagtaatttgtctttcttacttacaaataatatactagatcttgatgatggaataagcttacttcttgaggaatgtgcaaacatgacaactaataatagaaatttctgtaactacagttagcatatatattttaataatacacctttgcatagattacttacatttattttcatatttatacatatgacccctaacttatgatagtttgatttccaatttttttgactttatggtgggtttatgagggaattaaatctatttcaacttacagtattttcaatttacagcaggtttattgggaaataacctcattgtaagtcaaagatcatcttgtatttcagcatattttattatacaacaatgaataattaaatagacatgtgccttttagtatgcatatacagaaatgcatcgaaaaaatatcagtgactctcattcatcaaaatattcaagccatgattgcaccactgtattcacctgggcaacagagtgcgatcagtctacaaataataataataataataataattcaatctgtttatcctatgctaagtatttccaacatttgtaatcctaattcctacagactgagttactatataacttagcttttggaaataaaaatgtgaatgagatgatctttactatatcagtaagaaagatgcatgcataatgaacaaaaaatgtggggatagggagaaaaagaagaaaattaaggatatttttatctgagtttattgtattcctatgtatcaaaagcctaagattcattttctgacattgttctgaaataaactgaaatgtattagggatgatttggattgttatttttgcaaatgtacactgttgtatattttgcaaatatttttcacatagaccctttaattgagaggcaaaagttcagatagcaattgtacacattaggctcgcatatttgattctaggaatgtacattttcagcaacacactcatagaaaaaaaatgcacagctgccaaagctgttaatgggagctgcatgctgaatttattgctacattgaaaatatatcccttcttgttcaacatattcagtcaaaaatgttcattaagaagtagtcttatctgcttttcattttcagggtataacacaagaatattatattccattaagagcaaatgtttaagtaacatttcagaaataaaataatgagtttttgcagtgctttttgggaaaatttaatttatgaaaaagaaaactcttagaatacagttgtagcatttcaatcttttcttctgtgcttgcaattattatgcaaatattattgctactgcaaaagatctttgtcatgaattgctttgtaatggggcaaggttattgagcactactttttaaagagatgtttctatgacagtattatacataagacttcaaaataaattgctaatggtaaaagactaaacaaatgcacccaccatttttatttctacagtgccagaattaaagacgtttatccaaatgctttaaatcagtttattttatattttctagccatgcctgttctagtaaacatgaacaatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggattaggttcagcaagagtaccaacagattaaagctggacaactttggcattcctctgttttcgctgtcaaaaatacactttggactttgcaataagttcctcaatagttataaatcctagtagacaaaattgaaaaaaaaaatctcttcaagcttttgtttgctttactgtattataatggtaatagttactggggattatttttaaatttccagttgtttggatggcatgaactgattatgtgtatctaaataatatacttgtattattaatataaatattttgctaataaatatctttaaataaaatattataagttaagttgaaatgtttatctatttttatgttattaaaacgggttaacactaattcacgtgagttatggttggtgaaaattccaaattatttgttaaagatataattgtaatagagctatagagtcttcactctgtcaaaattacagagctttctccagaagcatcactgtttctttagttctcccgcaccctgctgacatgatgtggaatacactgagtatttgtcagtggagtagccaggatgggtgcagttgagagcactgctgaggagctttcaaggaaagacactctgctctgaagcaccagaagttacacccacagggaactttaccctaactcctgagttgaagtaatataggccattattataaaagaatgcttaatttagagttaaattagagttaaaaactattaaataaccgaataaatctttgtttttatgaatcactattttgtaataatcattaaaatggtgtcagtcctttaagaactcacattttatttttctatgttctgaaatatacacaaatgtattttattacacctaccctgcacaagtgtgattattttgcctgctttctcctattcatttttttttaacacagtacctgaaaatagggaaatgggcagtgtgttgtgggaggaagcaggggataaaatctcaaattttggcactggtaatatgagacagaaaggagtgaatctgagagtcaaatagttcgttacactgaggagaggtaaatggtgaaatatctggcgtccatagatccctcaacataagtggaaggaggatagatttgttcttacggtatccgtggcccactctgtacatttgggacaagtaggtttatggatgctgattttgtgagacgtgttgtttgtgagtctaatcatgtggacagaagataactgaccatagaaatggataactgacaataaaaataaatgtatttaccatgtattatgctatattctatgctgaatactttctaaaatagactttcatttttctttcaactttctaaaactttcagtttgtgagatgaataaaattattatccccattttataaatgaagcttgtagacgttatgtaactaccaagatgacaaagctagtaatggagcaaccgcaatgcaaacccagggtgtcactgttttagaaactgtgctcttaactgctacactctcatacagtctatggcctttccaaacttgcagttaaaaccaaattttagtagcaaatagaggaaatttaataaacgaatgaaagcaattgatttctttgaaaatagttttgcattgtagactgtctatgactacaaaaaaaagctttattttttctcttggtagcttatttctatagaagtgatgagtcagtgccttatcaagaattttcatttcttgcttgcacactccccaaaatggtacttgcagctatttatcattttagtcttatcagtgaattaattttggttatgattaacctttaatagagacagaatagcatggtggcttagagccagtttttcatcatgttattaaatgtcttttgagcccaattttttatctgtgaatcagggaaaataatagtacctcagttataaagttgtgcccacaataaataaattgctgtatgtagaggtctttgaacagtgcttaccttgcctaagcacacgataaatgttatttagcaattattgttaaataggattgcatgtcaaagttaaggaaaccaaagttgattctgttttattgaagttcaactaaatatcatcaacttgagttatatacttaaggaaccttcaaaatgtcggaatgaagactattttcattgtaactttaaattaataaagattaccctgaagggacaataataaatataaacattaatttgttctaaaattttaaacatgtacatgatatattacacaaatttagagtttcaaaatatgaatcttttccagccaacacagtaattttcaaaggacttttttttttactatatacctcttgataaaattagtgaaaaaacagcttaaaatggaactgattggattgaacatttgtatacctctgtgggtattgtttaattgcccgtgaaattgagttgttaaacaagcagaataatacatgtgacataaataaggtaaatcataagaaaattggaaaaataatttcgtatctaatgtgcaatccttaattataagtagtatttcgggcttacaaaatatatgcatttcctttggagagcaatttttatcttacttatctcgggttgtttagattctacttcagatattattggttggatattgtcaaaatacaacatttaaagttaaacagaggtagatatattagaaaatgtaaattgatagaatagttattttgtgtccttttaggatgatataattcagtaggtttagcataagtattaagtacacttataaattatttattaactactgtctttcaggtgtttatattctactgtgaagatatttgtagtgaggaaataaatattttttataactcatttttaattgatttaaaaagacaattttaatagttagatggtgtgatatatttccttaaatgctatcagttgtcatctaatgcatatagacataaaagtttattaatattaagatgattaatattctttgaaacataatttataatttaggataatatttcatctcaaaaaatcaaggccagtaatgtagggaattttattgacgggatgtgttaatcagagcaacctctccagtaaattttaaaatagtggatatgattttttaaaatttattaatagcatcaaagaactaaattgacaagagagatagtcattacaaggccaaaaattatgaggaagggggaattggaaaataagaagacaactgagggccagccatggtggctcacacctataattccagcacgctgggaggccgaggcaagtggatcacctgaggttaggagttcgagaccagcctggcctacatggtgaaaccccatctctactaaaaatacaaaaacttaaccgggtgttgtggcggacgcctgtaatcccagctacttgggaggctgaggcaggagaatcgcttgaacctgagaggcggaggttgcagtgagccaagattaagccattgcactccagccagggcaacaagagtgaaactccatctcaaaagaaaaaaaaaaaagacaaccgaggaagtttggcctttgttaaaactgttcgttcaacaaactcaccataataacctgttttagtgtgcaacttctttcttgccacagtgtttactaacatactgtcaacctaaataacagagagagattatctaaagatactcattctattctggagtgtgcagtatagatgctaatccaggatatgtggactatggggatcataggcatagccaaggagtttgagacaagaggaagctttcaaaggaaaaagtgaacgtaattcgttttaaaacaaacaaaatattgattacagtggcttatcacaggagttgatgccaggtccttgtggagacagtatgtcaggcaagtgttcttatgcattcactagctgtccttgtgactcatgtaacaagatgcagtttgaaaagtccttggcaaaagttctttttacaggcatatgtgcaagtaagagactttcagatgttctttgtaatagttcttatcataggcatgtgcgcatgagggccctcccttcctaacctaccagcttaatttttgacacaaatgactccatttgtggaatccaagtttgacacaaatgactccattttgatcctgacaactttcacatttcctcatttgatcaaggtctttctccaaaagcattgctgatcaaccatctcaagcatctcatagttaggttttatttctcagtgctggtatgatcttgtcctgattgttcagttcttctcacatcagtgaggatggtcagcaaattctgagtcagttttaaaaacactttagcaaaatggccgcaacaagtatgtttgaaaaccctgtatctctgattaattttgcctgaagtccattggtaagttccattttgttagttccaaaggtgttggctatcattttaacaaaaccggaccagtattattctattaggagtcttgctgttgcagatgttagacaggcaacaaagagatactgatctttatcaaacgttttgcctatgtctgttgagattatcgtgttgtttgttctttattctctgatgtgatgttccacatttagttatttgcacatgttgaaacacccctacatccctcatgtaaatcccactgtattattgcgtgtaatcttgttgatgctctgttagattcgctttgctagtatttctgttgatttttgcatctgtattcatcaggggtttttgcctatagttttcttattttgttgtattcttgtctatttttagtttcaggctaatgctagcctcataaaatgaattagaaaaaattccttcttcatcagttttttggaataattagagaagaatttatgttagttattttttaaaagtagtttagaattcagcagtgaacccatcaggtactgggtattttgttattagaagactattactggttcaatccagttactgattttatatatgtttgggttttctattttttcttggttcaatcttggtaagttttatttttcccagaatttattcattttcttgaggttttctagttggcatgtagttgttcatatttttttctaaatggtctttttgcatttctatgatatcagttataatatctcctatttcatttctgattgtttttatttgggtctccactgtttttttcttactctaactaataatttattgacttatgtttatcttttcaaacaactaggtttttgttttgctgatcttgtattatatggggttttctttttgtctgtattttgtttagttctgctctgatctttgttatttattttttatactaattttctgtttggtttcttcttgcttttttagttccttgaggtgcatcactacatcatttaattaaaatctttctacttttatgatgtaggtttctatggctataaacgtccgtcatagtactgcttttgctgtatcctgtaggttttggggcgttgttttctattttcacttgtttcaagatttttttttctctttaattccttccatgacccatcagtctttctggagcatgttgcttaatttcaatgtatttgtacaatttccagagttcttcacgttatttgtttctagttttactcctttgtgatctaagaagatatgtgatgtgattttgatttttgatttttcaatatttgttgatgcttgttttgtggcctaacatatgttccctcctggagaacatttcatatgctgaagagaagattgttttctgcagctcttggctgaaatattctgtatatgtctgttaggtttatttggtctataatgcaatttaagtctgatgattatttttgtttttctgtctagataatctgtccaatgctgaaagtagagtgttcaagtacccaactgttactatattgctgtctatattggtctttgattaatatttgctttatacatctgtgtgctccagtgcgtgtgtgtgtgtgtgcatatttacaattgtattttcttgccaaactgatctgtgtatcattatataattgccttatttgtcccttttgttcttcgacttaaaatatctattttgtctgatataagtatggtactcctgcatggttttgttttccatttgcctggaatatctttttctcatcccttcattttaagtctatgtgtgcctttagaggtgaagtgagtttcttatagccataatattgttgggtcttgtttttttttaatcaattcagcagttctgtattttttcatatgggaatttaaagtgtttacattcaaggtttttacttttctattgaaacatattcctgtcattttcttaatcattttctgattattgtgtatatcctttgtttctttcttacttttattatttgtgtggtttggtggttttctgcaatgataacatttgattcctttctctttctcatgagggtatctgctataccaatattttttatgctttttgagtgtttttataataatatatactgtatttttgcttccagatataggatttttaaataatatcttgtagggctgaccagtagtgatgaattccctcagtttttgcttgtctgagatatcaacaagcaaatttctccacatttctgaagagacagctttgtcagttataatattcttggttgaacactttttttttcttttcttctggcagtttgaatataatatataatatcattcttttctggagtgtacagtttctgttgagaaatctgctgttagtctgatagagattcctttagatacaacttgatgcttgatatggtttggatctgtgtccccatccaaatctaatgttgaaatgtaatccccgttattggaggtaggtcctggttggaggtgattggatcatggcggtagattcccctatcagtgccatactcgtgatagtgagtactcacgagatcttgtcatttaaaaatgtgtagcacctcctcgctatctttcttcccgctgtttcagctttgcaaggcaccagttccccttcagcttttgccatgattgtagccaagcagatgctgccagtcttcctgtacagcctgcagaaccgtgagccaagtaaacccattttctttataaattacccagtcacaggtatttctttatagcaatgcgagaatggactaatatagaaaattggtatcaagggaggcattgctataaagatacctgaaaatgtggaaggaactttgggactgggtaatgggcagtggttgaaatagtggaggcctcagaagaagacaggaagttgaaggaaagtttggaacttcctaaagacttgttagattgttataaccaaaatgataatagtgatatggacagtaaaggtgaggctgatgagacctcagttggaaatgagaaactcattgagaactggagcaaagttcacttttgttccttagcaaagcaattagctgcattgtattgttgccctagtgatctgtggaactttgaacttggtaatgatgatttaggttatctggtggaagaaatttctaagcaacaaagcattcaagttgtggcgtggctgcagctaatcacctacactgatacgcatgagcaaagaaatgacttgaaactggaagttatatttacaaagaaagcagggcatacaatttgggaaaatttacagcccaaccatgtggtagaaaagaaaaaccaatttttgggcaggtagggggattcaagtggactgcagaaatttgcagaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggtacagctcaggccactgctacagagggtgcaagccataagccttggtggcttccacatggtttcaagcctgtagatgcacacagtgcaagatttgaggctagagaacctctgcctagatttcagaggatgtgtgagaaagcctggatggccaggcagaagctggctggactgcaggttagagccctcatgtagaaactctcctagggcagtgcagagcggatatgtcaggttggagctcctacacagagccctcactggggcactgcctagtggagctgtgagaagaggaccaccatgcctcagaccccagaatgttagagccgactgtaacttgcaccatgtgcttggaaaagccacaaacactcaacagaagtccatgagatcaatcatgtagaataacccctgcaaagccactggggcagggttgcccaagaccttgggagcccacctcttgcaccagtgtgctctagatgtgaaacatgcagtcaagggatattattttgaagccttatcatttaatgactgccctacttggtttcagacttgcatggggcctgtaaccactttcttttggccaatttctccatactggaatgcgagtatttagtcagtgcctataacccctttgtgtcttggaagtaactaacttggtttttttttgttttttgtttttttttaaacggagtcttgctctgtcgccaggctggagtgcagtggtgcaattgcggctcactgcaacatccgcctcctggattcaagcaattctagtgcctcagcctcccaagtagctgggattacaggcatgcaccaccacacccagctaatttttgtattttttgtagagacggggtttcaccatgttggccaagatggttgtgatttcctcatctcatgatccacctgcctcagcctcccaaggtgctgggattacaggcatgagccaccacacccagccaactaactttgtttttattttacacactcataggcataagggactagccttgtctcagatgagactggactgtgggcttttgagttagtgctggaatgagttaaggcatggagattgttgggaaggcatgattgtattttgaaatgtgagaaggacataagatttgggagggcctggggtggacttactttgtttggatctgtgttcctacccaaagctcatcttgaaaactacttcctaatgttataggtggggtcttgtggaaggttattggatcatagggtagatttcctcgttgctcccattcttgtgatagtgagtgagttctcatgagatctggccttttaaaagtgtgtagcacctcccccatctctctttctcctgttttggctttgtaaagtttcagcttcccctttgtcttctgccatgattgaagctgagcagatgttgtcatgcttcttgtacagcctgtggaaccatcaaccaattaaacctcttttctttataaattacctagtctcaggtatttctttagagcgatatgataatggactaatataatgctattctcttactgtttttagaattctgtttttctctttgacttttgatattttaaatataatattcctcagagaagaccttttgagttcaatttacttgggaattttttaccatcttgtatgtggatgtctttatcttttccaagacttgaaaagtattctgttattattgtattaaataagaattttttatgcagctttccatttcttcccttcctggaactcacttaatgcaaatattggaacttatttgcataatggtatttcatatgtcacattggcctttttacaattttttttttccttttcctttttcttttttcagactggtttatttcaaaatacctttcttcaagttagtaaattctttcttctccttgatctacactgttgtcaaagctatcttttgtattttttattttgttcattaaattcttcgttttcaagatttggatttttataatgatatctattactttgtagaattatttatttagatcaccagtttttccctgatttctatttattgggtaattgtttgttcttttatctcactgagttttcttaagatcattattttggttttcatgcatttaaaacattttcttctgtggtctcctcctggagtattattatgttccttgggtgatgcaatgtttctttgctctttagggttttttgtgttcatacctggatgtctgtgcatctggtgtaactgttgtttcttccagtgttacgaaatagctttcataggatgtatttttcctttagatgtatttatagtgtcagttgaataggatactttggctttggttctgtgactgtacagtaaggtagtcttcatatgatttctttggctgtaatcaacatcagttatgtctgtgtgttcctcacggtttaggttgtggttgtttgtgtaggatgtggagtggatttgctggggacagggacatcaggcaggccaatccttgggtctctggggtcatgtgtaagtgcatggttgccactctactgaagggagtgggtttgctggtagcagcagtggtgagtcccatgtgtggtgagccattccatggggccatagagggcacatgtgaacactggaaggtccactgtgagccctgtgcaggctggccccacagcccctagtaccagaggtgcatagcagttccaccagtgaagtggactgtgtgccctgagcaaactgattctcaggcccctggcgagtacacatgagctttgattgtgtcaggggtgggtgctgggtgggccagtcttcaggcccctaggccacacttgcaagcatccgtagtgctattgacagactccaggcagtctgatcctgaggcccctgggtggcttgcatggatgctgtgatacttttgtaatatgaatttaaaagtatagaattttaaacttcatgtttaaccatttatttttcagtatcttatctcatttggatatgacccagactttttatgaatatccattgcctaatttaatataactttaatattttaaattacataaaaatttcatttataaagtttctctgatttgtatttacctaacgtatttatttttaacaacacctggattacttataaaaactgggatattagacaaggatagtcatcatttctaattatcttcttgttacagcctgtcaagatcaggtgtttatcacccaagtatgaatcttaaggttaaatgtattggtattttgctgataattaagaagatagaggtgtttacattaagccagcaatatttaattagtcgttttgttaatccatttcacgttataaaggaatacctaaggctggataacttataaataaaagaggtttattttgctcacagttctgcagtctgtagacgtgtgacactagcatctgcttctggtaaagcctcaggaggcttacaatcatggaagaagaggaagggaaatcatggcagaagagaaaggggaagcatgcctgtcacataggtaagatgtgggtgggagaggtctcagactcttttcaagaaacagatctcatggtaactcattacctcaggaatgacaccaagccgttcatgaaggttccatcctcatgacccaagcacctctcaccaggccccacccccaacactggaaaatcacatttcaccatgagaattggagggacagatatccaaattatatcagtcttacttatcaaggagttacataaaggatgatcgttttgcttttaagctgcttatataattttatgcccttaaaccattttagagacaaatataaaactgtctggccattaaacccaggctaaaaaatatatgctaacaattctaaagattatttttattttaccagcaaatttaaagccaccttatttattaaagatttactcaaagcatgtgaactaaaaggcatttggataaattagtaaatattttaacagtcttaagtattaaattatatgagttctcatttattaaaaccaatcttaatagaatttattaaggtatttctgaccaattatgctagattttaccctgtagacacaacatactacgtgtgtaaacacacatgaacacatatgtacacacaaagatatagctttcattttagaattttagacatgagacattaatatgttctgatctgtaatcttatcatggctgtaaaccaaattttgggtaaagcagttttcatagaaatttttttctaaaaaatgcatattttactccatttccccttttttttcattttcagttgagttaggggttaattccttgtcgccttgtatcattggaatgccattagaaaaacaatctatgagtgagattttccttgtttttatttaaatttgtaactacaaagactgttgaagcattcagtttttattttaatacaagcaaaagaaaaatcagcagattcagagtaggcagaagaaaaacaatacatagagaacttgaaagcctgtacatgtaaatcttatagatgcagtttccttatagagttcaaataatggccattgagctctgaatatatatatatatatatatatagagagagagagagagagagagagagagagagagagagtgtgtgagtgagtcagcatcttacttgtcacccaggctggagtgaagtagcataatcatggctcactgcagccttgacctcctgggctcagggaatcctccttcagcatgctgagtaactggggctacaggcccataccaccatgcctggctaatttttgaattttttgtagagacggggttttgtcatattgcccaggctggtcttgaactcctgggctcaagcaatccacccacctcagcttcccatagtgctggggttaaatgtgtgagccactgctcctggccaagctctgattttttttgtgtaatttcctcatcagtttaaaaatgtgtacaagaatgtgctataatatagccctcctagaatccctgaaagaaggttgttctggaatgccattagaacttgaagatcccattccatttcttattaatctttcagagcaaagaaaatcattttccctgctgtatgaaatttaaagtgtatacttaccagaaattcaaaatgtctctaatagaaaggacttgtgttaaaaatgcaaaaagtcttttgtcttcataagagaaatgcgggttccttatgaaggtggatttatctaagtcagatctcaaataaagtcagcaggaaacatctgccaaaaatagggcatcttggcctgagaggagactcaccagacactaaaggtgaggtgtggaaggggagagcagagggctcaggtgactgctgcacactgttcttaagaattactgcttttttccaaaggtaatcttgctccacttctgactctagatatgtcaacctaaataaaagacgaagagagagtctccgaagacactgagtttattcaggagtgtgcaagggatttgcacttccaggatatgcagcctataggattcatagacctatccaaagagattgaggaacgggcaaacttttaaagacaaaaggaaaaagaacatgtaatttgttttgaaacaaagagaatattggtgacaagggcttatctcaggagtccataccagttcattatggagacagtgttaatcaagtgttcttatgcatccagctagctatcctgtaactcatgtagcaagctcaagtttgaaaagtcattggcaaaagtttttgttacagacatttgtaattgttctgatcataagcatgagtgtgtgagggtcctcgcttcttaacctcccatctttatctatgttttgttggggtttgatgcaagcaatccattttgagtttgataacttttacaatatcaagcaaattctaagcaaaacaaaactgatgtagttgtattaatattatgtaaaatagaatttagggcggggcgcggtggctcacgccttgtaatccaagcactttgggaggccgaggcaggtggatcacgaggtcaggagatcgagaccatcctggcttacacggtgaaaccccgtctctactaaaaatacaaaaaattagccaggcaaggtggcgggcgcctgtagtcccagctacgtgggaggctgaggcaggagaatggtatgaacccgggaggcggagcttgcagtgagccgagatcgcgccactccactccagcctaggtgacagagcgagactgtgtctcgaaaaaaaaatagaatttaaaacagaaagcaaagatagaaaatcttcactgctaacaggttgtctttatcacaacggtataataaattataatttataattatctaacagcatagcgtcattgtatttttaaaaatggcaaaattttaacataactttctcagtaaatgataggtcaagcatataaaaatcatttaaaaattgtacaatataatgaatcaccttgatttataaggtatatggaaccctgatcaaaaagggaacaaaaatgtatgtacacatacaacatttatgaagattaactatatatgacaccgaaaagcaagtttctgaatgttttaaagaatcagtttcagacagaccgcattctgttactgtaatgcagaaagtttcaaactgaaattaaaaaattgaacctgaaatgccaggaatgaacaaattttaaaatgtaagcactatctaatatgacaaagaggtaattgaggtagaaattagaaaatacttggagttgaataatactggaaatgttacttaccaaaacttctgaagtatggaaaaagcactacttagagaaaaatctatagtcttaactattcatatttaaaacaaatacaaaagctgaacattaatgagctatgtatctcatgtaagcaatttaagaactacaaaaaaaccaaaataaagtacaaagaagaaataatgaagtgagtaacaaaaatttttaaaaaattaaatagtgggggtaaacaaataccacaatcagtttttttaaaaatactaataaatgagagagactggctagattattaaatagatgaaagagaaggtatacataatcaatgataggtttgaaaaggtagacgtagtaaaatagtatgcattttcttgattcttgtaaaataaaaatatagatatttagtaaaataatgtgtttacaaatttactacatttcaacggggccaagcagtctattagtcacagtaggtacagggcctagggctcaggatatttttagggacgcatgaaaggatttaattttactttttaaattgtaaaaaaaatgaatatagtcataatgaatatctaataatgaatccaggcaggattaaatttgtttctatacccacatagtcataaaatattatttttctatatctattgctgaatttatgtatttattttttaatatatgtttagggaagaaggagctaacaaaggcaaaagtgctttggacccactaaagtcatgatacagccctgaattcaatagcatacaataataaattttaaaatacttcaagttatattaagtacaatatatataatatgattttataataattatgcctcctaaaatactttgcaactacatgtttaaattatgttttctaaagatagaaaaatattaaacagtattttattaaagtcctcttaagaatcagtttttaatttttattgcaaaatagtcagcaataaacatatatgttatatagttgtaaatataagacttgatattaacattattggaatgacataattgttttggaaaaactaagcaatatcatcttcgattataaaatttaacaatgagatataaaagcaatgtgagagtggtatgcagaagctgcctggagccaatttgtaggagcctattgtgtgcaactcttcccaactctgcgttcagtgtcatcaccttggtattttgaagtaggccatgatgagagtgtttgcaacacagaaatctgcaaaccctgcaaatgaggacccctcccccactgtttggacagctgactgttaaacatttactaccacactactgtatggagtatacgatacataaaagtagtgtctataatgctcctatataaaataattagggggtgataaggagattatctttgaataacttctactcgtctttacaggatatatttcattttctttaagtttctaagttggatctgcaatatctttagaatttgtaaccagaactactttttaattccccttagaagatttcaaatgttttcaggcaatattagtttactatcataatactaaattaaaaccaaagcaggtatggcctttaaaattcaaggggatactttgtggaagggaggttgcgaaacaagcagtgtagactggcagaaacaaaaattatataccttccctaaaagccaaataagatattgggttttataacagtgtcttatttgatactttacagtgttagtggatgctgcctttaataaggaaaatataaatatatttggaacagtacattttgtttttcaatacaaggtcttttggtagctgcaaacactgatgattagcattttgttcgaaattgtatggatgaaactgaaaatggaagagttgtcactgtaaattttttgagctgatagaaatttctgatggaattttttactttggaaattttcaaaaatactaagaagcaaataataatttgtatttccacactcataatttaatgctattaatttcttggcatagttgcttgtagttttataccttttttgttaagaaaaatcactattgttgctgaaaaatattacacatgtgtattgaaaatattcaaacaaaaaagtttagaaaagaaagaaaaaatagaccatgaatattctatctggaaagttttatccataacattctagaaacacctttgcaggtgttttatctgtacataaatacagaaaaatgagggttcaaagaaaggaaacttcacacattcagtccctgagttcctagaactccattcatgcaatttaatcaagaacctattcccagaactccattcatgcaatttaatcaagaacctagaattggatgccaaggcgcataggaatgaccctatatgcttatatttccaacctcaatgaacaaactcttctttctctagatgacatttccaatcctccaaatctaagcccctcaagcagccccaacttgttcgttcctctgtcagtataaagattatccttgaatgcatacccttacttaaacaatcctcacactttccccctcatctcctgaattttctccagcctgccttgcagagtaaatattttactaataataatttgtactacatggtatatctccatgccccctgaaactggtattgacctgaatcaaaatactccaaaatattaaacccttctcagctagtttggttacttatcattcatcatttttataacacacacactcatatacatacacttactttgttaaaaataaagagaacttaaaaacaatggcatacataatctgtaagttgtcagataaagcatttgttttcttttcctatgtcagttgttgtttctggaaggtggaagagggaattaggaataattatactttattatatatgttgctcagtggccaaatcaacataggttcattttaaacatcagctgttctggtaatcatcatacttagaggtaatagtaatttggctcaaatactttatttttgggcatattgcttaagcatctgtccatgaattagcttttgtaatgtttcaatatgttctggttcatgttgggtatatttgattctgttacagtaagttaataccatagattttcaaagtagtccttggataatgtttaatatgtttccttagacaggcagcaatttaaatcattttttgtgactcttaatctacttttcatcttattcaaatttgatactagcaatgaacttgcaaatcgctttctcagatttcacagactacattaggttagatttgaaagaaaaataggtgaattgtcacagtaaagaaaatatttattacttattcatatagatataaaatttatttttcaaactcaagttattgtattattgttgatttacatatgaattccagagtagcatctgcatatgagccatttcctaatgcagaaatcatcaatagagaggttatactgttgattagcctcttgaatatcctcagcacatatgtatttctatctcctaatatttaacatggtttttgcctccatataacctccatattttatgatttgatgatagaaatataattaggcacataaatgaggtaatttttacaaaatattttttagtgagataaaatttgcaaaacttgaaaatcaaccattttaaacagcccggtgtcactttgtgtattcacaaagatgggcacccaccgcttccatctagtttcaaaacattacagcaccacaaaataaaaccctttacccactaagcagttgctccccattctcctctcccctgccagatccctggcagtcaccaacctgaagtgggtctttgtatttacctattctgagtatttcacataaatagaattacacagtatgtgaccttttgtgtttggcttctttcacttatctttacgtttttgaagtttattcagattatgtcatgtattagtatttctttttttttgagacatagtctcacgttgttgctaagactggagtgcagtggtaagacctcagctcattgcaacctctgcctcctgggttctagctattcttttgcctcagcctcccgagtaactgagattacaggcacacacaaccgcgcctggctaattttttgtatttttaatagagacagggtttcaccaagttggccaggctggtcttgaactgctgacctcaagtgatgcgctcccctgagcctcccaaagtgttgggattcaggcatgagctactgcaccccacctcattgtattttcataccacaatttatttgtcacttcatcccttgattgatatttgggctgtttctaccttttggcaattgtgaatagtgctgctaagaacacgagtgtatttgtttgataacctgtttttacttcttttgggtatactcctaggagtggaattgccagttaatatggttgttctatttttaactttttgaggaaccaccaaaatgttttccacagtttgaaatgaaccatgttggctgaggcgggcagatcacaaggtcaggaattcgagaccaggctggccaacatagtgaaaccccagctctactaaaaaaatacaaaaattagctgggcatggtggtgtgcacctgtaattccagctacttgggaggcggaggcaggagaattgcttgaacccgggaggcggaggttacagtgagccaagatcgcaccactgcactccagcctgggcaacagagcaagactctgtctcaaaaaaaaaaaaaagaaagaaaaaaaaagaaatgaaccattttatagtatttccaccagcgatgtatgcgagtttcagtttcttcacatttttgccatcacttatttttgatttttaaaattatacagctattctcatgggtgtgagggcgtatctcattttggttatccctaataactaataatgttgaacatcttttcatatgcttcttggccatttgtatatcttttttggagaaacgtctattcaagttctttgcccatttcttagttggactgatgatttgttgttgttgcattgtaagggttttttatataacctagatgctagatccctatcagataaatgatttgcaagtattttctcccgttctatagattgtcttttcattttctttaaaatattatttaatgcacaaaagttttaaattttgatgaagttcaatttatactttttttcttttgttgcttgcgcttttggtgtcatgtctaagaattcattgccaaatccaacatcataaagatttatctctttgttttcttctaacagatttgctttagctcttataattaggtatttgatcaactttgaggtaatttttctatgtggtgtgagtccaacttcattctatttttgcaatagtatttggttggtgcaaaagtaattgcggttttggtattacttttatggcaaaaactgcaattatttttgcaccaatctaatatatccagttgtcccagtccaatttttttgaagagtctattctttcctaattgaatagtcttggccttcatgtctaaaatcaattggctatagatgtatgagtttatctctcatttttattccattactctcatttttattccatttctatttaataccattttatttttatatcattttcattccattactctatatgtttttctttacaaatatttcaaagctaaataacttaggaattgggcattatccacaatgtttttaaatgattaatctggaattttaaattaagatataattatgtagataatatgttgtaggcactgtgctatgtagagcaaacatagacttgaatatgatactgtctttactctcaaggaagagcttaatgtttagtgcgggtccaactttagtaaaccaacaatttaagttcagtctgataaatgctcagattgagtacgggatgttataggagtgtaggggatgtaacaggtgtactcaccaatgtctattctactccaagtaattagtctgaagtaatcatgaatcctattctccttgccagacatgatgttttcaaggataggtatgcctaagtcaatttaagccatgagagtccccaggagaggttactgaggagttctggatatggttttattgctcttaagagaaagtataggaagcttctctcttcccagtgaaaataaatgaggaaatgttttccaaagtggtaattgttgcatgaagccatattggagactgcagagcagagagtcaagactgaactgtcttctgatggcatcactgaatcattagttgaaccaactcggaattcagaaccatctgtagtcttccttttctgtgagctcatcatttccttaactctttattatagtttaaacatggaattctgtttcctgaagataaaaagtcctgtaaggaacacagtactagaagtacatctaaatcggattgaggaatacttaaatggcttctcggagaagatggtatttgagttgaatgttgacttttgaattaaatgttaaagaacaagtagtagttagctaataagaagcagcatgattttaaaatattttctctcaacttataggttcccttttcattttgtttcctgtactgtgcaaaagacttttagtctgatacaatcccacatgtttatttttgcttgcattgcctgtatatggtgtcatatccaaaatatctttaccaagaccagtgtcgaggagctgtttccctttgtttaattatcagaattttatggtttcaattctcatacaacttagtagaaaaaaaatttaaaaatggacaaaagacttgaataggcattttcccaaagaaaacatacagaaggacaatagatatatgaaaaggtgctcaacattaccaagcatcagggaaatgaaaattaaaaccacaatgagatattatcttacatctgataggatgcctgttatcaaaaaataaaaagtacaagtgttggtgatgatgtgaagaaaagggaaactttaagcactgttagtgagagtgtcaacaggtacagctattatagaaaacaatacggacattcctcaaaaaattagaaataaaaataccatatgatccaacaaatctacttctgggtatatattcaaagaaattgaaataagtctctccaagagacatctgcactcccattacagcattattcataatagtcaaaatatgcaaacaacccatttgtccattgatagatggataaagaaataagatttatgtatatttaaatatttaaatatatatttacaaatttagtatttatatatgtatattatatccatattgaatagatatttaatagatatcatatatctatatttaagatatatatttaatagatatatatttaatagatatgtattgtacatctatatttaatagatatataatatatgtattatacacacacacacacacacacacacacacacacacacacacacacacattggaattttttcagccttaaaaaaggagatcctgtcttttgcaacaacctggatgaatgtagagtacattacactaagtgaaataagccagacaccaaagaaaaatattgcaggatcttacttatatgtggaaagtaaaaaggcctaatcatagaagaaagtaggactatgcttaccaggggtggggaggggggtgtgtacgggaaatggggagatgttggtcaaatggtacaacgtttcatatactagaatgactatattctagagatctaatgtgcagcatggggagtatagttactaatattgtatactcgaaacttactaaggtgaggctagatcctaaatattcccaccacatcaaaaattagtaactatatgaagggatagatttattaattagcttgactgtagttcactatgtatatgtatatcaaaatatattgtataccttaaacatacataaattttataaaaataaattgacaataattaaataaatagagagcacaaatggtagttaaaaagagccttaagatattacacatgctaacaaagattttacagtataaataggataatagaatatagaaatagaaagacaatgtatgctatcatatgtaatatgttttctaggtttcacatcaatcctcttaggaagataattgagtataagggaatagatgggagagacactttgaaatgctgtaactcaacagtaacataattatataagcacataattgttgaggccagatgtgttgataccacaccttgaggagttttcaaagcatcaaagttataataaagagatgatgatatggtctagttaattactgcctatagtagcatattaaatctgtaaactacagtgctgctaccaaatctaagatactgataccttctgatattatcgagatcacattttgaaaggaagagaatgcctagagaccattttcaatggttttctaggactgagctgtgaatagcggtaatctgaaaaacaatggcaagtcgagtctatattccaacccatatttaaggggaaataagatttggcactttggaaattcatctatcaagaatatatatcaatatatagttgtactcatcactgtgttcatactctgctgaccaaaatttaaatgctagctaaaaaggattctgggaagtatgggttttagttatgcatccttgtacctgtctaaaattcaggatgttttattactaaaaagaagaagggaagaattaattctggaaaacaattaactgtggaattatatagatcccagcagtaagttatttagtctaggaactaggtggaagcaaggagaccatataggcaagtaatccagtgatctagatgtgaagtaataaataatgctaccagacttatgaggttggcactgaaaaggattgggtggatccaataaatgttgcaaggaaagaagcactataacttcatgactggaaaacagaaagaaataaataaaaatcaatgcttgattatttttatatgatcttcagggaaataatcaagttggttataaataagaactcctgttatattaacagtaataatagggataagaaagaggatggttctttttaaaaatacctggtttatagttttaaagaatctattttgtaaaggacaagaactgtctttctcttacaaatttcactcaaatatgtagatgattttgattatcttgacaagcaacctaattttacatgttgtgatatacttgatattctgtaagaggtctaaagaactgataatgtaaagggaaaatgcattcggtgaatgaatatgctgcattatttatttgttattcatcatactgggaaattgtagcaggtagagactggtgagattatcacacacaaacacacaattttttggtaagccacaatacatgaataatgttatactaactttaaaaaatgagtcaatattataaatacaaattctagggcctcacattaactttttattttattttattttattttattttattttattttattttttgagacagagtctcactctgtcgcccaggctggtgtgcagtggtgcgatcctagctcactacaacctccgcctcccggatttaaatgattctcatgcctcagtctcccaagtagctgggattacaggcatgcactgccacacccgggtaatttttgtattttgttttgttttgttttaagtagtagagacagggttttaccatgttggccaggctggcctcgaactcctcacctcaagtgatcctcccgcctcggccacccaaagtgctgggattacaggcgtgagccactacacctggcctaaagttaatattttaagcgacaatcttcttgcccattattcactgcaaaaatgcatacatctctaatgggataaccacttctatcttgaaataaagatgtgtaagtcttggttctgtctatgctaatgtaagtatttttatcactgtaagtttgtacatttgattgtttgggacttgtcttggacagtttcttactgtgtgtttgaatttggtctatagatttacactataaggaaacaagtttattattttcttctataagaatttatagttatttcaaagttatgagttgaaatgttttgatagaagactacataaccatgggttctgattcaaaaataagtccaatcagtaatactcatagttacttgctatgagttgttaattaacttgttgttaattgtttgcaagatagataaaattagtaatggtttatcattattgactcccaaaccatcctgtttggatatgtgacatgtgcattttaagagttacagatactgaaagcaagatctaatatagaatttttaaaacacttttagctatctaccaagtcctttggtcatagattatttctaagaataataaaacattgatatcctaaagtatttgacaccagtgatttcttggaaagtgagcaatttgatatttccattgatagacatattagcatggctatatttgctagtagttgtaggtaaattcctttattataaaataaatttacctttattatcattattatgttttataccctcaagtggattgccagtactatcacagggaaaagagggttcttgggtctgagaattttgaaattttgtttcctcttaagaataaaaaataagtgttatatgtaacatcttgataaggaaatattaatgataccgagctctgaaaattaaaattagcgtctgtggaaaaagtaagccaaactagttttattcactaaaacacctaaaatcaactttttgatatatacaatctaccgtggttattatgcacttttatatctttgccaaattatccttacaattttccgactcactgtaatgaaacatattttccacttcatgctataccgtggcatttcattagtgtctataatggtacttgaattcaatcagccatattaagaactgacctatttacaggatggttcaaacaatggtgatacatacatttagatattgatagttttaaattctggtaaaaggtaacgttttatgactgatgaaattaatactggaacaatgagtttaattgaccaccagacagtatgcaaataaaatgtcaaaaattcatataatttaatagtccattaagcctaatggagttatatcccatataagccaaaggattcaagtagaattctattttggataatcatctgttactatttgaatataatttagaaaaatgcttagttctttactgtttgaatgtaacttagaaaaatgcttaatctaaaatatttaaaatatttatatgattttttactggataaaaataaacatgctcaagagtttaaaaatagatgcattttatcacttctaaagaggttataagtctacaatgcaaatattgtcagtgtctagatgtgccggcaagatggcctctgatctgccaccacctgatagtgtagttcccagaaaaccttgagttatcaaaagctgtgttataaaaattgcatatccatgagaacaaaagggccttagggcctagagagtttgaaaaaaaattacaaaaaaaaattatagtttcctgtagaaattttaataaatgctctcttagattctctaaaagatgttataaatctaaatgtgaaaacaaaatatttattaacatattttcatgaccttggagtaggcaaagttttctaaatgagacttttcaaatcattaatcataaaagaataaaactaataacctggaccatattaaagtaagaacttatcttcgtcaaagtacattattaaattagtgaaaaaacaagcaatggagtgagagaaggtattttcaatacataaatctcatattcagaatacataaagaacgttttacaaatcaatgaaaaaagatagagacaacagagtgggaaaagtggtaaaaaaaaaaaaaaaattgaacagaacttcatcataggtatccagacacccaataggcatatgtaaaggatctcaacttccttagttatttgagaaatgcaaaataaaactacaatgagataccattacacatctatcaaatggctaaaatgaaaaagacaatacaagatttgaaaaagatgtgtagcagttgaacctcttattcactactgtagagtgtaaattggtacaactctttttgataattatttggcagtatatattaaagctgagtatatggataccctgtaactgagaaatttgactcttagctacatacccaatagtaatgcaaacataagtttgccaaaaccaccatacaagtatgctcataatagcattaccaataatagccacaacctggtattactcaaaatgcccgtcagtagtatcatttttaaaaacaaaagatagtaatggtatgttctcacaatcagacactgtacaggaaaaaaatcagtgagtgaaccactacatgtaagtataacaaggtagatggatttcaaagaaataatgtctacatatacacaaagctagaaacataagaataaatacttaggattgggtttatttacagttcaataaaagacaaaactaatcagtatgttatgtcaggtgagcgcttccccatgtgaggagtggtcttcactgggaagaatatgaggagggcttttggagtactgctaatataggatttcttattctagatcatagttacacagatatgttcaattttcgaaaattagttgagatacttacgatttctcatcatttctgtattttctacttcagtaaaatttaaattgtgttccgtgcaggtaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggtaacaccagtatgtaccagtgggagctgcagaggcaccaaatgtactgtaagaccaacataagatcgcaaaggctatgaaatttaaaccatcattggaaccacagcccaccatagttatgtcaagacctacgtgttatgtgctaacaaagagaatgcctactaaataaaagatttaaatagaactcagagtctcctatgtgagaaacatgtttcctcaaaaattgcttgtagaaatataaagtgatttcatcttttataggaaatagtttggctatacctcaaggtattaaacataggttaccatatggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaattcccctgcctcagcctcccaagtagctgggattccaggcatgcaccaccacacccagctagtttttgttttgttagtagagacagagtttcaccgtgttggtcaggatggtctcgaactcctgacctcgtgatctgcctgccttggcctcccaaagggctaagattacaggcatgagccaccgcgcccggctattaacttcttattaaagacagaaaaatatgtttataaatgtagtgtgacctacttatactatacagtttttataaagtcttttataaagtctactatacagtttttataaagtagtatacattaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacacagggagatacattcaacactataaataaatcaaaatagattcctaaagtatgttaaagtagtccaaaggaaggcaaaagaagagagagggataaaatgatgaaaatgaggggtttttttttcaatttttttgattatactttaagttctgagatacatgtgcagaacgtgctgtttgttacataggtatatacatgtgccatggtggtttgttgcgcccatcaaccgtcatctaggttttaagctccacatgcattaggtatttgtcctaatgctctccctcccctggccccctacaccccgacctgcccagtgtgtgatgtgttcttattcaactcgaacatcccgtgtttggttttcttttcctgtgtttgctgttaatgatggtttccagcttcatccatgtccctgccaaggacatgaactcattcatttggctgcatagtattccatggcatatatgtgccacattttctttatccagtctatcactgatgggcatttgggttggttccaagtctttgctattgtgaatagcgctgcaataaacatatatgtgcatgtgtctttatagtagaatgatttataatcctttgggaatatacccagtaatgggattgctgggtcaaatggtatttctggttctagatcattgaggaattgccatactgtcttccacaatggttgaacctaatttacactcccaccaacagtgtaaaagcattccagtttctccacatccttgccagcctctgttgtttcctgactttttagtgatcgccattcaaactggcatgagatggtacctcattgtagttttgatttgcatttctctaatgatgagtgatgatgaagtttttttcatacgtttgttggccgcataaatgtgttcttttgagaagtgtctgttcatatcctttacccactttttgatggggttgtatttttcttgtaaatttgtttaagttccttgtagattctggatattagctttttgtcagatggatagattgcaaaaattttcttccattctgtaggttgcctgttcgctgatgataatttcttttgctgtgcagaagctctttagtttaattagatcccatttgtcaattttggcttttgttgcaattgcctttggtgttttaatcatgaagtctttgcccatgcctatgtcctgaatggtattgcctaggttttcttctagagtttttatggttttaagttttacatttaagcctttaatccatcttgagttaatttttgtataaggtgtaaggaaggggtccagtttcagttttctgcatatggctagccagttttcccagcaccatttattaaatagggaatcctttccccattgcttttaaaggtaggaacaaaatgcagttgcttacaaccaccagtgttattttgccctgatctggaagatgagccaatgcaagcagataagaagcatatttattagtaatacaatcatatctattgaagaaacagcaaaacaataatataattcattattgcagatagttgtaacattatattaaagcttttaaaattctttgcctatggaataattatagcttcctttctaagtctgatttcaacttgatcatataatcaattgatgcttctctatactcttccaggctggaatataataggagctaccatttacttgtttgataggctctacctctgtcatgctttcacagaagaggcttttactataaagaagtcacacattgccctagttaaactgtccagttaagttcctgaaatattgttacagtgccaaaaccaatcatctttgtagatatggttcttagtatttgagaaaacaaatcaggttgtttaagagggagaccttcctagatagaaaaactagactccacagatagaggattgtgtgcacctatgtgatattactactctactaaattctatattatttcatttaactatttacataattttctcataaaacattagctagcaacatgcttatttaaaccttttatgttaaaatttttgtaattttgcactgtaagatgagctaatgcaaatagataagaaatgtatttattagatattcagtcgtatctattgaagggacagaaaaacaaggtaattcattattgtagataattataaaattattttatataaaatattttaatattctttgcccatgtaataatcatagacttatttctcaatctgatttcatcgtgattattataatcatttcatgagctctctatagaatatttgaaaagtatgtgattgattacttaaacaagtaaactataatgtaagctggcactattataaaataaacacgcagagcaatagagttattactatatatgtgaacctagagattttagtattataatgttactaatattttaaattacatcgtacagcataataacaaaagttttcagactcaatggtgttagcaagggtagcacatacaaggccaaaatataaaatcaagggtatttccatatattcacaatgaacaataagaaattgaaatcaaaagaatgcaattcctaaaacttcctaacataggaaacacttacatatgaatttaacaaagtgttctgaaaactacacaacactgatgaaagaaatcaaagaataccgaactaatgaagaaatagacattttttgaattagaagaattaatgttgtcagtcttcctcaaattgatcaatagattcaacatactcctaataaaaattctagtgcttttttttttctttttttttgagatggagttttgctcttgtggcccaggctagagtgcaatggagcaatcttggctcactgcaacctctgcctcccgggttcaagcaattctcctgcctaagcctccctagtagttggggttacaggtgcccaccaacatgccaggctaattatttgtatttttagtagagacagggtttcaccatattggccaggcttgtctcgaactcctgacctcaggtgatccgcccgccttggcctcccaaagtgctgggattacaggcctgaaccactgcgcctggccaattctaatgtatttttatgaattagtaggctgataaaatttatatggaaatgcaaaggaactaaaatagcctgagcaattttgagaaagaatgaagttggaggattggtaacacttgatttcgaggcttattctaaagcagtggctctcaacagaggactcttttgcaccctcaggaaacatttggcaatgtctggggacattttgcttctcataacttcgaggtttctactggcagctagtggatagaggctagggaatctgataaacatttgcaatgcaaagtatggcactcagacaaattatccagcccaaaatgttaatattggcaaggttgaaaaaacctgatctaagctccagtaatcaagaaagtgcaacattcattaaagagtagatccatatatcaataaaacataaatatacccacatatatatgatcaactgattttcaaccaagatgcaaaggtgtttcaatggagaatagataaacccttcaacaaatagtgctggaacaattgggtataaatatgcaaaaaataataataactttgacctcatacttcacattcatatacaaaaattaactcaaaattgattataaacctaaacgtaaagctgaaaatcataaaatacctaaacaaaacacaggagaaaatctttgtgacctggaccaggaaaagactttctaggtatgatatcaaaaccatgatccatgtaagaacatattgataaattagaattacaaagtaataatgaataaataagccacagacagggataaaaatttgtagagcacatatctgacaaagaacttgaatctaaaatatataaaggattctcaaaactcaagaaaacaaaaatgatgcagtttttaaaaagggcaaaagatttgagtagacactttaacaaagaagatatatggatgaccaataagaatatgatgatactcaatatcattagtcttagacaaatacaaattaagaatgcagtatgacaccactgctgcacctacttctactactactactacacacacacatgcacacccccaaacaaacaaacaaaaaccccttaaaataccagatgagaacacagaacttctgcaattcctgtgccttgctgttgggaatacaaaatggtacagtcactttgaaaaaacaggcagtttttaagtatagttaagcatatacataccaatgacataatctcatttctccatctttaccccaaagaagcaagaacttaggtgcacacaaaagctgtatgtgaacgtttgtagtggctttattcataaacaccaaaacctgggaacaatctaatattcatcacctggtgaatatataaacaaagtgtagtatgtttacacaatggaatgctacctggtactaaaaggaactaaactactgatacaacagcgtggatgaatctcaaatgcattatgccaaacaaaagaagcaaaatttcaaaaactaagatcttatttgattccccagcagcctgaaccaatcacattgagcttgttttgtgttacagaaaaacatttttttactctttaatctgtgtgttcttggaggcctctgttacaatggccaaccttaccttaactacgcacagtgtgtaccaaacactgctgcactctcacatttagttctcacgacaatattgtatgtaggcattttaaactcatttttacagaagaggagaatgagtctcaaagagatagagtaacttgctcaaggtcgcatagcccaaacattttggattcagatctattccaaagtctgtatacttttgccatatatagggttgtaagtcagacagacctgggttcaaatcctcatttagccatttactcctcttaagatttgctagacgttaaagataaatttggatgtggctatttcacagtgctgtgagaatttaagtaataaaaggatatacaatttggttcaaagtaaacactaaataaatgctgactgttattatgcctcaatgcctctcctcatctgtatacatacttgggattttgcagtaattataaaactacatataaagtgcttagaagcaatatatctgggatgttgttagctttaattattattcttgtatttgttatacatgcttaattggggaaacttctttgattccagtaagttcattctcaaaatgtgctttgcattctatctaaaatttctcgtgaaatagttacattcctgaaccagtcacttgcaagatagaaaggcgtatatcacttctgacattcattcccagttgagtttggagcatatacagtcagagatgttatcaagataccaagattttgcttcattactcaacactaatggacaagctgaagtagtttatttttcgaagagactctgaagcacacttaaggttttcattgtttactatgctattctgtgttcaacaatagaagggtatatatcaagcttgtccagttcattcacttacatgatattttataatataaatgggaaactgtatgggatacttctgtttaagcccataactcattttttttaaaaaaagtattctcttcatctaaatacattgtttcttgaaaaaaaattttccaaaaagtaatgcagtgaaaattgttctttcttccttgttcctcctctacactgttcctattccattctcaatgggagatatatatatatttgtatatatataatatagatttatatatctatataatatatttatatatctatataatagagatttatatatatataaatataaaaaaatatatatccctctggatatttctccttttttgaatgcatataaaagcactacagaattttccaagaattttgtcatttaaccaaactgaactcttggcacaccatttagatgaaaagatgtgtttgttccatgtggatccctagtatgtctgctaacaggattgacaataacagacattagaaacatactctgaatgtttactagttttacttaatctgtttgtctctggcagtgattcagaatggagttagtctggagctgttattgaacttcattgttactgttcttgaagccccactcatttcctgccaccccatccctattgtgtttgaagtagaaagctaaagtgttgtaagatggtgaagaggaacacagacatgttttagtccttggcatctcaaggcaaaattggtacttgaaaccagatatcaacctttagatcccatattctttcacctatacattgctctagtccatttcatcctctttggtatgtttttacaaaattttaaaatttacacacacacacacacacacacacacacacacaaacatatatgcccatttaagctgagggaatactagaagttatggatgatctgtataaaggagatgatctttattgaaagagccttaaaattatactgattttttaaaacaaagaataactttattctaatattcgtttaaaactgtacattgatattattttataataatggctgctatagtgtgaacatttacgtccataaggtctgctttggaccctttattagataatttagtaatactaattataataaccaaaggaatgtatttacttctcatggaccagtttaatgtggatgttcgcaccagtaagatgttttcctccatatagtgtgttaaagacccctgttctttccattttatggctgcttcattttctagactctacagctagcagaatgttaaagagacagtggagaaggcatctggttcttaaaaactatggccttgaactggtgcataaccacatctgctgcatttcagcaacaggaaatagtaatcatgtggtcatacctgcttggaagaggactgagatatgtggtctttttcttttctttttttcttttttttttttatgataaccattgttaatattttattaaaagccctcccatacttttccctatggactaatacatatatatattcatgtatgtgtattaggcagggcataatactatacatactattatctaatctgctttatttttcactaaatagcatgtatgaattttttttattatactttaagttctagggtacatgtgcacaacatgcaggtttgtcacatatgtatacatttgccatgttggtgtgctgcacccattaactcgtcatttacattaggtatatctcctaatgctagccctcccccctccccccctccccccaccccacaacaggccctggtgtgtgatgttccccaccctgtgtccaagtgttctcattgttcaattcccacctatgagtgagaacatgcagtgtttggttttctgtccttgcgatagtttgctcagaatgatgatttcagcttcatccatgtccctacaaaggacatgaactcatcctttttatggctgcgtagtattccatggtgtatatgtgccacattttcttaatccagtctatcactggtggacatttgggttggttccaagtctttgctattgtgaatagtgccacagtaaacatatgtgtgcatgtgtctttatagcagcatgatttgtaatcctttgggtatatacccagtaatgggatggctggatcaaatggtatttctagttctagatccttgaggaattgccacactgtcttccacaatggttaaactagtttacagtcccaccaacagtgtaaaagcgttcctatttctctacatcctctccggcacctgttgtttcctgactttttgatgatcgccattctaactggtgtgagatggtatctcattgtggttttgatttgcatttctcttatggccagcgatgatgagcattttttcatgtgtctgttggctgcctaaatgtcttcttttgagaagtgtctgttcatatcctttgcccactttttgatggggttgtttgattttttcttgtaaatttgtttaagttttttgtagattcttcatattagccctttgtcagatgagtagattgtaaaaattttctcccgttctgtaggttgcctgttcactctgataatagtttcttttgctctgcagaagttctttaattagatcccatttgtcaattttggcttttgttgccattgcttttggtgttttagtcatgaagtccttgcccaggcctatgtcctgaagggtattgcctaggttttcttctaggatttttatggttttaggtctaacatttaagtctttaatccatcttgaattaattttagtataagctgtaaggaagggatccagtttcagctctctacatatggctagccagttttcccagcaccatttattaaatagggaattttttccccatttcttgtttttgtcaggtttgtcaaagatcagatggttgtagatgttcaggatacaaaatcaatgtgcaaaaatcacaagcattcctatacaccagtagcagacagagagccaaatcgtgagtgaactcccgttcacaattgcttcaaagagaataaaatacctaggaatccaacttacaagggatgtgaaggacctcttcaaggagaactacataccactgctcagtgaaataaaagaggacacaaacaaatgaaggaagattccatgctcatggatagaaagaatcaataccatgaaaatggccatactgcccaaagtaatttatagattcagtgccatccccatcaagctaccaatgactgtcttcacagaattggaaaaaactactttaaagttcacatgaaaccaaaaaagagcccacattgccaagacaatcctaagccaaaagaacaaagctggaggcatcatgccacctgacttcaaactgtactacaaggctacagtaaccaaaacagcgtggtactggtaccaaaacagagatatagaccaacgaaatggaacagagccctcagagatatgtagtccttttctaggcagttacttcctatcattaactcctccccaaggaatgggaaccgttgataaatagctattcatctgtgcacaaactctatttaaggtagtttattacttttggtattgtttcattatgtggccctgaaatttaatatgttggtgggttttgtgaaatttttattttaattcactgaagtggcaaaataaccaccacactttgttgtgtgccattttgtggtagaacatttgtgtgtgaattctcattgcaatgcagagtatttcttgagtgagaatcaggtctgtgttcacctctagcctctgtaactctctaggtgtgaggccttggagaatcacttaatttctctgagcctgtctttcttcatccataaatcaaggaggttagataatgtgttataatcttcaaaggtccttacaatgttaaaattatatgatatttgagtgacataaattttaaaagtttatagtgacgctttgttttatttatttgtcgctttaattattgtgcttaagaaatacgttatcattttgagttaacagtcctcactaaaagattaaaaatttgctatttgtatttattcaggcctagttaaatttaacagcaacatgaaataaatgattacctgttttagatataatttcataataaggcctctgaaggtcgtttgaaatactgcactaattaacgttttatttccagccttccttaattattctagccagatggtcctttatttatgttattgctagaggtttccagctgaggttgtttgattgttgaagaaaaatatgtgatggcaccataagataattgtaattgaattgttaggtatgttagagcatttgagccttctgtcccggttctatccacatctgggaaataagtttgttaacaaagcactttgacacctcatctgatgcttgagtgagattctgaactgtccagatggaattcaaatggggaaatgactgtgcattttattgtaaaaggcactttgcaaatatctgtgcaaaattcattttgtgaatgaaaagaaaaaaacctttaaaataaagtacacttttaagggcatgatctgttttccaagtgtcataataacttcaggaataaactgttgcattaaggtcaaatttaaaatttgtgcagattaaccaccatttaggaagcagttaagtggagtttttatggcatggaacttcaaaagtgtaaatgaattatcagctgaatagatagtccaataaaagaagcagacttaaagtggaagataaaagtgataaagtgacagtaaattagagaatagaactaaaagctctattgttatgaagaacaacaatagacctgaattatctatgtttctttacaaagtatcttttctcatttctgtgcttatgagttttacaattactaaataaatagtattggatctgaaagcttgtatcagccaagttaggtagaaagccttattaacatggccactggcaacttaatactgggcaattttcctccaagcaaacgtgatttcattattatagtacttaagctgtgcacatgcaggataaatcagttcaatgaccttcttcccaatatgttcaaagatgttgaaatctcagcgtatgcagagctgacacgattggacatgattgttcaacatcttggtaattgagatgctgttttttcaaatcatggaggcattgtttatcttatattgtttatctgatttatatataaataaaattttattggtcagaagactttcataagtcaagttactggttgagtataaggcactaatataattattaatgattatggaggtatcaaatctggatgataatttgatacctaatgaaatggtaaagcaaaacaaataagtaacttccagtggaacgcacacacacatgcacacagatacgtttgaatagaaaagctgaccatgttgatttaaaaagattttcaaagaaactagagaggaaggggattggatctgttgttttgtcttctttttttaaatttcttctatcactttgctttcttttgcccataaaaattaaatggcatacttaagtcacccatcttagaggcactgacttctgctaaataagagaaagagcttatggagtgttgtgttgttcatttttttgtgttttttatgttttattttttccttattgacttgtcccaaagccatttctgtgttttggttcgttgattattcccacttgaataatctctctctgcaggaggctttttgtaccgatcactaaagtaagtctcctaatttataactctgaatatattttaatttgcccattgtggaatatgtgctatctaagaatatctacatgtgcttcaatacatatacttagttctaggcagaatgagagtcaatttgaatgttccgctgacttgctttggaaacacacataactacaagcccttattcagctattggccacgacttagtttataaggggagatcaatgttcctagactctgcatgaattaaaagaaagtgtatgtttgaaaatgtgatccagtctttttattcatgctactagacgtggagtgagagaagagaacaagggctacctattgggtactatgctcactacctgggtgatgggatcattcgtaccctaaacttcagcgtcccgcattagacctatgtaacaaaagcttgcacatatgccccttaaatctaaaataaaagtcgaaattattttaaaaagaaatactaatatcaaaaagaggaaattagtcattactactattgggtttcacttgtaactgacaagtcatttccttttactgctttcaagattttctccttttctttctttggctttcagcaatttaatcacgatgtatctatatgtggatctctatgcatttatcctacttcatgtttgtttagcttcctggatgtgtaggttaacgtttttcaatgaatttgggaatttaaagaaaatgaaaatgtgagcaaggcattcgtgaaactaatacagcttacgagaaattagagagggggatctttacataaccatcttgctagaagttattaaatgtgtttctattgggattaataagaagatgcaatgatacctttggttagtttgctttaattatgtatttcgaagttggctttttctttaccgatgattggttagtgatgaattcatcatccttctatatggcaacagtaaataaatatgatatagagaatttgtaattggccaactaaaagatacttgtagaaaatatatgttagaatgaactgtttagttaactattataataatgaaaacaactgtagtaaccctgtttaaaggatttatgaaatagattataagatttctttgttctatacattaaatgaccattttgttcacaaatttgttatggattgtagtaaatttatgctgcaaagtagactcctaaataattgttagtaaagatttatgcagttttaattttttatataattttacatattttcatagctgtaaaggggattgttagcatttctctatccaaacatacctgccagaaatcagtcattgttgttgttgttattttttttttccattatactgacacagtctaaggaaagttagagggttttctattttgtatttttctcattatgtttgagatgacaaaatcattcatcattctcaattactggaaggcaattcactgaattcaatgtgagttaaaagccagatacctataaaattcttgcactgaccagtaataataagttgtgatgcacattttatccctaacatattaataatatacctattttctattgaattatttctgagatatgccaaaccagtgcaagtgaacattaacggatggcttaaagaatggagaacatatttacgataactagaagaaatggacatattaataacctttactattaatagctagtaaaatgtctttgatcttttttgagggcagcaccttaaagaagcagtatatattcgaggtctcatatactgtaaaagcatcagaatgagtgcataccattctgcatacagtttacttttaagagaacattatatattattaatcctaaaagccattagacaagagaacatttgctgtttatttaaattttacttggataaaaagaatttttctgaggttatcttatgttttaactaaatatttgtcatttattatagatgaattattaagagatttataatgcatgtagattttccttcaatttagtaaaaaggaaagtttattactaatttatgtattgtaagttatgtagtttctagttaaaaactagaactgaagcttttgatttatttttaaataatagtttttatttgtcattgcgtaaaataattacaactcttaaactgtaaactaaatcaataggtaatctaataaatgtaacaattgaaaagacacatttggctggtaagtaaaacccttcagatttatgacattaaatgtaaaggctttcacatgcttttatttttaagctctgatgtgtcacttttcaaaagtgttatattggctgtttacaaatatgcttttatatatgtagctatgcacatgtaagttttcatctgaaattgtcatgtacatttattttggtcatgagtgcctctttgtggctttcagtatgaaatccatactcattagcatctagtacaaggcactaagtgatgtgatcacagtaatctccttaggcctatctctcaatgtgacttcttgccccagattttctcttcaccctaactggctttgctctgaacccaccatggtttttgttttctagatctgtttgcaaactttgcctttccgtttggaatgtttgctaagtcctctgttacccaaaactggcccctattttcaaacaacagtaacaatatccttctgatggacctttagcactctggttatcattgttttctggaaggtcttccattgcatattaaccctcagtccaggctaagtattttctctgtgttctctagcagcctgtgtttacctctgtgatggtcatgctgttatggaatttcctgtttattcatttctctccccaacactctaagctccttgtttgcaaatattgtgtcttatttatctttttatctccaaaacaatcctgcacagtgccctggctcatagcagacacaaaataaatgtttgtttcattagtgtttatcaaacaaaatcactcatgagtttcacctacaaatgcaatcttaaatgtgcctgtgatcacatccttttttatgtgtaacttctggaatcaacaatgtaccatgaatactgatattaaatatgattatctcaggtatctcctgtgagatagtgaaataacccaccatatttgtctctaaaactatgttttatcctcagaactaaatacaatataagcagtctgaaatatatattgaaatctatgcagtctgaaatattcattattgacatttcctgaaaacatggaagtgttttccagttatttgtttgagagactggcattgctgttgtagacagaatggaaatctgtgaatttcttttcttttttttttttgtttttgagatggagtctggctctgtcacccaggctggagtgcagtggcgcgatcttggctcactgcaacctctgcctctcgggttcaagcgattctcctgcctcagcctcccaagtagctgggattaaggcacccgccaccacacctggctattttttgtatttttagtagagacggggttttgccatgttgaccaggctggtctccaactcctgacctcaggtgatccgcccgcctcagcctcccaaagtgcagggattacaggcatgagcaactatcattcccatcattcttcttttctcattgactaatttaaaatgttacctgggaaactgtttaactgttaatggttgccttttacattttttgagtaaaaattgtaattcctttaagtaagacactgtgttttatatagctcctttactgtgcatgttgttggtgtccatgtttagatgagtaatgaaaattattgatgggaaatagggtcatttttattattgctgcagacaagatgtggtggatttaagatgaccacaaattctttgacattactcacaaagaaaggtgacatttatgtcccctccccttgaatctggatggactctaagaaggctttgtccagttgtgtacagtggaaatgatgctgtgccagtttcttagccaagaccttaagagactgacaatttccacttcttgtctcttagagcacttgctcttagaatgtttgttctgggtaggccagctaccatgtattgaagtctgtcttccctgagtgaggaggagtgaaagagggaaaagaggagggagagagaaagatggagagagaccaaggaacaccaggataccagataagtgaatgaagaatgtgaatccatcttggaagtggatttcccagtcctaatttcctcagcggccacaacatgagtcagagatgagctacctatccaagttcttccaagattcctgactcacagtcatgatttaactatgggtatcgttggttaagccattgataaccggaaaaaaagggcgatcactttatacaaataaggaaatttaacatagtttagtctctaatttgtgaatagtacatataaagagtggattgtgaattatatcttgagcgtccttggtaataggcatatgttgccaaaatttctttcatattccttattaattaagtattaaggttattttttcttcatagatcgacatgaacaaagtttgaaggaccctaaggaataaaattttagtaaataaagtagaatgcaagatgatcatctcattctgtgataactacttcttttgaattttgtaacagtttctgtgatatgcatgttgattttttaggcttacttttaccttttgggcaagcccagtcctctgaggtggcagcaagaacaacaagccactacaaatagctagtaatccaagtcaatttcagtttttccatatattaatgaataaaacttaaaataaaacttaaaattaattcaaatgtgaattaatgaaagttctgtttatttatcctaccaatgatcatgtcagatcatgtcagtaggagaagcaaggatactttgagctgttagggtcaatatattttctttaatttataactaagatctttgccctgtaattttatcctttgtctactgcaaaaatttcctccccaaactcctacttgcaccgtgcactaaataggaaaataagcctgaccatatgtgctgctgcccctaaatactctttatttgcacatgagttttctctttattatgttattaacataaatcaggatcccatgaccaggacaactgagattagcacctctactctttggtattagccaggccttctgctatgcttaattgatctccaacagtattattggcccgtttcactgttgtgcttccatgaatgtaactgattctgaattacatgtcattaaaacaaatactttgtaatgtcccctttattagcaagaaatgaaactcatcaccagcatgacttatatatatagctccttaaatcacttcttttcattcaatgttgttttgatataatattaaagagaaaaaaatacttcctggatgaagccagtatctttatagagtttgcacattctccccatatctttatagagtttgcacattctccccatatctgtatgggattctctggctactccagtttattcccacatccaaaagatgtgcatgttaggttcattggcctgtctaaatgatcccaatctgagtaagtatgggtgtgtgtgtgagtgcgccctgcaaagggatagcatcctgtccagggtgggtacctgcgttgctgccccaaggtggataggttctggccacccaccaccctgaactggaataagttggttcgaatatgaatgaatgaatgaatgaataaaatgattgtaaaataaaatttcatgaagtttactatagtcatgcaagtgtatggcagtaaatgatgtggtaggagagtgttcactgacccccaagttgtgattgtttgtttttgaactgagtggtggtaggaggttctccttataattttctcttcacaaacatttattccttgatacatcctaccaccactatgattactgtcactcactgactcaccaaaaattgggtaaatcattatcttacttgttttaattactccttcttaaatatatatatagctcacatttgtttcaatgtttaatattagaagtgtttgaggtctttagttagaagcgatgatgttacataattagaaatataccagaggaaattaactcttgtttatatcaattagcctgcagtaaagttggtttcattatacatcatttcactgaaactcagtttccaaggacatatcaataatgttaggtgaggacttaatatacatgattttaaaaaaatacagtaaaatgtcctaatgtaaaagatacataaaatgaaggtaatttataataaatcaatatatatttaatagctaaatgtttatgtgactgtgctacaaacataacgatgtagttagatgcttgcatctattcatagaattagcagaaatagatggctacagatgctgacaaatagatgcttgttgttttggtgactcatccaccatgggcagcattgcagtacagtgacattttttgaaaggataaatggctcacaataaatttagaaacaaagtgaagggaagtcttctcttaaaatgcacatggcatggcagttgcattcttgaaaaattcagtgttaataactgtgcaaaatgtacttagtatttacataaaaatatagttagggattggatttagataattataaatgggtgagtacttggttagacatttgaatgtcatgcaggagtcacgatggttcacagtggggaaagtatcttgggcattgcaggatctttagaattcccggcccattaaatgccagcccagctgtttccccattcattgtcataacggccacactgacacacacccaagaaatttccattacatccctttgggatgtcacttccaccaattaagaatctttgctttaaacactctcccttttcttctttatcttttctgtttctacccctgtatctttctgacagtacatgtttcctgaattctctggattaatacataaaatgtatcctaactaaacatatcacaaaatgttatcaaacttatgtaataacataattgtaactctttatgaattctcttaccaaatatattctcataaatcttggcatataaatgttaaactataccctatttttaatagtataccttttaactaatattactcatcatattgtataattctcaatttatactgttagtaatttttttcctttttttttttttttttttttttgagatggagtctcgctctgtcgcccaggctggagtgcagtggcgcaatttcggctcactgcaagctctgcctcctggtttcacgccattctcctgcctcagtctcctgagtagctaggactacaggcacctgccaccatgcctggctaattttttgtatttttagtagagacggggaatttttttccttttatatctatatatgagtctactcatttgtaataatacaaaaccccttaaaggaaagagcacatttttgtatttaggggtctcttacccaaaatagatggatatatgtatataatatttattatatttgttgaatgaatgaaaaatagactattctattagtatccttcttctgtggataattatgagtcttggaggtttcaaccttttttagtgataggaataatttgataaacttttaagcaatttgtttcaaattagcagcattctccactgaaggagggagagttccagggggtatagtatcctccctatctggtcaggaggatatcagttcaggcaccagcttggagtgtaaagcacactagtgaggtaaaggtatttattccctctgcctcttccctgtagagttgcctcaagctggctgtgtcctttgctgtaaggtcagagtttttctcaaggtagccatctgtatcagtccattctcatattgctaataaagacatacttgagactgggtaatttataaaggaacaagtttaattgaaacacagttcagcatggctgtggcggcctcgggaaacttacagtcatggcagaaggggaagaaaacacattcttcttcatatggtggcagcaaggagaagaatgagagctgggccatgggggaagccccttataaaaccataagctctcataagaatgtactcactatcaggagaataacatgggggaaactgccccatgatttaattgtgatgggtgtctcccatcacacatagggattatgggaactacagttcaagatgagatttgggtggggacacagccaaaacatatcaccatctctacacaacattctcctctggcttctaataaccttccctccttttctctttttggcttgtggagggtcctacacaacccaatatagtttccctgcactctgcccacacctttgtaaataatccttttgtgaaccttcctcaaattatcctaatttgaatgtgtcatctctttcctcttaggcactgactgatataacccccaggcacagttaattatctgcttggtgtttccatgacattgtgcatatagctcctttattcatttctttattacataattcagcatatatttattgtgcatccactaagtgtcaggcagtctcctgggcccacaaggaaaatatatccatgtaagttatgccagcattagttaggcagttgtatgctatttaatgttatttaatgtaatgttatttacattacattatttaatgtattgtaatacagttatttatgcagttattgtaatgcagttatttaatgtaatgagtcctacacatacagaagtctatagtgctatggaacttcataaaaaaggttcataacttacacataatcattggagacattgtctcaaagaatgtgaaatccaagctgagaccagaaaagtgagtaagaattagacccgcagagagggctgacagtgagaagggaatgttccagctcaagaaaaacatacttacaaaaccaaaaaaggaagacatggcatatttgagtaatgaaaggtaacagatgatgtgtttatgacgagtgagggtgtgtcaagagatcgttctggagaatatgggtcagattataaaggacattgtaaactgtgctaagaagtttacctttattctaatgaggatccactgaagcaagaagcatgacatgaacaggttgtaactttggaaatgttattctgattagttgtagagcataggtaagaggagaataagaatggagggagggagactgtatgtatggtcatgatagggggacgaaccaatgtatattcacctggtggggaagaagaagagtaatcagatttcagagagattttacagatagcacctacaagacagagtaatttactggtatttgggggtctgaatccctaattctaaagacggtgggagatttcaagcctaaacctccaagtttatgaccaggcaactagttggcttgtagtgatagtcaacgaaatagagaaggtgaactgtgagcaagttttggaggaaaaaccatgaaggcagcaatagataaatctaagtggaggtgtgtagtaattatatagataagtgggcttgagttttatgagacagatgaggattggtagtatggttttagaagtcatcaacataagctgaccattaaagcaaaggagataagatgaagcagtgggggcagtaagtcagaatatgattgtatcatattctaaggcaaggatattttaagaacgcttcaggatgacacctaagtaaggactgagaagggctcagagaaagaaatgaacagggtgacaaaccttgattgagacagtttccatgataaggtggggaagaaagcctagattagagaagtaagagatgagaaagtagagtgagtaaaaataactctttcaagtatttttttccctgaaagagaagagaaaggattttagttttggtaaatatggtggtggctcaggggcatcgattgcatgcatgcatgcatttacatatgtaagtacacatatgaatatgtaggattctatgtatgttaatgggagtatcttaaagtggtttaaatgctgatggagacaggcactagggagtggattaaaggtatagggaaatgaaataatcattagattcagatttaggggaaggtaggataggaacaatatcattattatcaatgtatattgttctttcttactagcttgatccctaaaaaggcaaagactatattttttttgtatcctcagcatctaagacattacctagagaatactgggatcttctatattttagttttaggaaaaaggaataatagcttgctaaaataaaatagttaatttacctcagaactcttccaagatcctcagccaacatttgcattatatcctaccttcaaaaactgtcaaacgtatgtcctttaggtattttatgcatagaaatgttttttaaatgatcccttttggacattaaataacagttttaataattttgaattagtactaagtgccatttaagtgttctcctgatatatactaaatgaaaacagaaaatgatgcatgggagaaatgagttagatcaatatggttaaatttaataaaattcaaattaaagaatctacattatttctatggtgatatcactatgatatgtgataataactccctcaatgtataagttccagtcagaagatgattatgtgcagaaagcttttgcttttgtgaccctatatctcacctgttcttttttattgattgattatatttgaagagactcaaatctgtttacattagattaggctatataccagccacgtgattttctgtcatactaaaatttcaaacttaagatcagaagtaatctagattctataataaaaaatcatgacatatgctatggagcttggctgtgactcaattaaaattgcattttttttattatactttaagttttagagtacatgtgcacaacgtgcaggttagttacatatgtatacctgtgccaggttggtgtgctgcacccattacctcgttatttaacacgaggtatatctcctaatgctatccctcccccctcccccctcctcccaccccacaacaggccccagtgtgcgatgttccccttcctgtgtccatgtgtcctcattgttcaattcccacctatgagtgagaacatgcagtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagataccatctcacaccagttcgaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggttatatacccaaaattaaattttatctaattatgttggtggtagtcagatgtgtactctttgaccagttacctgtagccaatttgtcacactttctttctgaaacttattgaatagtttttaaaagatattttatcttttgagaatttttggtaaaatgcttagttggcaataacatctgatttatgaatttatatgatatccctcataatagaatttcaaaatacattttaaaaattactttttaatgatagaaggcaaattccacctatctgatcattccaaaggcagaattattaatttgatggcaaattgattttcatatattataaaaaatgatgctccaaatagaaaagttttacttaaaatcataataattttgccattgatcttatacaaactttaaaatccatatgttcaaagtacttaagggaaaaaggaagtagttgatatatccttgacatctgctgctaaaaattagattactttgtattcgcatttaaagtaaacaatgttaaacatggaaactatcaagtgaagaaatatgtactgttatctcttctgaagagttattcaaatttttattgttatataaattaaaatttagtgtaattttaaaaactcgttttctctttgtaactggttagtatatgccaaggcctgtgttaagtgctcaatatacattatattatttaatttatgcaatactatgaattattattatttccacttatccagtgagtaaactgaggttcaaagaatttagataacttgatatgctcacaggctagtaactaggcaaaacatggattcaaatttgggtttctgtgacttgaaagctcatacactagacccttactatgtatattataatttcagccatttgcaacatttttactatactttaaatgtaatatttgtgcatacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtgaaaagaaaatatttgtgttcaagatgagtcagtattttgcttattaaatatatgtcctatcacggtgtataaataagcataccactttgaaacaattaaatgttttgcaataaaataaaattcagatataaaatagttacacatttttcaaattagtctatttttatcaaggtttataatcactttccagtacatgaaaattatcatataaataatttaatagaagactctgctctcttcacatttcaaagtttattttttaggtatagaaaaaaatcaatattttttttctcattttcactcctagaattagaatccaaatcatttttaggtatttcttttaatgcttacttttaaatttacctaactgtaattttatccagcggtgaaaatctacaggatcagggtcaccttgccctgtgtcaagctattccacttcttaactgtctctgtacttaaaaatctatgtcatttgatattaaattctgagtttgtgtttatttaattttaaagccaaagataaaatagttcaacacaggaacattatcccagaaatgttgttactacctggtcatttggccactgaaactgaagaccagatgggaaaacatctaatggtttctcattaatacagagaatgtagttcaatagaagaggcaatatgtttgttgttgtggccagcattaaaataaaagtaatcaagaaggtaaagactactgatgtaggttgggagacaggagttggggagagggatttagtcactatgtttaatagaaatatataacagagtcattgattattaaactatgaagatatttaaagatcactaatacaaactcctcactttcctagaaaaaattgaggcacaaagaaggtaagtggcttaacccagtataatccaaaaaattaataattaaccaagactaggatatcatctcgtgactttcagtcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagtaagttgtgtttcctgtatatttttgttcagaaagtggtacctgttcctcactggtctatcagactcattaaatgttaaggattcttaaatgggttgtaactttgaggcatcttctcttttgcagttttggttttgtttctttgcttaggtttcagggtgaaaagttgatgaaaataacattggtatggtaatttgattatgataaatataaataaaggttagatgttctaagacatagttaaattcaaaggacacctgtaagaaagtggaaagatagctgtaaaaagtttcactgacaaaaatatagattctttctcaagcctcatattcagaaattctgatgtaggaatatacaattttaaaagaaacttccagagtattttaaaggtcgtccaaggtttgaaaaacactgacttacactgtctaaatattggctgttatgattaactgataaagtttatattcaattcattgtgtatcatgttttgactagtttattgttgcttttatgtgtttgtttatgcttttactctgtgtttggattattcatagcttccttaacacccattaccgtagtttattgagagttggctcggttgctttggaaagctatatttctgcaattctacaactccatacttttgtaattaaaatagagttcagacttattatttggaactacctttaggggtaactggcaaaacacataaagaaattagcctcactgctatagctatgcctcatattttttccccaaaaagatatctagatctgagccttccaatatgacagccactggcaacatatggctatttaaagttagttaaaattaaatacaatttaaaatctagttccccagtcataccagcatcatatcaaatcctcagtaggcacagtaaatacttggtatttaacctctcaatattaaacagcataaatataaagcaaaaagttctattggacagcactcatctagaatgaccacctaccctattcacaagactagtctgtagaacttttaattatttgcaatacttaaatccacttttaaagggtaaaagaatttgccaacactaaagatagtcaaataattttgccataggatctaagggaggggacagtgctcgtattttgagcaatatctcaaatacatgcagtttagggactgtggatgactatagatgaatagcacagcttttatatgaatatgtacattttggtagtgtaccaggtatattctgcctgcccctccaggtccactcttcactgctgtctaccctgctctctgccccagaagctgactgtagttactatgccaatggacttccttacactttgtcttccagtaggtttggtatggagtatgagatcaggatattgtctcccactcccttctaaaaaggtctcaaaggctgactgcactgcacaacccaaggtatatcagttatctattgtggtgtaacgaactatctcaaaatttaatgacttaaaacaacaataatgtattcattctcacaatttgatgggttttctgcgttaataagtaatctaagaagttcctcttttccatgttttgttggcttatgcgattacattgaacagggaggtctgcttaagtcagaacctgtctggcatctcagttggagtagctagaacagctcagggtggctgatcttttctctatatattacagttgaatgacactacatcattgctcaggggttcaagaggaggaaagtacaagtttctagacctctgaaagtctaggcctggaactggtccagcattacatccacaacattacatctactgcatcttttttttttttcctcctttgagatagggtcttgctctgtcacccaggctggagtgcagtggtgtgatcatgactcagtgcagcctgaaactcccgggggctcaagtgatcctcctaccttagcctccccagtagctgggactacaggtgtgggctaccatgaccagctaattttttaattactatttttttagtagaggtgtggtctcactatgttgcccaggcttgtctcaaatccctgggctcaagcaatcagcctgcctctgcctcccaaagtgctgggattacaggtgtgagccaccacacctggaccatcactgcattttatcagccaaagcaagtcatgaatcaacttagtttcaaaggatggagatgagacttgatgggagaagcagcatgcacctacaaatacaggagggattgctggtagccatatccaccattgaaaatcacagattctgtctagggacctttctccatgactttcttgcttttgatttcttggtaaccacttgttccccttacccctccaagcttaggggtggtgtgactccccggttcttacgaatccctacacactgaattacaccttgtgaatttcctatgcctgtttaccccagtggggtaacttcaaaatacctgaatggagaattattttcctgcttgatcctgtttcatctattctcaaaaattagttatgttgctttatcttactaccttatacctgaaattgttcacaatattctattaatttttttgtagcaatcataaagcatttaaaattttcctttacccagttagctttacatttagtctttatgatttcttacattaggatttaatcttgatggagaatgaatattaagtttaactaacatatctgtaagccattatttcaaaatgaaatcttctgattttggtaacatctgcaacctccagtgaccagacctacagtctttaactgtatgactcagttctgtgttctgtgttcagtatcaatgtcagtagtgtactaaaatgtccattttttctctaggattacataaatcttttacatttgtgtcttaaacaggtcaccaagcatttaactttaacctttttatatcatttatgttcaatagaattcactacttttactactctcatcagtgcttgtcttctgacttattaataaattaatgagcttgttttaacaattgaaatttaaaccagatggtcatatgattactcagtgttttcaggatcgaggattttaaaaactaaatgtcattattcccctcagacatactgatttcttgatattaaattattttaaggtttatagaactagatccagaaaaaaatgcttcgtattgtagaaggaagagagctttccatctttaatttacctaaagtggttttccaaatgattatatgtaaatatctgacaccacattgttttcttttataatttatttttgattctgcttaaagaaatacaaggctttagcaaatttaaagtggtccactaccccaagacttaagaaaacatttatactaaacaaatttaacaatgtatatgtcatatcaactgaaaatctgaatttttacttttttgctcatttttctgacagaatatgatagctgtctgaaggatatgtaatatttataaatgggatatagcagatacaacctgttaatatgatatacactagagttagagtatatctagatatagaaatactagatttgtaatattgagaccacattactgtgatatttcattgcagctataataaatttttatgacttatcataaggtaaatgccaactttgcaacatgtatctttttttctttgcaactgacattctatgttcagattcattgtgctcctgatatattcccatcatttcctttcctgggagaatccctttcttgtgaactacagtgacttttttattgacatactgcaagtgcagaagctttccaacaaagcattgctttgtaacagtagaccaggtacattctgctaagcaataaatcatgtatatattcactggagcacaaaaatattttggtgatataccaggtaaaaattgatattctagtagggagattttgattaaatgccctttcttctacaactttggtcaaatttcaggtgtttaattcccatatatgatgatgtttgtgaacttcaatatacattgttatgtttttcacctgaattcccagctgaatgtaaaaactgagaacaagaaaaggtgttattacttagaggtgtttttaacagctctccaatttcataacttgtcatttcccttttctttgatttagaaatgtgttatactcctggaagttttcacatttgatagatgtaaaaaatagaatactttgagagggattatactagcatagtggttaagagctcagactctggagccagagaactgggttttacatttcatctgtttcttacttgcttttaacactgtacatgttaatgtctcaatgcctcagtttcttcatctttaaaatggaaataatatccatatacatagggatagtcatactttatacagttatggtgaggattaagagttaatatatgtgtagtgcttaaaaagtggctgtcatataataaattctatgtgtttgctatcattgttgctattgaaagacaatgaaagcacatttgctcatttaattagttccagtcattgttattaatgtatttcatttcatttttcctgcagtgaaaaagaatgcaatggatccttttgccattatttaacattttaagttgcatttttaagtttatatataatgtattctacaatatttcacaatatatgagatattgggactttaataataacttgtgtgagtaatgtctctagtcttaaagactctaacactatcttaaccaggcaaagtaaaacactgtcttaactactgagcaagtagtctctttgaaatcagcccattttgtggatgccatatacatgttacactttaaagcatataaggttgatactttactctttctcaacattgattagagactaagaccttgttttgactataaaatatatttctttaagagggagaaggagacagtgccctgtgtttcagtgaggtatggaacacctgagttcaggtcaaggtcactgccatttacttgctatgttgatctcttacctttgtgactcacagtttctttatcagctaattctgtgattagtataaaaatcaaatatgagaaataatgtcgaaacactttagatgctgaaaatattacagaaataaaaagcagtgttattgaagccactgtacctttatcctgctgaagaggttaaggattaaattggttttgaatatatattctgtggtagtggggttggagcattgcagaacatgctgatgcacatgcttagggagagggacaatgatttctagccaagtgtcagaaggactgtgtggtcgtgaaacacaggctgcatttggcagaagtgatccaagctagaggtcagatcagtggtgtccaaaagatgatttagaagtcttctttttgcccaaagccttttgatgaatttcctatcaagtatttttctaagaactgttaataaatgtcaaaattaacagatttcagttgtatctccttttcatcctgactctgcaagatagactccagaatatagcctaaaggaaagagaagaaaagaaaaagtaatggatagagtagatgcttctaatataaaagatttccaataggctgagtgctatataagaaaaaggaaaaatatttgatatttttaactaacatttattgcgctacacattttgatagcattccaatgatgattcgacctgccttgtctttgagattcttcaactagttgaggaaagacatctatcaaggaaagtatctacatttctcctgaagctatctgaaagagttccactgtttccctaatcaggttgttaggtaaggacaaagatgagagcatgagtaatagaatttgtggggtaggtgagggcagccagaccactgcctcggcagggaacaatttgggcagcctccaaaggaaagggatctttgaggcaagagatttaaagaaggttttttacgaagtttgtttgtaagtaatgtacccttctcttcttatcccaagaaagcgtcactgaacttctgtatttcatttcagtccatttgagttgaagttgtgggtatttagagttatttttggatatgatattatcttgagactgcccataaggtgagagaaacaagatgtcccaataaattttgcatacagatttataaagaaataaacaaaatacagggacactgccactagatttttacataatattcactttaaataacattttaattgtaaatatttttggtcacgacctctaaacaagtcaataattgaaagaaaaacaaataacataattgtatataacacattgtacttttaatgataaaaacaacaattacgactaccatttatatatgcccagccaggaaatattctagatgtctttatatgatctaaccctaacagtaacttgaaacatggtagatgttgatagcctcatttttaatattagaaaaaggaagctcaggggttaagtgacttgccctagattaaacagcctaggaagttgcagagctggaatttcaattgaggttgcctccgaagcctattctttttccaacttattgtattccttttgaaagaacacaacttattttaggaattactcatagaagcatctcctgttaattcgatatttatagtctcataaattgaatcctaaattatagcgttttagaacataatatataaaaaaagtggaaaacatttcgactggtgcaaagaaaatgattaagaggataaaaatagcccaaggcaatagtattaagttaggcaaacgtaagctgaatgttgagaagttaagaatataggcttcttagatttcgattttcaaagtaataacttttcttattacagaaattgttttttatgtatggtgcttattactaaaaaaagattaattatctgtcattcatgtcaccaacttactaagttgttacattggccaatttttgtctttcttaaattattttttatctcatgtttctatctcatttgggggaaagaagaaaaaaggcaaaagaaattcctttctgaatatccatacacattgaagttttatgttcatagtaaactaataactatttcttcagtgtatgacgttatagtattttttcctccaccctcaccacaccttgttttagcaacttagttcattgccaaatcctgccacacctccctttattccactcccatatccaatccagctcatcttttatcgtactgattttaggaatgaatatggtccccttatttaccaaaaggtgtctcagaagttcgtgttgtttcctagtgttcattaaagcttgcagatattgaagtgtcaccagggcattctgatggagatgcccagcaggtgtttgagattgtccctgggaggtcagaatttaggattctatttaagacagtagtttcaaatctgagtgatataatggctctcctttaagagaagtaaaaataagaaatctgcaaaagacattattttattctttttcatggctgtgtagtatttcatggtatatatgtaccacattttcttcttccagtctaccattgataggcaactggccccatgagcatcttgcaaatcccagagtcagaagcaactacagtaagagctggcatgtaagggttgctgaactgcaatatcagacaggcatttgagtctcagtgacagcagcattttctagaaaacagtggtatctccattggtaaagatgattggaatggtgggagagacacttcttatgaaccagtaatttctaagccaagtacagtaatgttaagttcaagaactatatgcaaccaaacactagataatataaaagtaaagcaaattaatataaccaacttcaacatctgtgacagtttgtgttttccagtgatgaccacaatatctcctatcccatatattcttctgtaatgtgactttgctccttccccataaacaggtagtcttattcccctctttttgaatgtggactgaccttaccaactcatttataaccattggaatggaaaagaattcatgtgtgttccttccaaggctagatcagaagacgtgtagcttcttccttagtgtactgttctggaacactgactctctggaaaattcccgctcagcatgcttcctcttgggagctgccatgctgtcagaaccccaggctacataaaaaggctacgagccagcactacacttaatacatccaactgggcccagcctccaagtcatcccaactcaggtgctagacttatgagtgaaggtctttatgtgcaaaggagaaagcaaagagatctttgatgaccagaagaaatatattgccacagagacaataatgcttaccaaatattctatgcacacactcacatttttttaggccccttgcagttatttgaggccaagtaattattcttggagagtgagctatgagtagcatgataaatgtcacttcccaaccataacagagaagatcaggtatgaataaacatgacatttctgatgtcggagctttagatagcctagatccttaagtcactatgtggaagagaaagccctgccaacctctgttagacatcatgtagtgtaagtgaaaaacagacattcttatactactgagattttggagttattttactacctggcctattcttgaataatatactttcttcatttttaaaaaattccattttacttaatcattgatttattacacttactgagttcctactgcatgtcagctacatcctgggaatagaaagatgaataagatgtagtcccagttctcaaggacctccgagtctactgatgaaatttttgtaagtacttaactgtgtatttgcccatttatagactttcttcaaaagagatcttcttggaaaattcaaattatttagcctggaatgcaaagcctttcaaatctgattttacttgtcatacatgtattatttttcacaaattccaaccacaccacatctcacttttctaaaaaaatggactgtatttctagaccactgtgattcttgcatatgctagcaactttgcataaaatgacataaattatctctgttcataaaaattcaacccagcctttataacccagttaaaataccacatctttatgaaatatgtcatgactgtatcaccaaatatgatacatttctctcctaaaaccttagtgatagtgtgttcatttcttttaactctgtctccactagactgtgggttccttgaaaacaagaactacttgcttatttctgctgaacctacacacagtctagaatgcatttaaaatctcatgtttagctgcacatggtggctcatgcctgtaattgtagcagtttaggaggcctaggtgggaggattgcttgaagccaggaattggagacagcctgggaaagatagcaaaacctaatctatacagaaactaaaaagattagcctgtagtcctagctagttgggaggctgagagtggaggatctcatgagcccaggagtttaaggtttcagtgagctatgattgtgcgactgcacactccagctccagcctgggcaacagagcaagaccctgtctcttacaaaagaagaagaagaaggagaagaagaacaagaagtggaagagaaagagaaagaagaaaagaagaagaaaagttcattttctgtcatggggtatattatttatctgcttaagccaaacagacattttaggagcttctgtcttgccttatgttcttgcttgtctagaaatacattgtaatgaagttccttttaacagatatttctctaggcatgctatcttccaaagttcagtgttcattttattcactgcagttatttttattacagcaaataagaacggaaaaatgcaaaaggccataggacttctactcgggtacccactgtggttacatacctggcaagatgttgttaataatggtgtaatagctaacatttatgagtgctactgtgtgccagatagtcttttacatactttacatatattcaatttaattcttataacaaccttattaaatagcttattattatgctcatatcttaaagatgaagcatgaagaaagctcaaaaagctagtgagctagaaaacagtaagtcgagatcgcaggaatccaggccgtctgtctccagagctgtgctggcaatgctctcagcaagaaaggaagttccaagccctttgtagttgttcctaaataacaccgggcaaaattttgcaaatcaatctatctggaaagaaaatctaatagtcgtttcagtgactattaaacaataacaaaaagttaacagtccatataattatagtttcctaaggataattcttattgttagatgaaatttactctagcatatgaaaccatatacagtgacaataagggaaggatgttgtgatgcacaaaactttaatcacaaaaactaaagaaagcaagtttctcagtaatcatggctggagaaaacaaaaagaactttcaaagatattgtacattttactagagatcgaccatagcttaactcattaaagaaaacagttaataatacttctagagaagtacatgtttattcagcaataccttggcataaccatctgcaatacatgtcttatatgcaaaatttagtagaattatttactcagttatctaaataattctaatccacatgcaacttcactttccaaatgagaaaaaatagcagattagttatatataatttggagtgagtgactgagatctctgtctatgtatgtatatctgtattatctacaactgtatctgtatatgtatatatatatatatttatgattcagtaagtatgcagttaagaacacaattctgaactttctaacatctaatgtctaatttatgctgtgtcaaatgtatttttttaaaaaaagataaaaggcaaacataagtcaggggaaaggagcatagagtggagggggaaagaaaaaagagtaacagtggagaaagacggacaggaaaaggataaacaagcagagcaggatggctgattacttacagcatgtgctgaatggagacactcacaggaaacatcatgtcagatatgcttaaatatcgaacttatttctgagtttgtgttttttctgctacacccatgaccaatgtctcagttaaagaaagtagagacaaaagacaaatgcttaaatttcctgatacatacctcttatttacagtacttcttccattgctgtacttgtttttatttctggcagctttatttgcttatttctgagtacccagcataatgtcttacatatagtacacatttggttaatatctgttgaataaatgcattcatgaaagaatgaataaaagaaaacaagtcgatagagggctattgatgtgtgtacatagtctcatgggctaaaagctctaaatgcaaatataaggggttccaggaatttcagggctgctccatgaaaaagatatggccacaggtagaggtagcatacataagctttattttgctaacactttgacaggtttgatacaggaaaatccctcacagcatggaactgtccagaagttactgcatgagagccaccattcagaaggggaggacagcaagtgatatggtttggctgtgcccccacccaaatctcaacttgaattgtctctcccagaattcccacgtgttgtgggagggacccagggggaggtaattgaatcatgggggcttgtctttcccatgctagtctcatgatagtgaacaagtctcacgagatctgatgggtttatcaggggtttctgcttttgcttcttcctcatttttcttttgctgccgccatgtaagaagtgccttttgcctcccgccatgattctgaggcctccctagctatatgggactgtaagtccaattaaacctctttttctttccagtctcggatatgtctttatcagcaacgtgaaaacagactaatagagcaaggaaactcccagaggagggagagaatagggagggggcttacctatctaggtgatgttcctcggcagcaccacattgagtctctgcatcagagagctccaaagggtatcagtggcttggcatatatatagcccaggtgctatctatagcctggggccagcagatatcgggcatagtttcatggggtatgcaaagtaggctgtttgtaactatttaaatatctacttatttagtctatgttgaaaacatagtgaaacgaatgaaaatttgagtttggtatgggtttacttttggactaccaggtctcagcctgctgtgaagaaataaacaatctatggaccaatatacaggagccatctttggctgatttatataacagtaaataagcatgatataaaaaataataattcaacaaagagaggaagtgagtttattggtttttaccaagcattatttcatatactaaatttcttcaggcacatcaagctaaaacattatattaagaaacaggtttacaccactgtacatgtgcaaaaattaaggatcatttctatgatttaactaatataagtacaattgaacaataaataccaatctctataggttaagaaataaactacgaatctttttataaaattgattatgaaatgaactctcccacttttgttattattttaaaaatttatgtggagtagttaaaatgaattaaactccgaagaaaagtaaatcatcattacattttcttttattaccactttgctcattaggaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctgtaagtgcatgtaggttatttatatcatttctgtcactaaaggtgtcatatgcatatcatagatgccagcaagggagaacaaaccaaaagtcctatccagtcactgcagctggctcaagtttagaaatctggtcatataatgtagtctgcacattatgttctgacttgggtttcttggtcctgagacctaggaactgataaaagaaagtatctcctcactccaaacccaatagacaatggtggaagaggaataagttaaacagtgtaaaccctccattcaaaaatgggaaaaatagcaggcaccattaggcatagtctgcaagcattttggaaatccactgtgcagtagttgtaaaagtgaaggatcctgatgcctgggaggaggtccttctcttactatttcctggaatccctgcatggcatgtactctctggaaggtacttcttttccattatcctctttggccatatctgaagtatgtgtgacggaatatgccttacttgggggcttcagtgaaggcttttcttcctacttcctgcttaaagcaagttggtagcccaagtgtaattttaagtcttgaacagtactagtttttgtttgtttggttggttggttggttttttttttaattccaggtttgttgttccttttgcagtacaaccctctctgaaactcactgggcttcttatctgtttgattacagtgagtcctatgtgccaattaccctgcctgcaggttttttttagagatgttattctcagatctgctgtattgctttgctttctctccgcatacttcactctctagactcagtgagagctacattgggactatctgacttctgcagaaaggttgttttcattctgatctctaccctgagtcattttatccagttgaaatgttttggggtaataacccctaatttgatatttgccctgagacatcatagtgagctcaacaattgtaacaataggcatgaaggctatacctttaatcatatctttgatactgattaaattttaatgggcctctgtcattcaaagtcttcctcagctatatttcttactgtttagggcctttagtagttagcttttccaaaattgcaaggcctcaaatttttggactctctgaattccatttcatttctctttgcaaactgacattactttttgattaaaggtctttccttaataccctgttaaaagtagtcaacatactctactaatattctattttccattatcttctcctagaacttaaacacatgagatatgtgatctgtctcccactttatcaaagacaacatttaaccaaatgtttttgtactgcataacatagattgctagctcttcagcttccagtatcaattttctcataatctgcctgctaagtcaatgccacagagtttaggtttttgtaacagcagcgctctactcctgataccaatttctggactagtctagataggctttgttatgctgtgatggcaaattaaccctgaaatatcaatggctttatatgaaaagtgtttatttctcacttctaaggcatatctaagacagatcagcaaagggtctctcttccatctagttactcagagacctaggctaacagaagagccacatctagatcctcactggtcaccaaagcagatgtagagagagtacctggagagttgacatcttctctgctttggcccagaaataatagatgttatttccactcagtttattggcaaaattagttacatggccctgcctaatttcaagatgcctagtaactataggggatcatatgaaatatttggtgagcattgcagtctcttctacagagaaaactcttaaagtatatgcagttatgaaaagtctatgtaaattaacggctgtatgtatttgctaaggctgtagttccagagctattagaaatcctgagctttgtagtcttggaagactagaccagataaacaaaactaattcttctttcaatgggttaataatgtatttatcaaacacattaaggaatgatatggacaaaaattttaaagtaagttcaagaaagagatgtattgaaagcaatagctatatatatagcaagtggactatagaaaacaagtggtatccttgaagtgtatccttgagctttggaaagataatcatgtgaataccatgctctttaacagggagacacttgggacatttattagactgaatgatgggcttgagagaacacttgtctgacctggtattgcactttttgtgtttcaggagaaatgatttatacctatagtgtatccatatttgaagtctagtgtggttctgctttagttggcagtctatgaataatatccttttttaaactatcaaaatttacattacgtacctctttccagacatgtggaatgggattctactattactagggaatggattatgatgaatacatcttctcatgtacaaaatagaaggatttaaaatataactttgaatgtcaattaataggattattaaaaatagatttgtttggtccttctatgtcatgtgttaattagaggctaagtccttgaaaagttaatagatcaaaattaatacagagtaagtattggacaaagtcactgtaataataatgctattcattgagttatcacataaagacttttacgtgtgttatctcatttatttctcataataatccagtgaggcagtaaaattattatccccactttaaagatgtcaaaactgatagcagtaggttcagcagctgacccagtgtcacacaaaaagtagcaggactggtattcaaacccaagcagtctgactccagaagaccacattcttaattccaactgtatactagtatccttccgtttgatagaaggttgtgtttttattagatcatcaaattgaaccatctcaagagtgtatttgtgttgttagagtgtaactcagtagttatcatgtcataatcaactgaggggaattcttcaagctacatagatctttttcctgctcttctcccttgcatcacagtcagtcattcattctcacatgtttacctgggtgaatatataactaaaaaagaactttcatgtaattttaatacaccatcccacccaccacttctttttgagaaccactgctcttggttatattggtaactgtttttgctgtgtaaggagaaaggtgacatgtgaaagaaatataggtaattttttctgaaacacattaccataaattgatcctgagatacaatgcagtggttaaaagtaaaggattcatggtcaaacaaggtgttaacttggtgtgcagccctttattgttgtagtgatttttttagactgttttagacttgatagaggtctaataccagttcttactctagctgtgaaaataaaactctgttggattttcctttcttgttctctttgattagcaggatagataaactgaacacaagtctcaccctagctccacaacttactgtgtgaatttaggcaaattgccttaggatcctgtgcctttgtttcctaatctgtgaaacagaaaaaaaggaatatgggccaggcatggtggctcacacctgtaatcccagcactttgggaggccaaggtggatggatcacttgaggtcaggggttcgaaaccagcctggccaacatggtgaaccccatctctactaaaaatacaaaaattagctggcattgtggtgggttcctgtaatcccagcgacttggggggctggtacaggagaattgcttaaacctggttgggggacagaggctgcagtgagccaagatcgcaccactgcactccaccttgggcaacagagtgagatgccatctcaaacaaaacgaacaaacaaacaaaaaggaatatgtacttgatatgttgctgtgggaaccaaataatgcctatttgtaaactgtatagaaatgtgcccattttatagtaaacactcaatagataatacatatgatgatgatgatgatgatgatgatgatgatagaagagccagccagttccctacctttatgctcttgtgctcccaccagtggaaatctccctctaaaggaacaaaacagttgacaactgctagctcttagaagctgtagacctctaagtcaaagtttcatcaagaaactacatttttaagtatcacaacagaagcagtattaggaaagagattaaaggcacagaatctagactgagattacttggatttgaattctggttctgccttttctagctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaaggtatatgggaagaagaagagaactagcgttttttttttttttttgcatgcctaatatatttaacaccttttgatattaacctcacagcagcctcactgactagataacttatcaataaaaatacatgactaaggttttataacaaattgtagtgctggaaaattcaacccaaacttacctccaaaacccagagagggcaaataattaaaatccagatgaatcacggagaattaatagaacaatgtaaacaaattcctaagttgaaatttgtataagcaaattgaaatttattcctcaaagaattgatataatttatgtaagctattttttaagatttagcataaattacatacacattaataaagcatataagcagagacatagcaaataaataagctctgcctaagaaaattttcattgacctgtgttttagcccaattagactgtgagataataatctagatatctgatacacatatttttatctaatcatgtatcataagctcttctaggaatagtatcagtatactatttatggtaattatttccatatacagaaattattgttctgtattaattattacatagtagtttaattgtaaggaaagttgttttagatacctggtaatttctgtacaatttatattttttcattagcaagggcttataatttaaactttctactttttgttaattttttttagtatatagtatataatatttatgttcttaacaagatatttctacaaatttatattgggtcctccaaaatcaatgcattttgagggtatgttacaacttgaatatgaagtatagcaagaaatatttttctctgtgtgtctaatgatccactgtgttgcctgtgtgagtataatgttattacaagcattttttgtaataacattagtacaaataaaaaaagtttctgtttttttttttatttttcctctaacaattttatatctgtaaggttttttaaacagattttggttcaggatatttacattaagaaataatattactgagactttgttcaaatagagctaattattgtccataatatagcataatttaaaataaatatgagcttttgagtaaaatttccctgagaaaaattccactatgtaatatatcaataaacttgggttaattatctaacttccctgaatcttagcatccttatctacaaaaattagaatgactgtatgttcattacagagttgttgggtaaattcaatcagataattcaacccaaattgtgaccaaatagtgtaatgcacatatagtgtaatatctgtatattacacactgtatgtctaaatggctagcatgttatgatacttaacaaatgttagtcttcctcctcatttttatgttaatttaattgatttgtggctgtcatcacagaatatagtatattctaaaataatgtttcttttacaataattttcaacatataagaagtaagtagttatccacagatagaattagcaacttggagtacatcagccatttccaatcataaatccatggatgggtactggcctctgacttcattttcactgtacaattagaaaaataaggataataaaatttattaagctaagttaatttcagttaattattgtggtctaattgtgttgtgattcagatgtcttccacaaaattattataacatagtgatgtttgagattttaaaaatacccttttgtagcaaaatcaagaagttagaactcctctgtcaattattcatctttatttctaaatttattttaaatatcaactctgccatgtactacttgtatgacttaggacaagttatttagcctctttatgatataattttatcatctatacaatggagatatcaataatgactacctcgtggattgttaagataaaattagataatacatgtaagactcacagagcagttctggcatataataagtattccataaagagctaaagctactgtcatcatcactagtctgtgaaatccaaaatgtgagaatcatccatttagataattcgtcttatgccaaaattactttaaaagtaggaaagcctatgtttacagatgttataatacctcaaagtcatagacagtctttgtagacacatgaagttgttattgaatgtgaaggtattttacaaaatatacctatttgctacaatagattgaatattgtcattgaatatcatctgtatttttatttgatgattttaaaaggcctatttttatattagactaggcttttgatgcttttgttaagtccaagaatacaattgatgcctatattatattttgcatgtaatttaattatcaaaatttttcttagtttttaaatatttcttaaactttttcatataccaaatgcataatgatgagagtctcaatagttctatttcaaataaaaataaataattgccaaatatggaatattatttctaatttttgttcacttttgagttaccatacatagagctctagaaacttctacaaactttatttatagaagtttaggaaaattagaacaatgtttataatttattaatttattaattatttatccaataattgaataatatttttaaaatagcttagcattttatttgaatatgaatagcatttgttctattttctcagaaggaagtgctatttttatctaaattctgaattattaatgccacactgtaagcaaaaagtacatccatgtttgaatggttgaagacgaagcattgcctttgagaaagaaaacagtacaataccgcaaatggttccttacagcaaaagactctgcttccttacatagttctagagaattctagcctcaccatttcttgagctacacctacttagaaaccttagtctgaccttttctaagtatgaaagatttgccctttgtccttatgggaaaatgagagggtttggtaagacctgctattaaccttcattaatctgcatttttagaacactaacaaaatcccattcctagaatgtaaaagctaagtggcagatactctatcttatttatcttttcatcactattacttagtatgatgcttgcaaggcacattaataggtgctcagttagcatttgtaaactgaatggatttcaagtccgctaaccaaaccagcacatatcaaatatgtgattacttttaaggagtcatgtttcaaatgggtcatttaattcatgtttcacactcttaggcttgatatccaagttatcttccatcattttgcattacatctattacaaaactgatagaaaccttgactgctacatttggagaagttagctaagcaccttattgagtaataatataaagttttgttaaaccactttatttaagggtgacttatattcaaaaaactctgcatatttaacgtatatacttgatgagtttggagataagtatacagccatggaactatcgacagaatctatgctataaacctattcattacctccagaaatttccttccaccttatttatttatttatttaggtgattgtggttttgatttggattttcctgatgattagcaattttgatttggattatgatgttttacataacaatggaaaatctcgtctcagcaaaatgttaagtatataatacattaactatacacattatgctataattatacatataattgtgttgtatagtaggtctctaggacttgttcatcttgcttaactgaaactttgtacactttgactcacacttctccacttccgtcttcccccatttcctggaaaatcaccattctactctcttgcttctatgagtttggccattttagatttatcatataagtggtgccatgtagcatttgcccttttgtgtctggcttattttgcttagcataatgtcctctgggtacacctgtgttgttgcaaatcgcaagattgccctcttttttgaggctaagtaatattccattgtatgtatataccacattttctttatccgttcaaatttaatggacatttaggttggacatggacatggttgttagtattgtaagcaatgctgaaataaacataggaatacagatacctctttgagatattaatttcattgcccctttggaagcaggattgctccatcaaatgatagttctatttttaatttttcccttttattgatatataataatttatatagttacagggtccatgggagtgtttgttgcaggcaaaaattatataatgttcaattcagggtaattggagtatcaatcatcttgaatgtttatcatttttagtgtattggtattctttcaagttctctcttgtacttatttcaaatatacattatattattgagaagtatagtcaccctagcctgctatcaaatattagattagaacttattttatctaactgtatgtttttaaccctaatcagtctctcttcattcactcccccgctccccactgcaacccttcccagagtctggtatctatggttctattctctatacccatgaaatcaagtcttttatcttctataagtgagaacatgcagtatttgtctttctgtgcctggcttgtttcacttaacataatgtcctccagttccatccatgttgctggaaatgacatgatttcattctttgttatagctgagtagcattccattgtgtatatatatattacatttcctttactcattcatccatcgatgagcatgtaggttgattctatagctttgctatcacgaacattgctggcagtaaccatgtgagtccaggtatccccttgatacactgatttcctttggatagatacccagtagtggaatggttggactataaggttggtatactttaagttttatgagaaacctctctactgtttccacagtggctgcactaatttacattcccaccaacaacatatgagttacctgttctctgcatcctcaccagaatctgttatttttggtctttttagtaatagccattctaacttgggtgagatggtatctgattgtggttttgatttggattttcctgatgattagtgacgttggggcatttttttatatatacccattggccatctttatgtcttcttttgagaaacaactattcgtgtccttttctcatgttttaatgaggttttttttgaaactgttgagttgtttgagttccttatatattctgtatattagtctcctgtcagttagtaatttgccaatattttccccattcagggggtggtctattcactctgctgatggtttcctttgctgtggagaaacttttaaatttagtattatccccccttttttatgattgtgcttttgagggctttgccataaaatctttgcctataccaatgtcctgaagatttttctctatgtttcttctagtagttttatagttttgggtcttaatttaagtcattaatgcatcttttgagtttacttttgtgtatgatgagagataggggtccgagtttcattcttctgcatacagttatctagctgtcccaataccatttattgaagagagtatgctttccctagtgtatgttcttggtagctttgttgaggatcagttggctgtaaatatttcaatttgtttctgggttctctactctgttctatgggtctatgtgtctgtttttataccaataccatgctgccttgtttaccataaccttataatatgttttgaagtcaagtactgtgatggctccaacttgtctgtttcttctacaatttttttgtgtggtttgttcttgattttctagctccttgagatgcatcattagattgttgagatgcattattagattgtttatttgaaatctttttggcttttttatgtaggcatttattgctaaaaacttgcctcttagcactgctttgtttttgtgtcccgcaaaacaaagtatattatgttttcatatgttgtgttttcattttcatttgcttaaagaaattttcctctaagaactgttcttatgttgctatgcccatattggcagcagtgggatgagcatgcttgatcttgggccccagaacagcatacactggcaccagtattagcaggatcagacagactgattcttaggcctctaggtggctgcttgcttggatgctggtagtggcagcagtggaccaggaaagtatgtatctctgggtcttgatcagtgtgcactggtgttgatagtggctgtagtcagagatcaccattcacagccccagacacagagctcgcaggctgtcctgctctctgcagcaacagttctgtagaggtggggaaggaccctgcctgtcacacactgtcctggacgctggggccacaccatcagtgggggcacagttgtcattcatagccccacacaggtagcctctgttcatgcacctcagcctccagtggcagcagcaatggctgtacttgtaacagtgtgcagacggaaagaaggcatcctactctgtacatatgaggcctagcagagaggtcattttgctggtgagaggggatctcactctctgcttgcaaggccaagtacagaatttgcactactgctggagacagagtcacttctcatagtcccagacagggaggtcttggcctctgaaaagcatgtgctttgtttcctttgtcccacggatggtgcgctgtaccatcctttccccaggaaatagtactccctgtggattacagcagcagtccccaacctttttggaaccagggaccagtttcatggaagacaatttttctacagatgggggtgggtattggggggagatactttcaggatgaaactgttccacctcagatcatcaggcattagttagattctcataaggagcacacaacctggatccctcaaaggcacagtttgcaatagggttctcgctcctgtgagaatctgatgcccctgctgatctgacaagaagtggggctcaggtggtaatgctcactcacccactgttcatctcttgctgtgtggcctggtttctaacaagccacggtcaggtaccagtctgtggcccagaggttggagacccctggaccagagtactggggactatgcagaatcttttgaaccaaccaacactgtgccactttagtggacactgggtggacactgagagatgtcagttggggctcatgggatgtagagatatgggggctatgattcccagggcaagatgcagtcccatggcaactgtgccctcacaagggtgcccagctgctgctgcttaggtcttggcagggacaggaatgagtgacaatgtgcaagtcctctttctggagcaatgtcctcatggaccctgcaaatcactccctatgctagcgtcagggtttctgtgggcgtaagaactctcccattgctcaaattgcagcagtccacagtagggatgtggactgctgaattacgctttacctacaataccaagccccttggggctcccaagccaaccttctctgagctggctgctgggtaccttttccttctctgcctcaggtgtttcctgtggcatctctgttagacatcagtattctttcctagatgttctattcaaggtatgattatctattcataattttggtgcttccttctggagaaggcaggtgcccaatgtctgtagttagccatcttgaaccagtgttcttatttttaaccttcaggaacttccatagtgttttccatcgtgcctgtaccaatttacattcccacaaacaatgtacaagggttccattttctccacttccttaccaacattgattatcttttgctttttgggtaataagcatcctaacaagtgtgaggtgatagctcattattttgatttgcatttccctgatgggtactaaagttgagcaccttttcatatacattttggccatttgtataccttctttgaaaaaatatctattcaggccaggcgtgatggctcacgcctgtaattccagcactttgggaggccaaggcaggtggatcacctgagttcaggaattggagaccagcctgaggaacatggcaaaactccgtctctacaaaaaatacaaaaattagctgagcatggtggtgcatgcctgcagtcccagctatttgggaggctgagttgagaggatggcttgagccctggaagcataagttgcagtgagctgagatcacgctactgcactccagcctgggtgacagaggcagaccctgtctaaaaatcaatcaatcaatcaatcaatcaatctattcagttcctttgctcatttttaaattttgggtttttttcttatttttcatttttaaattttattgtttttgctattaagttgtcgattttgtttatattttttggatattagtcatttaccaggtatatagtttgcaaatattttctccaaagctatgcctttttattttgctgattgtttccttcgctttgcagaagcttcttagtttggtgtaatcccacttgacagttttaggttttgttgccagtgctcttttgtgtcatatccaagaaatcattgacaaagccaaatataaaattcttaacttcaccaatgaggcagttttgacttcatgaggttctgaaactttttcctagagttgaatcaaataatacaatttaaattcctaattctttaacaaattaaagaaaaactatttcctccaactatagtaaggcaaaattttggctattaaacaactgaactctttttaataatgtgtgaagctaataggtgcctgatgggaccctattgctttgaggatctaattgcagacagaactatttattctttgattactagacttgtaaagcaggagttcaggaataatgattagcaaacaagattgtgcaggaatttgaagaataaattgacatatatcactgaaagcatacaaagtttcagtcaggagccatgaacccaaagcatatactgttctaggtacattacaggtgaaggtcgctgcattacatttaagagcctacgggcccttaaaagtttaacttgacaacagatgttagattgttcaagtactctaaaaataatcccttaatatatctttgtaatacaatagcacttgtattcctaaaataattttataaattttataaataataaaataatttttaaaaaatttgaaataaaatgaaatataatcctataagagattcattgaatgtttttaaaacattttatttatttatttagaatgcattttaacctactgaaatccaatataaataatatgtagaaaatagttataaaaaacaagttgtagttgtagaagacattaatgttttagaacaaagtatttcaagcttagtgttcaatgtatatgtgatgctaaggtcattatcatttggccacagatataacctatgagtaaaggagagtccttgttttttcataacctcttctgaatgcaacatccctctttataataggcaatattgcttccaagttgccatattcttaaaaaggcactgagtaagatcattgatcactgatatttgacatatttatgtactgaagagcacttttgtggaaaattcttccctcaattaattagatatgtttatatgtttatatgtaacagaataaaaagggaagatttcattcaaataagggcatttcaccagcccttttatgattatatatagtaatagttttttactatttaaatggctgaaaggtaaccacttttttaaaaatgttttttacatatatttctgttttaatatcctattatgggcagaaatgaaatgggacttaaattcaggttgttaccaatagtctaagattctaagtgcatcactatttcatgtacgcaaatattggctgagatttagcagaggtattgaaccagacaaatctatttatgcagtggctgttttacatttcttctatagagtattggcttcatgctttttgttagcttcagtaccttttgtccaaaccaaattactcacaagctgaaatgtaagacaattcaagattaaaaacgctatacaatcaggcatcacttaatgaaaagataccttctgagaaatgcctcattagacaagttcatcatagtatgaacatcacagagtttccttaaagaaacccagataggatagcctactacacaactaggctatacggtatggcctattgctctcgggctacaaacctgtgttgtatgttactgtaccgaatgctgtaaacaactgtaacacaataagtatttgtgtatctaaatataaaaattaagtagagcaaaaatgcaataatgcattatataagataaaaattgggcacacatatatagggtagctccattaaattctcatgggcgccctgcaatatatacagtccatcattgaccagaaacataattaaacagcacatggttatctttgacaggagggtgctaggcataaggggccagaagcctactggcttttaattctcctgtgaatggaaaatataatgtaagtcaaatgactatccatatagtatgaagtcataataccagatgactatccatatagtaacccatgtataatccctaaatcatagtacttgttccttatctatgcctctttctatttgccattttctgttcctaaatataactttcctatttttcacttctactcccacagtctacacagacgcacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaatactagacaaatatcttgattaaagtaaaattcaggtagcaatgttaaaacttttcataatgtaaacagctatgcaaagcatgacttttgaatttatatataaaatacattttcaaagacacagatactgctatattcattttgtgtatactgaatgttatttctgacattcttttagattcttgatagtaaataaatgatattttggagagtactaaagcttatttaaacatgatttgatgttcaatacaactaacaaaattgtagtggaacacaatgatattataaaaatgaagcttcatttgggaaagcatttccccaggtgggaataaggcattttctatgactagtctaaataaaagattcacttttccttgctttattttgggagggtggaggatggtagaaatgcaatttcaagtgaatgagtgcattctatttttcctgtttttttttttttacaaatgttataaaatcacacacacacacacacacatgcacacacgcacacacacacacacacacagagtatcttcatccatttttatgactccttagagataaaaggggttgagaaacatggtttggatttagttaatatttcctaaataccaaaggaatactgtttttcataaaataagggtgatactttcaaaactgtgctcagagaaaaatcaactgacacattttttaaaagaaaagaaaaaaaagaaaaattcaaaaccctttattagtttagaaaaggaccgttgtcaataccctgagttctaccaaattcaattttggctatttagtacaaatctgaaggagaatttttttatgctcatcagtcaggtccaaattcaaggagccattatcaaagttaggaatttaaacaacgctggaattcaataatgtgaaaatactactgattatttttataggagttttattctgaaaagtatgaagtatttataaataatatttcaacattcttttttttgaaagatggaaggtgaagttagtaacgggtaagttattatttgaatctcctagcattcagtccaagctttcaatactttaaacctaatatgatgtcattctaaaacccacgaggagtaaatgtgatttgtattgtattctacattcagtatgaagtgcacattcatgatgttgataaccttatatattagaactatatcatcatttcctataatataaacaaagaaaatactaaggatattaaattgaataaaaataaagaacatttacatcttgatgcttaggtaatgataaagattataaaataataagaaattcattgactattcccagccatttaatagtaacatcacaatagttgaagaatgaatgcattggtttgctaaggacaatgtccttcagctccatccatgttcctgaaaggatacaaccttattctatttttatggctgcatggtattccatggtgtatatgtacaacattttctttttttttttttgagatggagtcttgctctgtcgcccaggctggagtgcagtggcatgatcttggcttactgcaagctccacctcccaggttcacgccattctcctgcctcagcctcctgagtagctgggactacaggcgcctgctaccacacccggctaattttttgtatttttagtagagacggggtttcaccatgttagccaggatggtctcgatctcctgagctcgtgatccgcctgccttggcctcccaaagtgctgggattacagcgggggagacaccgcaccctgtcacaacattttctttatccagtctagcattgatgctcatttaggttgattccatgtctttgctattgtgaacagtgctgtgacaagcatacctgtgcatggtctttataatggaatgatttaattagctaggcatggtggcatgtgcctataatcccagctactcaggaggctgaggtagaaggattgcttgagcctgggtggcagagattgcagtgagccaagatcgtgccactgcactccagcctggttaacagagagataccctgtctcaaaaatcaaaacaaaacaaaataataggacaatttatgttcctttgggtatatgcccagtagtaggattgctagatcaaattatatttttgcttttgggtctttgaggaatctccatactgtcttccacaatggttgaactattttacactcccaccaacagtgtgtaagcattcctttttgtccacaaccttgctagcatctgttatttttttgactttctaataatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaagggggaaaatccacccccatgatccaatcacctcccacctggcctcttccttgacatgtggggattacaatttgagataagatttcggtgggaacacaaagccaaactatatgatagccattctgactgttgtgagatggtgtctcatgatggttttgatttgcatttctctgatgatcagtgattttgagctttttttcatgtaattgttggccacatgtatgtcttttgaaaagtgttcatgtcctttgcccactttttagtgtgttttttccttgtaaatttgtttaaagaaccaatgtattctgccatgttaacagaatatcacagttggaatttatactttacaatacaagcatgttttgtatttttttgagataggatcttgctctgttgctcaggctggagtgattatggctcactgcagcctccaccttctgggctaaagcaattctggcacctcagcctcccgaatagctggcaatacagatacataccaccacacccagctaatttttgtattttttgtaaagacaagttttcaccatgttgcccaggctggtctgaaactcctgagctcaagtgatccacctgccttggcctcccaaagtgttaggattacaggcatgagccactgtacctggcctatttttttaatcaataaaaaatttctgtgtgttacatatataattctattataatttacttttattaatgtaaatgttatgacatgtatgatatgctattttggaatctcatttgagttagaggtctttatcttaatgcctctcttaatgctatgaaaacaaagcattttttataactaagaagacagagcctccttttgaccgtgtctttgctactatcctgtacttggctgtcctttctgttgtaaattaaaatagatgaaggctgtcgagccaagccaatgatggaggctaatttaatgcgatataattgatgaactctaaattgttccacttttcccttttgaaacacactaagtagagcttaaaatgccagatagagtattttgatttatgctctttgtcacattaatactgaaaaactcattgtagtgatagagaaatgggaattaaccctttatagatactttcatagtttctgtatatttggctgtacaacaatcagagaaatggacccagtttaaatatactaccagaataaccattaaataataataagaagaaatgtaatgaagaggctactaatttaatgctcatgaaactagttaaatgatatgaaaacaaacaactctaacagaaaaaaaatcaaattaagtccaagtaaaatactggatttatatccacatgatttttgtgaattttgctaaatctgatgcccttgaaccagaatacatggagaatttacaaataaggacaggggaaatcatgaaggcattttaagatgatgaattttcttaacatgtggcatactgatagagttcagttgaacataaagttgctacagttgttgctagtgtcaagaagaaatgtgggctgggcacggtggctcaagcctgtaatcccagcactttgggagtccgaggcaggcagatcacgaggtcaagagatccagaccatcctgaccaacatggtaaaaccccgtctctactaaaaatacaaaaattatctgggcatgatgtcgtgggcctgtagtcccagctactcgggaggctgaggcaggagaatcacttgaacctgcgaggcagaggttgcagtgagctgagatggtaccactgcattccagcctggcaacagagcgagactccatctcaaaaaaaaaaagaagaagaaatgtgagtagaccaaaaaaaagagcagctatccagaaatggccattactagcaatattcgtctcagtgctttttgtattaagttattaaattttagtaatatttaaaagttaacaaagtagccagataaactaaatacactaaaggaaatttcatatttatatacaccagcaacaaatagtaaatatgatttttttaatctatattagcaacaaaaatggctatttaggaataattttaacagatgctcaagattgttatgtagaaaattatgaagtcataaaattgtaaagttttataaagctttgttgagagggattaatgatgactcaaccaaatggagaggaatagctactttatggataaaaagatctagtaaagtcatcaattctactgaatctaagaagattcagtgtagtaaagttatcaaattgatctatagatttaataaaattcccattgcaacatgtttttataaaacatgaaagatagttctaaaatttacatggaaaagcaaagtatcaagaatatccaagacactcttgaccaggaagtataagattagatgacttgcctttcaagatactcagttttgttttgttttttaataaaactagagtaattaagaaatgtgattttttgcgtaaggataggcaattagatcaagagaacagaataaagagttcaacaacaaactcacatagaattaaaaacttgatatgtgtcactgcaaattattgggagtaaaatgaataaatgagagcttcacacagaaacataaatggatgttagaaacataagctgaagtgaaaaaagcaagatataaaggaccattcacagtcagagaacatttatttgtttgtttatttatttatttatcatttattattttaaataattgcagcttttattttagattcaaggatacatatgcaggtttcttacatgggtacattacgtgactgaggtttgggataccattgaccccgtcatcgaagtagtgagcatagtaccccatagttactttctcagccctttcctcctgctctctcatctctagtagcctcctctgtctgttgctgtcatcattatgtccatgagtgctcagtgtttaactcccacttttaaatgagaccatgtggtatttggttttctgttcctatgttaatttgcttaggataacggccttcagctacatccatgttgctgcaaaggacaagatttcattcatttttatggctatgtagaattccatggtgtatatgtaccacattttctttattcatctgtcattgatggacacttaagttgactcaatgtctttaccattgtgaattgtactggaataaaaatacaaatgtgtgtgccttttttggttaaatgatttatttcttttggatatatacccagtaatgggattgctgggtcaaattgtagttctgttttaagttctttgagaaatcttcaaactgctttccacagtggctgagctaatttacactcccagcaacactgtgtaagtgtttctttttctctgcagcctcaccagcatctactgttgtttgactttttaaaaatatgcattctggctggtgtgagatggtatctcattgtggttttgtggttttgatttccatttctctgatggtgagtgatatgaagcattttttcatatgtattttagccacttatatgtcttcttttgagaagtgtctgttcatgtcttttgcccactttttactggggttatttgacttttccttgttgaattgtttaaattccttgtagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattctaaatatatatgcactcaacgttggagcacccagaattataaaacaagtccttctagacctatgaaaatacacagacagctacacaataatagaggggaagtgcaacaccccactaacagcattagatagatcatcaaggcagaagactaacaaagaatttctgggcttaaattctatgcttgaccatttggacctaaaagatatctatagaaaactacacctgttaaccacagaatatacattcttctcatctgcacatgaaacatactctaagatcaaccccatgcttggtcataaaacaagtctcaataaatttttgaaattgaaaatataacaaccataccctcaatccacattggaataaaagtagaaatcaataccaataagatctctcaaaaccacacaattacatggaaatttaaaaacctgcccttgaattgacttttggataaacaacaaaattaaggcaggaatcaaaaaattattggaaataagtgaaaatatagatacaacataccaaaatttctgggatgcagcaaaagcagtattcagaggaagcttatagtgctaaacacctacctcaaaaaattagaaagatgtcaatttaattatctaacatcacagctagaggaactagaaaaacaaaaactaaccccaatgctaaagaagaaaagaaataactgaaatcagagcatagctgaataaagttgagacacaaaaatccatacaaagaatcaacaaaaccaaaagttggttatttggaagtataaataagattgatagactgctaggtagattagcaaacaaactgaagaagatccaaataaccaaaatcagaaatatcaaagatgatattacagccaatcctgcgaaaatataaaagttcttcagagaatattatgagcacttctgtgcacacaaattataaaatctagagaaaattgataaatttctagaaacacacaatttccccaagattgtatcaggaagaaatgaaatcctgaacagaccaatattgagttctaaaactgaatcagtagtaaaaacctaccaaccaaaaaaatccctgggccagattgattcacagctgaattctactagacatacaaaggagagctggtattcattctactgaaactattccaaaaaatacagcaggagagactcttccctaagcattctatgaagccagcatcaccctgataccaaaacctggaaaagacacaacaaaaaaagaaagttatgcaaaattcctcaacaaaatactagcaaattgaatccagcagcacgtcaaaaagttaattcaccatgattgagtagctacattcctggcatgtaaggttggttcaacatatgcaaataaataaatgtgattcaacacataaacagaatgaaaaacaaaaagtttatgatcatctcaatagacaccaaaaagttttcaataaaatccaacatcccttcatgataaaaatcctgaaaaaactagtcatcaaaggaatgtacctcaaaataataagagccatctttgacaaacccacagccaacataatactgaatgggcaaaagctggaagcttttcccttgataattggaataagacaaggatgctcactttcactattcctattcaacatagttctggaagtcctagtcagagcaatcaggcaaggaaaagaaaaggcatctaaatagtaaaagaataagtcaaattatctcgctttgctgatgatataattctatacttaggaaacactaatgactctatacttagaaaacactaaagactccaccaaaattctcctggaactaatcaacaacttcagcgaggttttaggatacaaaatcaatgtacacaaatcagcaggatttctatacaccagtaacattcaagctgagaaccaaaccaagaatacaatctcatttacaatagtcacacaaaaaataaaatacctaggaatccatctaaccaaggaggtgaaagatctctacaaggagaactacaaaacactgctgaaagaagtcatagatgactaatgaaaaacattctgtactcatggattggaagaatcaatatctactgcccaaaataatctacagattcaacactattcctatcaaactaccaaagtcatttttcacagaattagaaaaagctattgtagatttcctatggaaccaaaaagaaaaaaaagcccaaataggcaaggcaatactaagcaaaaagaacaaactatagacttcaaactatactacaagagtacagtaatcaaaacagatggtactggtacaaagacagacacatagaccagtggaacaagatagagatcgcagaagtaaagccacacacttatggccctgtggtctttgacagagtcaaaaaaaataagcaatgaataaatgactccctattcaataaatggtgctggcatagctggctaaccatatgcagaagaatgaaactggacccctacctttcaccatatacaaaaattaatgcaagatgaattaaagatttaaatgtaagacctcaaactataagaatcctagaagacaacataggaaacaccattctggacactgaccttgggaaagaatttataactaagtcttcaaaagcgattgcaacaaaaacaaaaattgacaagtcagatctaattaaactaaagagcttctgcacagcaaaagagaacattgttataaatatcaaaaagtaccaaaactacttatgacagtggttacctctggagtgataagcagggagataaaatagggaagtagcacataggttgatggatgatctagtaacattctggtttttaggttgagtggtgagttcatggatgttcattatcttatgtttttaatttaataaatgcatgtaacatgcattaacttaatatacaaacatatatgtagataatatataaacatataatcttttgtatatttaaaaatatatttaaaacaaacatattaaagaaatgaaagaaagaaaaccagaatgctctataaaaatagaatagtttgggggaattttctttccaaatatcaaaatttactgtggagctttctgaaggataaatcctttatggaactgaatagaaagtctagatttaggcctcttatcaaatatatggaaatttgatctacggcttgattttcaagtcagtgggaaaatgatagaatatttaattaatgatggtgggacaactgactgtggaaaaaaatgaaatagaatcccaatttgcacatgcacaaaaatgaatcccagatttattaaagacagtcagttttcacttaaaaggaagaaaatttttaaacttgaaaaagtataggagaatatttgagacaacagaaatgtattcttttacgattctggaggctataagtctaagatcaaaatatcagtagggttgtttccttctgagagctgtgtgtgcctcttcctagcttctggtgggttgctggcaatatttgacatttcttgacttgtaagtgcatccctttgatctttgccttcttcatatggcattctccctatgtctctgtctctctacattgaattgtctttataaggaaactggtcatcttgaattagggggcccaccccattttattgtgacatattaactaattacatctgcaatggccctatttccaaataaggccccactctgacatacgagggtttaggactttaacattacctttttggggagacatattttcaacccatgtaattgttatttttaaattgtatatatgagttatatgtactattttcaggatacatttaataattttatttttaggaaaaatattaagcagaataaatatgaacaataactattttgttccttaaactaaaatttttaagctaaaaaatgaaagctaacacacctaggttcgccatccctatagaatactttttgtgatatggggtatacggtcttgcctacctgtctagcttcattcccaccacattttcttatattctaaagaaagcaaaatattgactgttctatgctattttatagaaatattggtgtctttccatttcctattatagtctttctgcttattatatcctcatctttcttcttctatctctttctcctcctttcttcttccataaccctcttctctttctctttcttctcctagttaactccttcttctccttcacgtttcatgtggaagccttcccggccccactctccagtcactctcatatgagacagccctcctcttttgcttccatggctgcatgtggatttctctttcattgcttatttgatttatgtgtactgaagacagagaatctcaatgcctaggatgatccccgaaatctgatctgtactcagtaaatgttaattgaaccaaaccaatgatgttaaatatctcatttatgtttcatctatacctatgaccttggccatcagattgcctgcttcctctggatcctgagaactaaaaatactgtctgtatgcttctatttttcaagcacaagtacacattatagtgattcaaatactaatggatattttagcattacatctagaaattttcttcacttcccagaaaataagattggttaaaataatagaggtattgattttaaaaagcagggaatatgctgtatatttattacttctcagaccagtgatatttcttcatttttttatacttagtgaattttatctcaagcctcattttactctaaatctgttctctactacaggatagctccttgctttggttaatatttaactttttaaaatatatcacattaccttggtgagtaaaatatgcatgtactataagattaccatcactataaaattatgcaggtactataagattattgtcttttactgtaagattactgcactatagattactgtaagatcactgtcataataaaatatgcatgtcctataagattactgtctcccaaagatttcagatttgtagagtaaaatgctttcactattcttttcctttgaattaccaggtcagaccacagggattatgcagaaagtagtttatttttgtgcgttgtgtttggtttctttctaaacaatctaaacaactttttctaggcttaaaaaattagtttgtgtgctaatgcattacttattgacagacatggtcatatttagtatctaattagtggacagagttaattttttcacacttcttacattttcttatatcatcccagcctcaggccgtcttccacttagctgtcatattagttccctgtggctagtacaacacaattactgtaaactcaatgacttaaaacaagttattcccttgcagttctgaagatcagaagtctgaaattagtcctaccctgctgaaatcaaggtctctgtagccaagcccctgctagaggctgtaggggagaatccatgttcttgccttttttagtttctaaaactgcatttcttgcattccttggctcctggcccttgtcaaaaccagtactatcacatcttactttagtggtcacattagcttgacttcttctctagttaaatctccctatacttctgttataagagcactatgattacagttagggcccctcaggatgatccaggaaaaaatccccatcttaagacttaatttaatcacatctgcaaagtctcttttgccatataaggaaacttgcacagattctagagattaggacctggagattttttgggggtgggcattattcagcccaccacagctactatctgaccaaatcacatagtgcacttttatctgccacagctttaatttcccccatgaatttatttaataccaatgttgtcttccatttttacacccatttcaaaactctgaaatagaaataggttaagtgcagacatccgacttgtatcacactgaccaccagatggcaaactttgtcattatatttttaggcctaatctgaattaatttgacagcctgagtagttaaatatgccaatttaaagtcatgtatagtgccatgcagtttagatcaactgaagttttatcacactagatcattttttatgagaacagctacacataatcagatattaatttgagctactttaatggcttctgaaaaagattacttccttatctagctaacgtcaacaactaagcatgcttctatttcacagaaaattcttccaatgcagtctctcttagtttttgagtaatttcttacaaattctaaatttaattgatatgattaattattaatctcaattttaattacttatatacaggatttttcctagaacttgtttcattaatgaattcaactcaggcaggtactaatccgtgtcgcttttatcctgtagtatcacataatatataataaaaataatggctacaaataaggcagctttctaaaatagcaaaaattattattgttctactgttttccaaaatcattgcactcttatcgtatcagtctaaacaattcagagacatcaaaataacagctaatattcttcttctttccctcttacagaaacttttatagaaaagttcagaaaatgtatatttaagtaagttaaaattcatgttctaaagataacactttttgtatttcccaggcataaagatataggtatagatgtggatatcaatgatatggaaatataattgggatgattcgtacagtgagttttttcttcttttgaacctcattcacaatatcatattaagtttattggccctcccctattccatctccccgtatcccccaagccaaagtaaacattattccaaatcttatttgtattttaaatatatgtgtgattatatatgtatgtgcatttacctatacatatatatacacattaatttattctgatttttcatataaagttatattcttaacattttccaatgttattaagattccttgaaaaatttttaatggtcatatgatattttacctttttggtattccagtttaaccaaatagaccaaattgtctccaatttttcactatgataaatgacactttcatagaaacttataaatcttgcttatatctctcattatgtatttcattaatatagaatcttagcggtggaattactaggtcagaggatatgtggacttttgatgtttttgatatctgttggcaaatagctttccagaagggccaaaccagtggcattctcttaatactcttgccaaagtgcttcattaatttaatttttgccaattaggtaaaaatattccttgatgtgctcctgtttactaatttatgactccctttcaagttatttaaattatatataatgaaatttatataaaataatcattatccagcttactgcactaatattgaaaaggaacataaacatttgagatgatgaatataatttataaaggtggaagggattacagaatggaattcagagtcctctttatcttttagagtagggttctctggcttcttacttcacatagatcagtgttgtcaatactgtaatagaaagaaaatgagaataaaagtaacactattaactagaattttttgtgtctttagcttttagtaagtcccataattgctttgtaacttcttttccctgagaaaattggagcctgaactctcagggttcttatgaagatacaatcactttaaaaagtgtgatcttcctaaggggaattattgttttaacaaaatctatatacgttgataattttaaaatatttgaaaatttataaactctttcttcctttttaatactgtttgttagaaatggctaagatctttgtataggaaggggacataatttcaagtgacattatatttgctcttcctcttttgtttgcactagagaaagccttgccatatctgatacatcattgtctgaaggtatgcttgcgtcatttccaattaaatgttttaagtcagcagtatacagtaaattatcataaatgttattgtaagttcaagctgaaatgttagcaagaaaattgctaaaggatatcatttaagctcttactggttctgtgtatttgctaatgtctgtggtgtatattactttgacgagcctacagtgacttctaacttgaattaaaatacagttttggttaattttgttaaggtcaagacaagatttaaattagaatataatttgcttagttatctcactttttttgaagcaagtaagcaatgaattgggaaaataaattatgattgtttacttaagattctcagaaagggaacacacatgcttcgttgacaacagtggcatcagtagactgaataataatttatgctatattcattacttttttattcctgatggaaagaagagctggttaaaaggtagcagagaccagttaaatgttcaggtctattttaataatatttatacaaattcattgactttataataatttgcatatttatttgaattttgacctacttggccttagaattgtcagtgaatataaggcagtttctgaagaaagcccgaaacactcactacaatgctagaattcaatcggtatttgttggcatgtcacacattcagataccttgcatgtctaattattatatactgaaatatatgtaatgaagagcaaatatagtgaacaaaatatatattgggtgagcaaagtttatgtcaagtaaatgattgacacaaatgtagttctgcttttttggaattctggtatcacaaacttattccaatatatctgaagagtaaaatcttgttcctgtggttactgtaactaaaagggaatggaaaaggcagggcaggaaaagatttatgggattcagagatgagaaaatgtgagagatttgaagaaaaagaaggtagaaaagaagagcaatgtatagactttgacaaatgagaagaaataatgaacaggaatttatagtataaagaagaaggataaaagggtacatttagtctcacaaaactagaattgtacaataaaagaattattctaacccaaattatttaattatcacaatgttgttattcaaatcctgcacatcctttgtctcacagacatctgaaggcctttagtaccagtccagtccatgacaatgtcttttcctaaaatctcatcacttgtttatgctacttacttgacaactgattgaacacttgtaattctgagttgttctgtgattaaaatctgctattataagttaacattttatgctttaaatctcaattttctaagtagaatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggtttctgagaggggccaataattagcactcttttctttctctgggttctaaacaaataggaactaacagttaatttgaaaatactggtcaatatatcatttttattattgataaaagtcatgctgcaggacataactttgggtccataaaccaaattattttgctaattctgaactcaagaattaggcagattttgtcacctgccatggataatacattaaggtatgctgcctcctgtgggtaggcttcccagataagaagttatgagagacaggatccaaaccaaactcacatcatctgcaggcagacttgcttctaaaaggaagagaggcagattcatctgtagaattaatcacttcacctccttggaacacaatgagtaagagcaggagagaagctaggagagtatctatggaaaattcctcctcatcaaaattaggaatggcaaaagcttttcccctctaactttgccttgcatctgttctcttaggccactgagtttaaccataaagcctgtggtcaactatgtgagggaggagatcagcagtttatttgggcaggaggcgaattctaatgtcagctgctttgggcattatcctgagatccatggtggtcagttttgattctacactgagaagattctgaaatgggttggaacaggacatatatcaaatcagcttcaatgacactctgtatctgaagctggaaatttaccgccaacttatttcttatcttaaattatatataactctatggccatattaaataactctaatactagaatgtgtaaagatacatcagtaataaaattccaaaaacatagaaatgccctaattaaataaaatctcctcactttatcaacttcccaaggaacaatcattaaagtttaaaagattatatttcttggcaagttaaaaccataagtaaagtctaaaattattttgcctttgtgagttaaaaattcttcaaataaattccaaaaccattcttcagtatttcttattaaaatattaaacattcttcaatattagtctcagccataagcactcaccattcacaggaagagttgggattgtctgtttctcaccagaatgcctagagctccttcagtgtcaacactgctatattagttcaatgccaagccttctgtgggcctgattttaaataactcaaattattaataatacatggaaaattttcagagcactggccacacagtgaccaaatttagaaagcagaccaattcctaccctttaaatgagttatctcaggcaaaatgatatgcctaaacctaattcttagtgtggccaaacaccataccagagactcagtggtatctaaggaaagaagggtagattgtaaaccctgattttaatcttgacatgatactattggtctataaaagttgtccagaattcttgagctatgggtttaaatcccagtgggagaaatccctaagcaaatggttgattttggtattatgcatacttacctcttagagaaacattgctgccttcttgcaagatttagaaatttgtggctgggcggagtggctcatgcctgtaatcctagcactttgggaggccaaggcaggtggatcacttgaggtcaggagttcgagaccagcctggccaacatggtgcaaacactgtctctactaaaagtacacagattagccaggcgtggtgatgtgcgcctgtaatcccagctactcaggaggctgaggcacgatgatcgcttgaacccaggagacggaggttgcagtgagccaagattgtgccacttaactccaggctgggcgacagagtaagacaatgtttcaaaaaaaaaaaagaaaaaaaaattagaaatttttaatcatatcaacccagtcccgagcacatcttattcatgccttctcctccaagacagtatttttaaaactttagtttccatttatcccaaccctaaattgagagtgactgtgtttggtgaatagcacccatgcttttgtgactaactagaggcatttcaatcttattttgctgtggctgttgccactgtatgtctctatgactttacttcccaggaagtatttgtctctcctctgtcattagccaattcagagacaatctaagaccacatggtagagagtgaccttgagcttgtgttcaaactaaacgattgtaagtttcatccataggtcctatcttagtcctaaattaatttttaaattcaacaaatatttattgaacatcttctatctaccagatactttctagatgctgagattaacatacataaaaatccaagtactatcagtagagacaaactttaaataaacaagcaaaatatgtagcatattagatgatagagaataatgcggagaaaaacaaaacaaggaagagggaaagtggctgtgtgtgtgtgtgtgtgtgtgtttgtgtgtgtgtctgtgtgaagatgattgacattttaattgaggtggtcagggaagaagtagaaaatgaaattttaggtaaaggaactagtgttggctacttaagcctaacactaaccatttaaagctcatgcacattctgtttatatatatacacacacacacacacatatacacagtaaccatttaaaactcattcaggttctgttttctatctatctatctatctatctatctatcatctatctatctatctatctatctatctatctatctatctatctatagtctctccataagagattgaatgagccaagaaagctgtctagtcatcagttgctgaaggactggctaagacagaaatacacagatacgtttctcagttgccccaagtttgggactcactcctcatatatgtgtacaaagtacaaaaattaaaattcaagttccgtaaatttagaacttgacttctttgtagtttactatgtttggtaacagcaaatattctgctcaataatttccaaagcctttttttccatgtgattaagtcattgcctcagcaaagcttagaaatagttgcatttgcatagtaaatggcatattaaggccttggccctagttgaagcccagtgatcttcatttttgttttctggattgccccatcacttgttctatccttaaggaaatggagtggcttatttgatttctaaatttaagtgaaataaacagcatcagttataaagatgatgttgtaggaccttttccttagttcagctaaaaatggggtccttatcacatgaccatgaaaggttaggctcacagatacattgaagggtgggaaaaattgaatttattgggtgaaaagaaaaaaaaaaactcagcaaagtgagagaatttcctgttaacaggcccccatctcaccaattgactcccaggtaccaccctagaacaggagaggccacgttcctcccgctgcaaacagcacgaactttctgaggctccacccagtgtgcattcctcccattgcacaggcctgtcaaaggttctgccaggcggcccattttacttggctatctcaatgatattatgttctttatcttcactttttactttttaacttgttcagaatcccaagcggatgagaagggtctacttaataatagaaaccttatcagagaccccaacagttcaatagattcattattgattgctatgtaagtgtccatttctagagaaagggtaatgaagcatgtatttcttttctctgatccacttaaaattttcatcaaccaagaaataaatggcctgattatcaaatttagatatttatgggaaaattcatggaaaggaaatatattagaataaagagaatttgtagattaagtgtgaaatatatagaatatatttggtgaaagttaaaatgcttttggtaaagggaagaaaatcatagggttagatatgtcttcttagcaggaatatatcataagccaatacattcaagaaaatttaccagttggttggtgaagcagacaaaacacaggaagacgctgcaaagtttttgggagcatcattagaccaagagaggttgaatgagccaagaaatctgtctggtcatcagctgcagaggggctgactaagtaagaaatacacagatgcctttctcagttgccccaagtttggaacccactccttataaaaatatatacaaagtacagaaattagaattcaataacatatggtccaaaaagttgtattccagagcaagggctaaggagggtcaagttttgggtaagttttgcagtggacaaaggatggtttcacaaagtttgaaaataagggaaaacatgcctagtctgctagctagggaacttcttgggtatcatatacctcttgccacccagagtagacataataaactgaatgtttctaaatccatataccttatctgtcctatcttttgatatacgacatggagggaaccctggaatatgaaaaagcaatactcattcttgtggtggcttttatgatttttattgaattactagcaagtatggcaactcactatcttgattctctttgcccccaaagggcattgacctgttcaggggatggaatcggggtcaacatgaaagaaaacatgcagagagacaactaacacattggaagtttaaaggttcaaagagaattctgcactcaataaaaaaacaggttaaaaataatcacaacagtaaaacatgaaaaatgtataataaataccaatgtgaagttccgaatttagtttcaaaaatttactcatagacatgctaagtaaagaagacttgtcttgatcaaagttcacgtcaaggtattcaagggtcctagatgaccatctgtcaggaaagtcacagcacttctgagcctgctttaataggaacattggacttagtaacctccagtattccttccaaatctgggaatgagttactccaatgagcctgtgactttctcaccttctgatttttgtggtttaacacattgttccaagtacataagaaagccgatttatatcagtcatgagtaatctatgctacatcaaactgcccttcacatttaaaaaattcaaacaattgaaattcattttttttaaaaaacatcatgtctcctttcacaaaatcttaaaagcaagtcagattgcctattcatttatcacaccagttagtcaatgattattataggtatcttccaatggagacttaaaaaaattatatttagcagatgtcttcacaaaggagcattttactggagaaccattttttagcattttgcaatattgaactgaaaatgactccattagctaatagcaaaataatcccattttcctcaaaggaaaaaaatatctttaatatatgtattgattaaaaggaaaatgccagtgtgtgggtcatttacgtatccaggaagatttaagaacctcttgaagaacttcaaaattatagtcataaactacttaaatgttcaacacgaactccttatacactaaatgaaaaagctaactggattatgttgcatttagaattttttaacctagaagctagcatgttgtggctcagaattgaatcattagctttgcattaattcccagaatcagggagaaaagaaatctttcttcagtaaattacttcttggggttgggggaactactgagagattgatctgagctttgttgcagcaagagcctcaagtcataaattattggcacacaagcagaagtcagtgtgtcatttctattgtagtcagatgcttttatatttccactcgtcaaggttgacttgatcatattgtacacctcctggatgtccgagacatagcattcatttgtccctctctttgagagcaggacaggtatttctttcacaacttaaacctctaagtttaagaaatatactccatagtatgactgtgggggtattctatgtgtgaaaaattttttcgagtgcagatttcaaaatttgaaattaaccaggttctcatttttgctctttgaggagtaatatgtattaaaatccattctgaggatctagcttttaaatgaccttttcagtactcatccttttgctcattttgatttgctcagataaattacaaccacctggccttttgtattaaaaaaggttacatacaaaattgaccttttgatacttattgagggaactaggttcattgtatttgagattaactgctgttgctgttttctgaatgatgtcttaaataactttacttgaggatggtaaagcctatttcttgtgccattttgttccaggctaattctaacaccataggaatggactgtctgagatatacaaagaaaattatgttttagaaaataatgaatctaatttattcagctcctgtgtgcctaatgatttacagatgtgatttcaatgtatcttaatcttgataaacccaatattatactttggccagtctgcccttcaccatattgcttattaagattctagcttctttctgtctgtttcttgaatattttaagctcaggcttgcctcaaaacttggtgcttgattttcccgctgcctgaaatgttctttttttttttttttttttttgagatggagtctcgctctgtcacctgggctagagtgcagtggtgcaatctcagcacactgcaatctccacatcccgggttaaagcgattgtcctccctcagcctcctgagtagctgggactacaggcgtgtgccactacgcccagctaatttttgtatttttagtagagacaggatttcaccatgtcagttggccagtatggtctccatctcttgacctcgtgatccacccacctcagcctcccaaagtgctgggattacaggcgtgagccacctcacccggcctgaaatgttcttttctagcttcctttgttccattcacctaatattctatttgccaccctacattttctggcttctgtgtaattaggttggactgtgtgactatttctgataatgagttgtatcacttgtgggctgaagcactgaaaagtccgtacacgattcactagtcctttttctgccatgattcttcgggaagttttgggttgagatggaaagtgacaagattgaaacaatctatatggctgatttcccaaatgggaagttacctagaccagaggattttgtgtgtgcaaaaaataaacttttctgtgttcaactactgagcttttgggaatgtgtgcctattctgattaactattcagggtttcagggcaaatgtcatttctcttctgtaaccattctatctaaagcactttccctctgcactgtatctttcctctgagcattttgtttcccatagcaatttttttccataatacttttatgtatttgtttatgtaagtcaacgtcgaacaaacaagacttctgtgtgctgttaattatgattcttaagtgcccagagtatttttaaagttgtcaataagcattcatttttcaacattttgttttaatgtcaacaagtacaaaaagcaagataaaatactatcttgcaaaggtccattgaatttcctgttggtcaccagaaaagatagcctgtatcaagccatagcacagtttttaagactctcctagataaatccattttgcattatttcttttatcctgaaatgagatcatctttggcaaagtctttataggtaatgctatctgtatcaacacagaaaagatttagagtccgtattttcattttaaaatttcccgaagagtcaccttcaaaaattctgcaatatttttgcatatatggaggtgttcgtccactaacgaatagctttgttgcttttaactccaggctacataagtacttcctccaatagcagactatactatctgccagctgcctgcttccagttttctggcacatggttcagaagagtctctggtattttttttgctggcatggagaagcttgctgaatagaatcaaaagagtcaccccatacatcagttactagaaaaagggcatgcagtaggagctcagtaaaaattcattcaattaattattacaggcaaatttattcaccatggaaatcttgatatgagcaaactatcacatttttctacaaataggcttttattttttaaaaacgatgaaagaaaaaaacaaaatttttcctagaattttagtctaagctattcaggatcatcctttggaatttgaagtaaagaacttcataatttgcttccagtccttaatggagtttcttgacaaggcattaagactttacagaaaaatattttcttattgctaatgcatgaagacatgtgccacatgaagtacagaacttcatttctcattaaggaacaaaatgagatatgtgatcaagtagaagataaaaacaagtatacacaggtatatcatctgcataatcaaagttttgcatggaatattcatcttcagtgttatgaagacttaagtgattttcttttgaaaaagtgttcacaagttggaattctttgttaatgagaagtcagcaagcacacagttgacaaaaaccagggattgtctatgctggatcatgttagtgtttcacttagactaaaaagaaatgatgaaattctaatcctttcctaatttacttcaaaatactcagtgttagcaaacattagaaatttctggaatggatgtgataattagatagggatattattttacttttctttgtttgctccatactgcaaattagcatgatcatccccccgccaccaaaaaatgattttaccaaggtctatccagagatacaaagcttaactgatttgattaacaactttgtgatatgcttcaagacacagcttttgtgttgagaaaaattcaaattttggtaaaattctatccacccccccacacactctttttttttttttttttgagatggagtcttgcttttttgccccaggctggagtgcagtggtggtcttggctcactgtatcctctgcctctcagattcaagccattctcctacttcaacctcctgagtagctgggattacaggtgtgcgccaccaggcctggatatattttttgtattttttagtagagacagagtttcgtcatgttggctaggctggccttgaacgcctgacctcaggtgatctgcccgccttggcctcccaaagtgctgggattataggtgtgagccactgcgtctggcccctatcccttttaaattaaatttattttcatgaagacttacaaatggacagatgtcaggcaacccttccattttcttgacttcaaaatttaattacaaagaatcgcccctgtaagaagtactgttttgtctcccatgatgtttaagtaggaatggatagcatggatatgtaaagataaggaagatttgctaatgaagattattcattttctctgacatttcctaaattaacctaaacaatgacagcccatgcttaaaaggaccatacttgtaaaagtaaggtatattttatttaattcctgtcagtagaaaccttttaaaaataccttattacaaggaaatgatggtgatgctatcaggtcatgtagtttgtaccaccctgctcttgttaatattgacaatttccagagttccatgagactgattttacattgaagttatgatctacaatcagtatgtaaggctgatatctttaagaaacaagatcattcagtatagagtataggtggcattgcatatacaccaaagtttacagaaaaaaacaaagtttgagaaccagtgagctacatgaagaaaacaaataaatgaaatgtttccaattaaatgtctgagctttgaactaattctgccttgaagatcattttcaaattcttatctagcaaataggaatgtgtcagtaattctaaagtagttttgctggcttttagaatttgttcccttttgttttaagcattaatatgagttgattgatttatttcttgaaataacttaaggaagtagagttacattttggttcaggatgaggggctgttagcttctgaagacagcagtaagttaatgattgaatccactgaaattgcagggaaataattaaagtatcatctattagtgccaggttcatagacttttccagtcctcatctatttgccctttagaggtctgtgatctgcagtttgaggaatctctggcctagaggttctgtgaggttcctgccaggtctaaaaatctgtggagattgtgtcttggtcatatgaattatataatcagtgttatccaggtgacaacaagaccctcatttgttgacataatttaatccgttattttgaccttttggtttaattttactttgagtgataacgtatttactttgatacgcatagtcatgcttatactttctacatacattgacatgcatatgtactatatatgcattggtatatacatatatataagcttattgtattagtcccttttcacactactgataaagacatacttgagactgggaagaaaaagaggtttaattggacttacaattccatatggctggggaggcctcagaatcatggtggggggccaaagcacttcttacatggcagcgttaagagaaaatgaagaagaatcagaagcagaaacccctggtaaacccatcagttctcatgagacttattcactatcatgagaataacacgggaaagaccagcccccatgattcagttcctcccactcggtccctcccacaacacgagagatttctgggagatacaattcaagttgagatttgggtggggacacagtcaaaccatatcacttatatatgctattaacattttagaggatattttgaaatctatattttaatcaaagatccagaaacattttccgtttttcctttgtctttcctctgtctggtagcagacctgatgacagtgaaaggtaggtttaggttttggcacattactgcccaaatagcaaccccaaataactgaacaacctacctggaaaatctgctgtggctatttgacaatattttgcttttgaataatgaagaaaaaataactaatcttaaggttttatggaatctcgcattattaaaggccttctggacagtcactcaagtttactttgcaagttaatacaaatattgcaaaaataccatttgacaaagaaatttcaaaaatcattggaaatgaatattatcagccaactcagtgaatacttgtcagtgttagacaggtagaattttttttttatttttaagttaacacattatgtcaaacacagcatattgccggcaggtcaaagattataaaagcctagaaaaaaaaataacaactgtaacctgaataaagatgtttttccaaaccactcccataatgactaacatcactatctaggaaaattaacctcacactggaagactgaaagcagaagatttccaatatttttctgaacaagaatttgaaccttgtgccttgaagatttagttatataaaatggtagaaaaccatgctttcctaatttaatgatactaaaagttcttgccacttctcttctttacaccatcctaacatcaaaagaacaaaaaatgattttttacttgtattactgtatgctaagtatgtttgtgttaataacagaaagcctcttatttcatgaattgttgcataatcttttcttcagaggctttattttagtttgtagctcaaaactaatgacaaaatcattttgagtgctctttttatacctttccaaattgttttgaatataattgctgttagaaatattaatgcattgtgatgactttatggcagtttttttctatgatctttgcagtattgccataagctagatgatgaggaacaatatgaaatctgatattgatttgcaagacaggtccacaaaacatccccattctaaaaaaataaatgtctacctactttcaaggagaagacataaattctagaacatcaaaggacatataagagttttaaaagtttatgcataattagagtcagttttatcataacttgcctttacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttcttttggctttattgttctgctgaataattggcaatagcagattagttataaaacagacacatctgctatatggcttcttatgggtatacaaaatgttaagcttcattttatataaaacacaatcctggaaaatctattaattttcaaattttcttaagaaaatacgatacagtttttcctaattttcaggatgagtttttatcattcttagtcacaaatggtggaaggcagttccaaatctaaattcattttaccacaataatgacagtttccaactgtctcataaatttgcaaaacatttgttaaaagggagactagtagagcaaaatgtgtcactgttgctgaagaaaatgggcctgtggtaattagtgtgccgtcttctgagacaaaaatagtgcttgaaatttaacattataattgtaccaattagcagttattgagtgctcacaatgtgccagcctctgtgtggaacagcccaagtgtgttatctctttagtctcaaccttatgacttaaagatactattgctattcccattttatggagagaaagaatgagtgaaaggtctcagtaattagattatgatccaattgctggtaagttcaacagctgggatttaaaacaggtcctctaaggtataggcgtagtgtaggtactgttattatttatagatgaaaaaaattgaggcttagagaggtctaaataatttggttaagctcaaacagctaaaaagtggagaaactggtatttaaaagtaggacaattgttaagaattaggggaggagggcagaaattagttgcaaagataatcacgatttactccatttgattattttagggctatcacactaaagcaagagtgctacgagggaaaatgatgttctcttcctaaatttcacagtaagaacatttgcattagtctcccaaaggcagaaactcagctgtttcagcaaggactctctaactagtcttctactaggtgacacagaataaatttatttgtctaattctttatttgtaactttactgacacactatattgtgccctaattatttccattttaccagatttgctttacaaactatagtagtaaagtcctgggcaagaagaatatttttcttgttctttacataaagtaatttagtaggcattcagttcttaaaaactgatagaaacacaaagctcaggaaacaaactagaatttttaaatatactttcgcattctacaaatttaaaaattgaacaaaagtatcagtcactgatttttttatgagtttttgggagtcacaataatagattacagtccatggaactctattttttgtcaacgattgtgagtttggaatatttgttgatttatattacaatatgtgatattgagtattcattaattctattttgtagaccttatacttttagatataaggaaaaggcaagatgaggaaaaagaagctgttcattttgtctagcaatcacttgtcatatgagatgccgtttatatgctgaggagaacaaatacaaatggagataattgataatacaaatcttagaaaattgtgttcaaacacaaagtggaatttacaattttctcaagactttttgtacatgagtataggaagggtagattgtatatttgtgtgtgttgtctgggcatgttggtgtgtgtgtttttaccaaagacgaagaacctggtgtcttctgcatttactatccttagcatttgagataacattatgtttgcattttgcatagacatactattcagatcaatttcccattcctattgagagaggcataaaccagattctatttgccaggagctgtatttttaataatataattttgaagttatattaaagtgaataatttgataattcagatcacattcactttttactttgaatatgtatttttaaaatgaatttgttacttcaaaaaaatgtgatctacaaacttaaattgttacttattaacagttgcattatttctatcccatattgtcatgtgaatgttctctttttaataataaaaaccaggtattaaaacaaacattttaaataataaactgtcatggcagtttattatttaaacttctgcttaaataaataaacttgtgtttaaataatttggcctgtgttcctttatcatctacaagggaattttatgaatcttcactcacaggactacatccatttacattcaaagactagtagttaacattttaagtaaatgacagagaatctttaaaaatatctgtgaataatgaagccattcattgtgttcaaggattttgcctttcttcaataatacaattttcttctcattttaaagagtatttaattgcatcacacgtcctattttaatatttaataataattttattagctgtatagaatgagaagggcaagaattgcaatatctagtgctggtcatcaatttttttatcatgacttaatgaatatcataattacaaggagaggcaaaaagataaattagcttagtagttggttgggacttgctagtttattggttttagcctgggcacagcccagaatagtcacaaagagaaagaaacaagtatctgggggtgctgtagaagtccttgcacacaatttctgcaccttactaatcatgcctcattttgaatgataaacagaggctttgaacaaaattataaacactgccaataataattccttctggttccatagcagttcacaggggattctgatgacttacaaaacttagtcttggcaggtatatgttcctttaatttctattaatgcattttgacaacttttcattatcttttcttaaatatttttactgttttttttttttctttttcagctaagacaaaaatctgagttattttgagtaggaaaatttggcatagccatcactgtaataacactttttactcaagtagcacctctcacccgaggctttcagagtgcttttgagtacattgtattaggcctgcaggatggaggtcaggggaaaagttatttgtaggcaccgtacatttaaagcttctgtggacatacagccaaggccacggggagaaagtaattttcatctttagtattctagatatggatatctgtataaaatgattcctaacttttcaatgccatttgttaaaagagggaaccagatattgttgaatttcatgtgcttttaaacctattttaagataaatcatttttaaccccctccagcaactgcttcgagaacgacagcagatggccagccgtccctttgcttctgttgatgtagctctggaagtgggagctgaacaaacagagtttctgcgagggccattagaggtaggaacagcggtgctgaaagaggaccactgtgctttgcatatttattatattgcttctctaatctacatctgcttatgaagccaaacagagtctgattatctacagttgacaagattcagctacatatgttatgccattttcaaggcacatagttttaatagtatgacatgagctgtaaccaaagccactggagaatctattagcctaggcaggagtgacagactgctcacctggcagcctttctctgacagaggagctgagggaatttaagatataggtatgatcgaagaaacaaagcgcctatatttagtctttggagtactctgtgcaccaagttaacaattcacatctatctttattaacaaagtttacttagaaaaggtacgagtggagatgagttgcattttaattacatagcttcatttttgaatgttgaaaagtgaatgtttctcacatataaaatgaatatttttatttgtggttaattgctgtattattacattcctttattgcaaaggcagaaatagagtatgatgaaacagaaatcattatatgcaactaaatatggtattagaatccaaaagtaatacatgaagtggtttctgaaaataataatccctaaagatgcaaaattcggccgggcgcggtggctcacacctgcaatcccagcactttgggaggccaaggtgggcagatcacgaggtcaggagatcgcgaccatcctggctaacatggtgaaaccccgtctctactaaaaaaaaaaaaaaaagaaaaaaaaaaaaaaaaattagccgggcgtggtggcaggcacctgtggtcccagctgctcaggagactgaggcagaagaatggcgtgaacccgggaggcggagcttgcagtgagccgagatcctgccactgcactccagcctgggcgacagacagagtgggactccgcctcaaaaaaaaaaaaaaaaaaaaaaaaaggatgcaaaattcacaaattatgattaatgactattcaaagcattatgatgcatactaatttaattgtatgtttattacttttatttacttttatatgtggtaagatatatttaagtagaaaggttaagaaactctagaattgaaacattttattctcttttttaaaaatgtctttatttgactaattttatgttgccattttcagattttactttttgtcaaggaaaataaagaatggaaaaatagaatcattcaaaaacctaggtatacatataatagattctgtctgtagcatttttgttttttctgaaaaaataagacaaaatcacaactcatggatgctactcaaagggtcagtttttagaggaaatgaaatattgggtgcatgtttccctatgatttttaagacattttgtgtacttgattttttactactctagatcacaggttaccatggaagcttagaacatcaggaaatttgtgtgtatatcttctatttgttggggaaaaaataacaaaaaagaatgattaaatgaaagttacagcaagtgctctaatttcattttggttccttgtttcaaataacttttataaaaaactttcacacacagaaaacttagactatttttggactattataaattctttttatccccatctgtttaaaacattcttaaatactgctaaaaatcgagtaacaagagaaaaaaaatgtaagtaatgcacacatagactaaagaagaaaagaaataaagaactagaaaattcacaaactcaaggaacaaatatgacacagacatatgtcaccatagtttgtcagttgcacgttaatagtgttcaataatgtattgttaggtacccatgtgttcataatcatcatatcttcatgttctattttttccaaatgttggttctttctttatcattgtgaatttttaaccttaaattgtattttgtagagttaaaaaatgtctagccctactttcttttagtccatattttctgatattccttatttcatttgcaatttcgctatatccttttgttttacaactatactttctggaaaaaactgttagcttttttattttttcatttactctgttttttattgatgttaacactgacattaactactgttctaccaaggcttatttcagctaccccattttgtgtgtgtgtgtgtgtgtgtgtgtgtgtgtgtgtgtgtgttgttactagccttgcttctttttgtttttttttcccagcttctgtccataaactgattttcatctactaaacagaatattgcatattctatttttatgttgcttatagctaccctttccttatcaagattcatagtgatttttccctagctatgctttaatcttattaaaacatattcctccattgcccatctcaaataaaattaatactttagcatgctctcaacttccctctgtttctccttccatatgttaataccacctggaatttttatcaaaacgttatggatgtacttctttctttattatggcctatgtaaagaacaatgaactttatttgttctcctttacttttgatatctagttgtttgctcatgcatttcttttatttttcactaagattacctctctaaaagatttttttcaaagagaaactttgggtccagcatggtggctcactcctgtaatcccagcactttgggaggccgaggtgggtagatcatttgaggttaggagttcaagacctgtctggccaatatggtgaaacgccatctctactgaaaatacaaaaattagctgggcatggtggtgcacgcctgtaatcccagttactctggaatatgaggcaggagaattgcttgaacccaggagatggaagttgcagtgagccaagattgcaccactgcactccagcctgggcaacagagtaggactcctcaaaaaaaaaaaaaaaaaaaaaaaaaaaaagagagagagagagaaactttgtatggcattatctttgagaacctaaatgcctaccaatatgtttttctcacatgtacaaaacagtttaattgaatatgaaattttaggttcaaagttctcttctccacagctttaaccattgtctcaagtctgatgtcaatttgattttttgtcctttgtaaatgatctccattttctttttggaatttttcagtattttctcctttctcagtgttcatacatttttctccaatgtgtccatatgtgtgtgtatgtgtatatatacatatgtttcttatttcttcccaagtaataaaagatacacgtaaatttacgtatttgctagatcggcagttgaggcgggaagaagtgaatgtttagggttatctagccatctgcttttatagctatgggatttcttccctgagatgagccctataattaccctgtcatcagtgtattagtcagggttctatagagggacagaactaataggagatatatagttgtgtatatgtatatattctatatatataggagtttattaagtattaccttacatgattacaaggtcccacaataggccatctgcaggctgaggagcaaggagagccagtccaagtcccaaaactgaagaacttggagtccagtgttcgagggcaggaagcatccagcatgggagaaagatggactaggccagtctagtcttttcgtgtttttttctgcctgctttatattctagtctcgctggcagatgattggatggtgcccacccagaataagggtgggcctgcctttcccagcccactgactcaaatgttaatcttctttggcacatcgtcgcagacacacccaggatccatacattgcatccttcaatgcaatcaagttgacactcagtattaaccgtcacaatcagtctccagccttaggctggcacttgactggttctgctgctttcctgccccacagcaggtgggatcggtaccaatctatccaggacaatgtggactgtggcccatattatctccatgtttaaaatcaggagagggaacaaatgactcattctgatttgctattttgttgtctgtggggtcatttttgcaagtacttggtataacataaagcattatattaattgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccgaaagaaaccctatgcctttcagcagtctccctaccccacatttttcttcagcccctgcccccccaccccacacccatctcctagccctgggcaacgattaatctaccatctttacagattttactgttttggacatttcatacaaataaaactatatacagtgtgatcttttgtgattagcttctttcgcttagcataatgtctttaaagttgatacgtgttgtagcgcctgttagtgcttcattcatttctattgtcaaatgatattccattgtatggatgtggcacagtttgtttgtacattaattagttgatggttatttgagttgttttcaccttttggatactatgaatgatgccactgtgaacatttgtgtaaaaaaaattgtataaacatgtttacatttttttgggtatatgcctaagggtggaattgctggattatatcgtaactttttaccgcttgttgaaaagtactttctttctccattgaatagtctagggacccttgttgaaaatcaatttaccataaccatgaggatttatttctggaatctcaatattattctaccaatctatttatctattcttatgacagtaccacactatcttgatgactctacctttgtagcaagttttggaatctaaaagtgtgagtcatccaactttgttctttttaaagactgttttaaagattgaatttcaacttcctaggtcttgggaatgatcaaaatgtttaaattgaggttaaaacattatttttcaaaattcctttacatacactatctcaatctcatttgagtcttaagtcaatcctataaaataagcagaacatatttcatcttttttttctatttactattgaggaaactgaggctctgagagcttcagacctatgctgaagatcacaaattcagtcaccagtagagcaagaaccagggttcaaatctcatattggcctaagggtttctttcccacattgctttttatatatgctgattttcgttcaaattgagaagacatcttagaccttaatatatctatagaattttttttgtaaggaatagagttacttaaagttcatgtagtatactttgattccaggtgctcaaatagtcatagataattgtggatcttaaggaagaactttcacttggaaagttataggctgtcttagtatatcagagaattccagcagttatccattgtaatctaaattgctataaagaaatcaaagtgacttactaaactgcaataaactcagcacacaagctttcttttatttttatattagaagtttcttataaaaataacttttgtagttttgttatgctaataaagtaacagttctgtagaaacaaagtaatttaagattgtttatttggtaattatagtcaagtaggctaattaataattttaaagacagttgtttacagcatgattaatttttaccagactaattatttcattagtattctctgtatatattttaactactttataccagaattttcattttacaaatttgtaatgttttgattctctccacctataaagaaaattatagctttcgagtactataaagtggagttttcaaaaagacactggacatgtaagaagcatacggtaacctagaaaaaattaatttcgaatctactttctatttggtagctctaacagtgctaattttgacatcacattgaagttcattctctgtttattgggacagttcagcctcgtatcttatgtaagaaacctcgctcccaaggtgaaaaacgcattgttcaagtctaaggcagtcaaagtgaagcagctgtcctattaagagcattgatggcctcattcctggaccacattaagcccagtcctctgctcttgggcacagccagtggtccccctggttcctcattcctgtcctgccatatccatggacagtagttccagtgactggcctaagcagcttatttaattttccccaggtttccttttttcttatagctgatttgtgatatttgatatttttaattattatcatttactgttaatattctgattatgtaaagaatacatcctcattatagataaatattaatgtaaaagatataatacaaattaaaatatttcattatcccattacccataaatattcagtgccagaacttttatttctttccaataacattttcattttgcatatttgtatttttacaaaattgagagcatattttatagtgattttgcattctgtttttctcagtattagaataagaacatttttcacatctaagtttgattcaaaaatacattttaattattttgtggtatatcatcatttatttgcctattctgttttcaattagcattattctaatttcacactattataaataagactgcatttcatttttgtatataactcgatcttactttatgaaaaaaaacctactgaatcaaaagttattaagttttaggatcttgaggtatattgcttatttactttctagaaatgtcgctgttcacactatctttagcaaagtatgagaatttctattttcatgcatccttgtcaaaaatgattgttggtgtttttgcaactgttaatttgatacaataaatgttaccttctttcttttaatcaaatttttattgttagtaaaattgaatatttttgtattgtctgtaaccatttgtatttttcctagatgttcatttgttgatcattattctctaatccttttctattttaatagcatttattgatagtcatctgattatatgagaaatattgtattaattctagaaaacttagaaatgatagctcattcgatatctttcttcatctttctattggaacattccttgcctttttacttctagatcaaatatattaagcatttgtaaattacctgctataaatgttttctctctttggatattgattttaaatgctatattttctctacttttaattaatcagcttattgtgtcttttggtaatatttttcagaccctacctttgctttattttcatcctgaatttcctattatttttccatctttaaaaaatattcccttttatcctcaattgatttgcatgttataaaatttatttattttagtggttactcttaacattttaacaggcatagtttaagtcaaaaattaatgaacatttttccctcttcccaaacaatataaatcttgcttccaatttaagaacaatttaaatcttgcttccaattttctttgtttttgttacctttgttaagttctatgagttttgtcattccttgaattaaacattattgttgttgtattatatgatcaatatgtgtttaaatttacttacatattgtgtattttcttggctcacagttgttcttcgccttcagagcttccttttaaaatgtttctactttcctgctctgtctttaagtaatgcctttagcatatgtcttttgataataaactctcttacgtctttctatttccctctccagtttcagtatcctcttattgtttacaatctaagaaatgtatttaaaatatactttatcaagcattctagttatctttcagtgggagggtcacactcacacattgtgttcacgtgaaaattgttctgacactggcttctgatttccgttgttgctgtagtaggtcccttcatatccccagggaatatgttccaagagtccccgtggatgcctgaaatatgggatagtaccaaaccgagatatacatacctatgataaagtgtaatttgtaaattaggcacaataagagattaacagccgtaactgataataaaatagaacaatattaataacttgccagcatcactactcttgcactttggggccattattaaataaaataagggtacttgaacacaagtactatgatactacaaagctgatgtgataaccaagacagctactaagtgatgaatgggcaagtaatttatacagtgtagatgcaggctgaatatgctagacagagataattcgcatcttgttccaagtcagaattatgtgcaatttaatctttttcttctggaatttttccatttaatattttcagaccacagttgactacagataactgaaaccatggaaagtgaacccatgcataagggaagactactgtactaaaaactttccttcagtatcattgtcactcctttatagagaatctagcttttctctccaaaatccctgtgtttggtgttcagcagttttatcacaatttaacaaagtatacctttatttgtttttaacctacttggcatattttgtgcttcctatatttgaggatccaagtctttggttatttctaagttattgagtcattatcccatttgtattttctttattccccttctaagactctgattagatgcgtgttaaacctctttccatcttcacaatctcttagtctttctgttttgttttctatctccttctcaatgctgtttcttttggcttattccgaacattgttccaattcactaactattttaagtgtataaaatctgtttttgacctgctttctactatgtccatttggattactatcaacacatatttttattactttctaaagttatattttattatttatttattaaagttctatttggttctttttttaaatctgacagtttttgaaagtctcttcttccttactgttttcattacttcatttttcattccgaataaaattatttttacgttgtatctgatcatttcaatatctgaaatccttggaaatctaaatctgttgattatttctgctggccctcaatcattatgactgatttccttgtgtatttggtgatctttatgagctcttatatgatcttagtttgtggtttgctagtgacccaaagaatgctttcctgcatagaggattgcttttgccaaaaaccaagggcctctctttattctgtagtcacttcttccagggtctctggaatagtgcaggaatctcaaactcagttttcctttttatttatttattatttttttgagacggcgtcttgctctgtcgcccaggctggagtgcagtggcatgatctcagctcactacaacctctgcctcgcaggttcaggtgattctcctgcctcagcctcccgagtagctgggactacaggtgtgtgcctccatgcctggctaatttttgtattttcaaactcagttttcttaccgtgtgagttgctcatattaacttttaccctcagggccactctgctgtcatatttgcttgctgctcattgcaccctctccagttttatctggttgccttggagcagttttatctggttgccttggagcattcccttactggctgcattctcagcaatgcattaaaaggtatacttcattgggtaggcacggtggctcatgcttgtaatcacagcactttgggaggcctaggcaggaggattccttaagcttaggaggtcaaaatccacctgagcaacatggcaaaaccctgtctctacaaaacatcccccccccccaaaaaaaaaggctgggcatggtggcatgcatctatggttcagctactcaggagtctgaggtgggagaagtgcatgagcccgggagttcgaggctgcagtgagccatgatcatacactgcactccagcctggttgaacagagcaagaccctgtctaaaaaaaaaaaaagaaaagtatacttcattaagcatttggttattttgaagtgggaaggccctacttacactatctgtagttgtctcctctggcaactctattttactgaacacaggttctctttggattgccattcctcctcctggccttggctcgatattttcattgtcaccaatttaagactcaggctttggcaagttgaaagggatgggaagggaggtccccttcacttgttaatgtggtagtagcatagaaacagtcaagccatccatttcctacagaccttttggtactcccccagtttcagagagaatgaggactcagacccccaattctgcttctttctaagcctcttggggaccagagagtccaggtatagtcttttaggaactgtattgacttttctcttggtgtttacagttctctctagaccaagcctctgtaaaattcttacactgggtcttgatgctggttcctatgcacttggccagtccaaatgggagaaagtaaggcatgagttccctccaccagagtttctataggacccaatccctaattgcacatagttgcctataggccccatgagccatttgccttaagagagggagatgattttcagttggtagtagacagaaggaaattgtaaggaaattgccaaattcttcataaaaaatgatttagaagataatgattttttttttttttttttttttttttttttgagatggagtcctgctctgtcgcccaggctggagtgcactggcacgatctcggctcactgcaacctctgcctcccagattcaggcaattctcctgcctcagccccagtctgtagctggggttatagacacccactacaatgcccagctaatttttatatgtttagtagagacagggtttgaccatgttggccaggctggtcttgaactcccgacctcaggtaatccacctgcctcgacctcccaaagtgctgggattacaggcatgagctgccatgcccagccatgattttttattttaagaaaattatttacaataaataagagatttttataggcacacctttggttcttgaagtgaggaaagatctagtttcccagctgcattttggaattttcttcatctttatgttaaaattataaaaagacctttcttcaccaaaaccatttagcaggcaatgttttggaaaaaatgttttggaaatgtcagatttgtagtattaacataaacatcgtgagtttcatgattgattgaagcatgaaataagaattaagtaatggtgcttcttcaatattaacatgatataaatagaactattaaaaaggtatgaatataatgtattactgaaattattgaaatctacatggttttaagttaatataatctgaactttaagcatgataaaagtcatttgtttacagtttaaataaataatttgataaatgccctaggttaactgtcctaataaagtaaattactgctatcatctttcattcagaattcactgagtcaaaagctaaatatatatatttataattattgtatacatccaaaattaaaattttacaaatgaaatttttcattgcactattgaaatattatttttatcttatcttaaatcatttaagatgaatataagctatgatggagaaaaatgtaaagatgaaaatgaacaacagcaacaacaaaaaactggtttctcttcactgtgtctgacataataaatagaaacatttggatgtacaaaaggcttatagtcctgatcaaccttattcatactggctgccattcaagagaataatgtattatttaagcatatggtcacatcacagctgaatcaatctagcataaactatttttatacagcatccttgcaagtaagaaatggctatgtaaagtaagactataatatcctttattggaaagttataaatacagtttaacaatgcttgggaacagtgttatagctttggataaacaagactgaattgccaacactgtcctccacccttcacctactgtcagataaaagaggtaacatattgaatccaccaaaaataactgtgctcaacagaatgggcagattgtatctcctgcacccaagaacattccacaatctatgaaacacagtagggtaaatttgagtattgtcaaaccctttgaatactcattcctatgtatgttaaaatgattgtgtttaaaacattaacacaaaagtagtattaacatcctaattaatacaactttctcagtaacagcaatcagctagtcatatttttggctcctgtttctaaccttttagattgtcgtgaagcattcattttatgtctggtagtatgcagtagttatttcctagtttttgtttaaatattttattaggctgttattgcctatgacagttacttttacactaaatttatgattttgcttaatatattttttgcttatgtttcatataaaatcagttactaatttaacttgtatatccttttttctgttacacgcagtaggagataatctcatcaggtttatatcctcaatggaatagctgactgtaagaatccttaaaatgctgttaaatcaaatagaatcttatgaagtgaaataccagatattcaaaatgtaaagctagatattttatgtgtagaatctaagaaaccaataatgttatactttagataaacattttcatgtgttcccatattttacttccttagaaaataaaatagcaactaggtcaaaatttagagtattaaatatgcaaatttacctcaaatcttaatatagattttttttcatcaaaggtcatagttcttacatatttcataccagagaccttttcttatattcacacttgataattttgtttatattattatatgtctttttaaatttgctttatagagaaaggctctggatttaccattaatgacatataaaagtggggcagaaagttgggtgcagcagcacacacctatagtcccagctacttgtgaggctgaggtgggaggatcatatgaggccagaagttccaggccaggctgagcaatatcaagatcctatctatctatctatctattttgtttttttgagacggagtcttgctctgtcccaggctggagtgcagtggcacaatcttggctcactgcaacctccacctcccgggttcatgcaattcttctgcctccgcctcttgagtagctgggaatacaggcacacaccaccatgccttgctaatttttgtatttttagtagagatggtgattcaccatgttggccaggctggcctcaaactcctaacctcaagtgatctacctgccttagcctcccagagtgctgggattacaggtgtgagccaccacacccggccaatcctatctctttaaacacacacacacacacacacacacacacacacaaacacacacacaatgttatggaatagactatcaagtatgtaaagtttaagtgcaattttttatgaaggagtttttatttcttgatttttttactcatcccagcacattttggaaaataaaagtaataacagctcagttttatttttccatattttaaactggaaattctaccttaaaaacaaactctatatactatgaacaattgtctccacaaatattgacctatatgcaaagcaatacaggaggtagatatggaaaatatgttatctttacctttcagaaacttacagactaacaagagagatatgtgcgtgtaaaaatacctctaataaaaatatgttattaatgccaaaaggacaataagcatgaagaagaggaaaaaggaatacaatactcaatgtattgctgaatgtttcaggaaaggttgtggtcatttatcttgggctttaaaggtacctaaaatgtcagtaggcagagataggaataggtgaggatggagacaggtaagaagcatgccaagttgagagagcaaggtgagcgagggacggagacagaaaacagggtggtatgtgagtgaggcagtgagaaggccacattcacccaatgaggaagcagctgtgagagttaaggtagcaaatataggagcatatcatggaagacaatttaaacaagatgccgaggatcacacagaaggtttttgagaagagttttatgattaattttagaaagattacactggcagcattttctagcatcaactggattgaagaataattgaggtagagaaacaatttggaagggcaggcgctgaactagtgattgtcaaaatgttaaggtgcaaatattactgaaaactttgacaatgtagaatatatagaatgtaagtaactgaatatagggatagtctgggtcaaaaagagggaggggtcagaaggttgggtcttcttcatatgtacttgaactcatgggagtgagaaaagagaattgaaggtagaatctaggaaaattgctacaaagaaacaaagattcaaatgacaggctgagaaagagtacagaattaagaagattgaagagttttagaactattagaattaagaataagactgcatgccaagaaggatggtgtggtaaaatatgtcatccatttcaaagcagtcaatgaagataagcactaggagaaaagatggaatttggtaattatgcagtcattggtggcttttgaggaagtaatttctattaaatggcagaagccagaccgcaagagatgtgtgaagatgagaaagtggatgcaacaaggatagatgacccattttgaaactgacaatattgaaaggaaggaaggacatgagatagtaatttaagaaattggcagtttcaagagaaagtttttttggggaagaaatattcaagggaaaaaatgtatagtaggataaaggggaggtgaaagcagagaaaggatcaagaagtcaagtagaagtattaattttagaaagatgaaaaaggataataaaattatgggtaaagatgaaagtacattttgagcctttctatttgataggagtttaccttcgatgatcttataatttttcacgataattgagaagtaaggtcacctgcagagagtgaacttgatgtacaaggttgaggcttaagaatagtaagagatgtagaacatttgtttcaaaggctatgatggttaagacaaaaactgagttatccatctcctttcactctattcttcattttctatctgtcattgagctctgcctgttctacagcctaagtatatcttaaatgaatctctttatcatcactactgcccctgtttcaagccttcatgatttttttcctgctctgttacattatcttccttactggtttccctgccttcactcttccaggcagttttccacattgctactaaagtaatctttctagcatgcaaatcttctcatatcaccttgctcagaattccccaatggcttctctattagtccattctcacactgctaataaagacataccccagactgggtaatttacaaaggaaagaggtttaattgactcacagttcagcatggctggggaggcttcaggaaagttacaatgaaggaggaaggggaagcaaatatgtccttctccacatggcagcaggaaggagaagtgccgagtaaaaggggaaaagtcccttataaagccatcacatctcatgagaactcactcactatcatgagaacagcatagaggtaaccactccatgattcagttgcctcccaccaggtgcttcccaggacaccacacatggggattacgggaactacaattcaagatgagatttgggtggggagacagacaaaccatattagcttcctatctcttatagtaaaaaaaaaaaaaaaaatacaactcttctatataatgtactatataccctacatggatctgatactaccattcctatccagccatttcttgtcatttcaccccaataagctgactccacacaacatccctgcccttgcctctgactctgtctctgttgttctcttgtcctagaggaaattgcctaaagtggtagtttaactaattcttaaagttcgaaacaaaagaaagaaataataaagaaaaaatgaatgagaaacattatcttaaggtgataaaaaggattgctgagcaacagtgaagcattgaggatatagaaattatgtaggagcacagtccctattcttgtgaataacagttcaagtagaagtgaaagggaaaactgatgtttaagatcttaaaaaatatttgagttacaaagtaattaggactgcctgattttgctttatttattgattattctcaattagatagatctgtgttttaattgctcaattatgcaactttcttattgtattttaatgcattaaaatactatgtgtattttattaaaattgtatgtgtattaaaatacacatacagtaactcagacttaaaaaaataacaaaaagaactttgtttagaaaaaatatagattttaagtgaacaggaaaaatctttttgtaaccacattgaaagaagttgttcagccagtatattgtacacatctacacatatgtttttattctaggagtaaatataaatgaatatgtattcaacatgaataaatgtgagtaaatattgagtattaatgaacttacataaattttttgcttataacttcctgttagaagaagcattctttcaaaacttttaaaaatgtattgcatatgtggcctcttaaatgtctttgaaagatacatcataacatctatgtgtttggaggaattttagaaatttttagaaactacgttcacaaaatagaatgattatgcctatataaattaaatttcaagcagttccaaataacattttattaaaagtacattaaattttgatgacctcattcattaagcaaaataatgtacagtgctctatactagacattccagatagcacaaaagtgcttatgacataattgatactctagaatatcttagaatctgctgttaaggatgacattaattatatcaccccttgaatcatctctttcttcttctgctactgcttcttctttcattctctttcagtctagttctcttactacacactatttctcatgtgttacaataacatgcaaatgatgataaacccaaagcaccataggatctcagaatacttttaattcatctaagtaagtttaatgttagtataattagtaataaagatatttcattatatttacattaatatataaaccctctttttgccataatatttgattaactatatacctctaatcagcctcccactgtattgaatttaatgtgagtgtatgaatatgtaaatgcacgcataatacatatacacagttttcatccagcactgaacgacaatgtgattgtcacaataattattttcctacatattcttgaattgtgagggcaatatagttataacatcagttgttaatttttaaataatgttagctatttctctaagaaaagtaatatatcttaattgtaaaattttgtaaaatgcagaaaaatatattatacaaataagaagcctcattcatactccatcactgtttgttctacaagtgtgtgcagtcatacagtgaccacaccaatcaagatatacaatgtgctcatcaccatggaaagcaaagcccatcactctgccccaagacccttagaaccacttatttgtgcctttatagttttgcctttcccagaacatcatgaaaatggaactttttttttttgtgaccgagtctcactctgttgccaggctggagtgcagtggcaagatcttggctcactgcaacctccgcctcccggggaaccatattttatgcagacttctgtgtcttgtttctttcacttagcacaatactttcaatgagctccaaccatgccattacgtatcagtagtttattctattactaagtttattccattgtatatccaccacagtttatttatccagtcaccagatagtagacatttgtatttttcaggacctggagctactgtaaataaagctatcattaatgtttgcatacaggtctttctaataaaatatgtttttatttctctcaggtaaaaagctatcagtaggatttctgggccatatggtaaaagtatgtttaactttagcaattttccaaagtgtatatgccatttcgtatttctccccacaacacatgagagtttcagttgcttcacaacctcaccagaactaggtattgttgagattttgtattttgttttgttattctaatgactgtgtgatggtatcttgttgtattagattggtgcagatgtaatggcaaaaactgcaattacttttgcaccaacccaaaatttggttttgaagagacgtaaattaatttccaacattggtggggtctggctacccatttataggtatgcatatcttcaaacgttagttttcccatagctatatatgcatagatatcaactgaggaatattctgtaatgaaatactaggggtggggaatatgtaatatgtgcttaaaaaacaagaatccaaaaattgaattttggaaaatatcttcataaaataaacagttgtatatttccagttcttatgaggccttcttagtgaaataactccattatataagaaaagaaatattaatatcaaaggttaatttttaacttttataagaaaaaactgagtgtacatagaaatagagagataagtcatatcactcaacttcgagaactgctgactcatggccaatcttgtttcatctttatgctctctcaccccgaacttcagcattgattattttgaagcaaatcccaggcatcaaagattaacttttaattgaatctcagagtttttgatttatcatattagtattgaaaataattatcttaaaatgtttaaatttttaaacttttagtattaatccctaaggttttagtagtctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttattgttcccaccagtgatcttcactattccaactagtgagaggtgtgttattccatctggactgctacaacaaaaataccataaacttctgttgacttataaacaacagaaatttatttcttacaatttcagggactggtaagttcaagatcaaggcactggcacattcagtatctggtgagggcccaactttcgggttcataaatagtgccttcttgctgtatcctcttatggtgaaagatgcaaacacactccattggccttctttcataaggacactaatctcattcttgagagtctggctcttataacctaattacatcccaaagacttcacctgataacaccaggactttgtagattagatttcatatgaatttgggggaggatacaaacattcagaccatagcaagagcgacatattctttgttgcccctaagcatgtaaccattcctacagtggttgtatctactggccttgctagtgaagcctgtaagtcatgtagaatgtactgctattgcttttctgatattatttaacaaagaaacctactcccagggcagccagcaatgttgacaacattttgacctctcctgaagcttccaggctgttttatacaatgaaggaagggtaacaggtcatcatgcttatctgatctataattcatttgattaatgttactgatcagctgcatcttttttttttttttttgcctctctgttgtaaattggtagggattgtagtttcttgttcactttggatttttccattacacatgcaaatggagatttttctttacataaataaatctttatgatcattttggttatttttaaaggtctggaacttttttctgtctctgaaagccctggacactcttttggtttcaatcaccctatgctgtatgtcactatttactcaccatttatataattaatataaatatttttcctcaatttctttttaaatacatttctcataaaacattttcacccacattgcttgctctagagcatgaccaatgttcatagtctttgctacaatatgttgtagaataccataatgtttgtgctgtctactctcatatttacttaatctgtcatcaaagggagcattgccgatgcctttaagtgaaccaatcgattatacagcattatgtttagcttccatagcagcaattttgttttctcccttaggaatcttaattctggaaatgaacattttatctagattcggaatgcttatttattaaatgcaaatgtatttagcttaaataatatatttataatgattcacagtaacaatgaaatgtataagacattttactagagtctatgatgattttcaatataatcacaatgaaatgtatttaaattaaaaatattactgtaaatctctcaagatgaaccacagagctcaatacaaaattgatgttcttaagttaatcagttagttaatgtattgccaaacaaactagaatagaatactatattatcagggcaactttgttaaatagatattcaactttttaaatataagaacatagtgtatttcaaccatcttttaatactaattttatgtatttttattgtacttattttgttttatttctttatcattagaaacagtaaaccaataattccaaaacaaagaaaactcactaattctttttattcttgttcattcctttttgtcctgttaatcgtacttagaaatacagtattgacatttcctgggctgcttttgtgtagagccttgtgctgatatataaacatagaaatttatacatagttttcattatatattagtaaaaaaataagtgaagtagaaaaacgggtaaaagacgtgtacagtaaagatgctgaacaaaaactcacgtgttttattttttaataccaccctcaggcatgtaattaatattattatcctcagaataatgtttaaaactgatcttttataactgttatttcagctctcatgcattctttttgctggagaataattgattcatctcattatttgccaggtttagaccttagtaacttgtacatccctatgataaaaattattttggaatggaaagagagatatctaaaaagggatgaaatcatgccaaacatcttatctctaacataaaaaaaattaaatttgaagccagaatttcagttccagttctacttttagcttgtgtgaccttgagaaagtcacttaagcatttctgagcttcaagtttctcatttgtaaagtcgaagtaagaaataccttttatgcctagcactcagagttcttgttggatcaaacaagatttgtacatttagttggaaaactcaacatttgtatctaaacataatgtattccagcagagaattactgtccaccattttcatttatacattttaaatagtgatttattgatgatcttcaatatgcaaggagcactgctagacactagggaaataaaagggaattaagatagtacccaaacacttcaaatcctcatgggcaaggacacgtgaacacataataaaatactttaatttcaattacagacactaatgggcaggttgttaatagaatgtttgccaactttaagtagttttataataaaatataatagtttaaaagaaaggtctattaataaaaacagaattaaaatatatatagatcaaataaagtatggaaatttagttgaaaaattggcattaatcagtaggaaaaagatgggcttctcagcaagtggtattgggatagatgaacagctatatgggaaaagagaaaactgaatctgttccaaatgtaacagaatcaaattctaaaaagatcaaaaatttaaattcaaaaactattatgttactaggagaaaacaaaggtgaattactctgtaacctcagagtggccaaaagtttcttaactgattctaaatccagaagcaataaaggaaaaggctaataaaggtgacaatatgaaaatttagaaaaaaaaactttttatactaaaataattgcaaatatttttcacttgttaatgcacaataacaaatggaaaatatttgcaatttttgtcataaacaaagggttgttatccctaaaatataaagcacttttaaaattaaaagaagaccagcaactctataaaaatgggcaagagacatccaaagatagtttgcataacataaatgcaaagggtccttaaatataggaaaagatgttccaattcactcataaaaatgctaattgaaatcactgaaattactattgtttatcagtaaggttggcaaaaacacaaaaggttgaaaacatacttgtggtaagcagaaaagtgacccccaaagatgtgcacatcctagttcccagaacttcacatggcaaaagagattttgaagatattaaggattatgagagatgaagattatcctggattactcagatgggcccaaagtaatcacaaaggtccttaccagtgaaagaggagtcagtcagaggagatgtatctgatgatggaagcagaggttagaacggtgtgatcagtgcctttgaaggtggaaggggactgcaagccaaggaatgtgggcaacctctacaagctggaaaaggcaatgaaatggattttctcctggagcctctgaaaggaatacaaatctgctgtcgccctgattttagctccctgagaactatttttgacttctgatttccagaactgtaagataagaaatttgtgtttttaatctactaaatttgtggtaacttgttgctatagcactaggcaacaaataaaatactcttaagaggaaggttgtgagaaaacaggcactttcatttattgttgggaatgcaaactgtacagcctctgtggaggagaattttgctatatttacatatacactcacccttagatcccacaaacacatctctgtcactgtcaaatattgtaaaaagatttttcagccctatttgtaatagcaaaaaatactgggaacaacccaaatatatattaatagaaattggttgaaagaagtgtggtattacgttgtactatgcagttgtaaaaaaattaaagttttcatcttatgctgtggaatgatctcaggcaatattgctaagtgaaagtggcaagttgaaaacaaatgtatgttactatttgacgaagaagagggagaatataagtatacctttacctacacatatatatttgcttttttaacaataaaatgataaactaaaaagtattatttgggttttcttttcttttttagtggttattcataggactgaaaagaccaggatgaaggaaatagggatggtaggtagacctaagtgtactttacttcgtagatctgaccctctagccctataaatgtattacaactatgaagttttactgatttaggaattcaaaatatttcaaatatgcacaagttagaattaatatgtgaatgaatataaatatgaatgactgaatcttatgagaatttcctaatttacagaaagcagttttcaaaactgatagaggatggagttcattaaaaatatttattcagaattcattatgacctcatcatcaagtaggggaatcagatgatatataattatactgcaaggaagatgatgaaacatccaaaagagagatttaaagggatttcagagaaatgagagtgcacttccacctaggagaataagaaagattttgcgctcattcagttagttatatattcaacaaatatgtactgagcccctattatgagcaaactctgttataggcagtagggttcagtgatttttaaaacagtcaaaaactcctaccttcatagagcttacatgcttataagaatgagggtaacagacaataaataaaagatgaaaagaactgataattgaccattacatttagtgtagtggagatcagtgttgaccatggcaagagcatgcacattcctatcaccaggacattcatagtccccctagatgaagacagacatttacataagcaagtactatgttgtatgatatgttgtacctattttaaagaagcctctatagcgcttgtagtacgttgagcactttaatagacagtgagtactccataaatagacaagaaaatgatagttatgcaaactaatgttagcaattattttgtacttatactgtccagcctctgatatatttatgcctagtattttaagtaagtagcgttcttttcattttctttgctttaccaatgaaattccatagaaacaaagtattgccaacacttttggaaatgaagctgtgctgttttgcatgaggactgttctgcgtgagtttggtcaagggctaaggtcaaatttgggagactcccttctaccatgtaatagtggcatgacactaggtgaattagtttacctacagctcaatttctgcatctagaagataggaataataatacctgtgttcagtgatgttgtgaacatgaaatgggatgcacatatggaagatttgatgttattaatcacatatttttgataataaaaattctctttaactagaagtcccttttttattatactttcagttctggggtacatgtgcagaaggtgcaggtttgttacataggtatacatgtgccatagtggtttgctgcacccatcaacctgtcatctacattaggtatttctcctaatgctatccctcccctagtgcctcattccccaacaggccccagtgtgtgatgttcccctccctgtgttcatgtgttctaattgttcaactaccacttatgagtcagaacatgcggtgtttggttttccgttctcgtgttagtttgctgagaatgatggtttccggcttcatccatgtccctgcaaaggatgtgaactcatcctttttaatggctgcatagtattccatggtgtatatgtgccacattttctttatccagtctatcactgatgagcatttgggttggttccaggtctttgctattgtgaacagtgccgcaataaacataagtgtgcatgtgtctttatagtcgaatgacttataatcctttgggtacatacccagtaatgggattgctgggtcaaatggtatttctggttctagatccttgaggaatcaccacactgtcttccacaatggttgaactaatttacactcccaccaacagtgtaaaagctttcctatttcttcacatcttctctagcatctgttgtttcctgactttttaatgatcgccattctaactgatgtgagatggtatctcattgtggttttgatttgcatttctctaatgacctgtgatgatgagcattttttcatatgtttgttggctgcataaatgtcttcttttgagaagtgtctgttgatatccttcacccactttttaatggggttgttttcttcttgtaaatttgtttaagttctttgtagattctggatattagccctttgtcagatggatagattgcagaaattttctcccattctgtaggttgcctgctcactctgatgatagtttcttttgctctgcagaagctctttagtataattagatcccatttgtcaattttggcttttgttgccattgcttttggtgttttagtcatgaagtctttgcccatgcctacatcctgaatggtattgcctaggttttcttctatggtttttgtggttttaggtctaacatttaagtctttaatccatcttgagttaatttctctataaggtgtaaggaagggatccagtttcagctttctgcatatggccagccagttttcctaacaccatttattaaatagggaatcctttccccacttcttgtttttgtcagatttgtcagtgatccaatggttgtagatgtgtggtgttatttctgaggcctccagttctgttacattggtttatatatctgttttggtaccagtaccatgctgttttgctttgccttttagtgtagtttgaagtcaggtagcatgatgcctccagctttgttctttttgactaggattgtcttggcagtgagggcacttttttggttccatatgaactttaaagtagtgttttccaattctgtgaagaaagtcattggtagcttgatggggatggcattgaatctataaattgccttgggcagtatggccattttcacgatattgattcttcctatccatgagcgtggaatgtttttccatttgtttgtttcctctcttatttccttgagcagtggtttgtcattctccttgaagagatccttcacatttcttgaaagttgttttcctaggtattttattctctttgtaggaattgtgaatgggagttgactcatgatttggctctctgtttgtctgttattggtgtataggaatgcttctaatttttgcacattgattttgtatcctgagactttgctgaaattgcttatcagcttaaggagattttgggctgagatgatggggtttcctaaatatacaatcatgttatctgcaaacagggaaaatttgacttcctcttttcctaattgaataccctttgtttctttctcttgtctgattgccctggccagaacttccaatactatgttgaagaggagtggtgagagagggcatccttttcttgtgctggttttcaaaggtaatgcctccagtttttgcccattcagtatgatattggctgtgggtttgtcataaacagctcttatgattttgagatacgttccatcaataactagtttattgagagtttttagcatgaaaggctgttgaattttgttgaaggccttttctgcatctattgagataatcatgtggtttttgtcattggttctgtttatgtgatgtttacctttattgattagcgtatgttgaactagccttgcatcccagggatgaagccaacttgatcatggtggataagctttttgatacgctgctggaatcagtttgccagtattttactgaggatttttgcatcgatgttcattatggatattggcctgaaattttcttttttggttgcatttctgccaggttttggtaaccggatgatgctggcctcataaaatgagttagggaggattccctttttttctattttttggaatagtttcaaaaggaatggtaccagctcctctttgtacctctggtagaatttggctgtgaatttgtctggtcctggacgttttttggttggtaggctattaattactgcctcagttttagaacttgttattggtctattcagggattcgacttcttcctggttttgtcttgggagggtgtgtgtccaggaattttccatttcttctagattttctagtttatttgcatagaggtgtttatagtattctctgctggtcgtttgtatttctgtgggattggtggtgacatcctctttatcattttttattgtgtctatttgatccttctctcttttcttctttattactctggctagaggtctatctatttcgttgatcttttcaaaaaaccagctcctcgattcattgatttttttgaagggtttttcctgtctctatctccttcagttctgctctgatcttatttcttgtcttctgctagcttttgaatttgtttgctcttgcttctctagttcttttaattgtgatattagggagtcaatgttagatctttcctgctttctcttgtgggtatttagtgctataaatttccctctccacactgctttagctgtgtcccagagattctggtacgttgtgtctttgttctcattggtttaaaagaacatctttatttctgccttaatttcattacttatccactagtcattcaggagcaggttgttcagtttccatgtagttgtgcagttttgagtgagtttcttaatcctgagttctgatttgattgcactatggtctcagaaactgtttgtcatgatccgttcttttgcatctgccgaggagtgttttccttccaattatgtggtcaattttagaataagttcgatgtggtgctcagaaaaatgtatattctgttgatttgagatggagagttctgtagatgtctgttaggtctgcttggtccagagctgagttcaagtcctggatatccttgttaattatctgtctcgttgatctgtctaatgttgacagtggggtgttaaagtctcccactattattgtgtgggagtctaagtctctttgtaggtctctaaaaacttgctttatgaaactgggtgctcctgtattcggtgcatatatatttaggatagttagctcttcttgttgcattgatccctttaccattatgtaatactcttgtctcttttcatctttgttggtttaacatctgttttattagagactagtattgcaacccctgcttttttttgttttgcatttgcttagtatatcttcctccatccattcattttgagcctatgtgtgtccctacacatgatatgagtctcctgaatatagcacactaatgggtcttgactgtttatccaatttgccagtctgtgtcttttaattagggcatttagcctgtttacatttaagtttaatattgttatgtgtgaatttgatcctgtcattatgatgctagctggttattttcccctttagctgatgcagtttcttcctagtgtcgatgttctttacaatttggtatgtttttgcagtggctggtaccagttgtttctttccatgtgtagtacttccttcaggagctcttgtaaggtaggcctggtggtgacaaaatctctcagcatttgcttctctgtaaaagattttatttctctttcacttatgaagcttagtttcgctggatatgaaattctgggctgaaaattcttttctttaagaatgttgaatattgtcccctactctcttctggcttgtagggtttctgtcaagaaatccactgttagtctgatgggcttccctttgtgggtaacccaacctttctctttggctgcccttaacattttttccttcacttcaaccttggtgaatctgacaattatgtgtctttgggttgctcttctcaaggaatatctttgtggtgttctctgtatttccagaatttgaatgttggcctgccttgctaggttggggaaggtctcttggataatatcctgaagagtgttttccaactcggttccattctccccatcactgtcaggtacaacagtcaaatgtagatttggtccttttcacatagtcccatatttcttggaggctttgttcatttcttttcactcttttttctctaatcttgtcttcttgctttatttcattgggttgatcttcagtctctgatatcctttcttctgcttgtgattcggttattgatacttgtgtatgcttcacgaagttctcgtgctgtgattttcagctccatcaggtcatttatgttcttctctaagctggttattctagttaacaattcatataacctttttttccaggttcttagcttccttgcattgggttagaacatgcttctttagctcgaaggagtttgttattacccaccttctgaagcctacttctgataattcatcaaactcattctctgtcccattttgttcctttgctggcgagaagttgtgatcctttggaggaggagaggccttttggtttttggaattttcagcctttttgcactggtttctccccatcttcatggatttttctacctttggtctttgatgttggtgatgttgatactattcctttctgtttgatagttttttccttctaacagtcaggcccctctgctacaggtctgctggagtttgctggaggtccactccagactctctttgcctgggtatcaccagtggaggctgcagaacaacaaagattgctgcctgttcctacctctgaaagctttgtcccagaggggcacccaccagatgccagccagagctctcctgtatgaggtgtctgtcggctcctactgggaggtgtctcccaatctgtatacacgggggtgtcagggacccacttgaggaggcagtctgtcccttatcagagctcaaacactgtgctgggagaaccgctgctctcttcagagccgtcaggcagggacatttaaatcactgaagctgtgcccacagccgccccttcccccaggtgctttgtcccagggagctgcagtgggctccgcccagttcgaacttcctggtggttttgtttgcactatgagggtaaaacccgcctactcaagcctcagcaatagcagaatacttttaattcttatgggtgtacataaatgttaaaatacattagcttatttttgtactttatagagtagatgcaacagaatcaattttgtttttataaaaaaacttttggttatgtaatagtgtcaataacaaaatatttgtattacaattttaaaatacttcattcaatctttgcaacagcccattaatataggcatttatactaccttaatcttatagagcaataaaaggagctcagaaatacaaaaattaatgcctataatattgtattattttgtttacgcggatgcaggaagtctgggttaggctgaatatattttgtcttgaggaaattggcatttttaaataaatttttgttttgatttacctttctctttaaatcagggtttctcaactagtgacactagtgacagtttgcactagtgaatacatatttgggttgttctatgagaaaacataagcactagtgacatttcgcactggtgatccattgttgtggagggccgatctgtgaatggtaggatgtttagcaccctctctagccactacccactagatgccaggaacacacttgctccatttgtgataaccaaaaatgtctcctacccatattgtcagatgacccctgggggagtgaccaggggacattagtgagaacgaatgagtgaggaaaaagtgagaattagtgagatgtgttaaactacagtagagcaaagttttaattaggttttgactaatgttttcatttgtattaaaaagtaaagatgataattttaaagcattttatgatatagtcactaaatatttgagtaaataaaactttttttttttttttaagatggaatctctccctgtcgccccggctggagtgcagtggcatgatcttggctcactgcaacctctgcctcctgggttcaagtgattctcctgcctcagcctcctgagtagctgggattacaggtgtgcaccaccacacctggctatttttttttttttttttttttttttgtatttttagtagagaccaggtttcaccatgttggcagactgatctcgaactcttgacctcatgatctgcccacttcagcctcccaaagtgctgcgattacaagcgtgagccactgtacccggcctgagtaaataaaactttctaattgtgaacactttacattgatctgataaaatttacagaaataaaaatgtgaattttagtcaaaacaaagaactatatataatatatatttttccatgtggctcattacatatgattttaattaatactttctacaaaacactgttcattactcccctttccaaaaaaaaagactaaactcttactaaatatatttgtggttttggttttaatggttttgtttttggttttacaaatactgattaaatgttagtagggaagaagtttagttttattttttgctctagtacatgtaatattctataaattttattgtgatgacatgacattttcctccttcaaaaagacagcagatgaatgaaaaatatatttttacgtattcattggtactgaattttaaataaaaataatttataactaattttaaacattcctaaatggtaagtctagaagacttttaaaaattgaataaaacaatttacagtttaattatatgacttagtagagcacattatttcctattatcctattaccctgattgaaagataaatataaatgttgggttattgttggtataattaagccattgaattgtaaacatctttcttctgaaacaatacacacacacgtatataaaaaacaatattattcttattagctatgaataaaaaatacattcctatgtatatactggatttcagatgacagaaacagatagaagatagtgtccaatatttttgttctacttgtttgaaaggttatcaagtagtaagtaataccagcagagcatgaaaatgaccagtaatttaaaagtaatcagacaaggtatagtttgttgtatttttaactacagaaggctggtcaatagctgcactcaatttgctgttatttccccatggaaagcccagtttgttagctttaggataggcgcagtcaatagattcttttttactaagagaaatgatccatgggaggtctcctaaggagtaaagtcatgagaaaacataggcagcctttcatgctgcacaacacaactagggaagtaagactctgacctatttgaggtagcgtttcaaagactgcactgttggagctcttttttaaaaaaatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaaggctctttgctgcttggaaaaaggaattcaaaacactaagtttccttctttcttctgtttcaaaaactattaatagatatgtcagtaagcctgaaagttttattcctcctggctcagactgcactgatgacttcttcagaaagcctgcctggtcttttggcagatttgctaggatttggatgacctcatccatgatggctaaaagtatatagaagggtcagattaatttaatgcagaaaatctagtacatcctagaaaataatgaaaagttcaaaattaagaattcattgatggaaccagtcatttaatgtgagaagaaacaacacagtaatatagaactcagtatttaaaaaataatcagtacttatgaattattttcttaaggattaacttagagaactgaaatctgccatgtaatttatctagattgtaacatgatttggggagaaagggtacatttacatcccacctaaaactaacctcccataaatagtatataacattatataaattataagaatacaaattactccatacttgagaaagttactatcaataatttatattgacagattctaatgacataaaagttttaaatgtaaccagttaatcatcaacataattattctttaataactttacttttgaatttcttcagtggcttagaaaatgaaagcatacaatttttctaactgttgaaatatctttattcatttttgtttaaatttttgaaatgttctttcttaagttaaataaaaattatttagaaacactaataggtaaaatataaaggtatattaaaatgtgatcagcactttttatggcatttgtataatatttgataaaatttcagatggattgggaaggtttaaataatttatctaagttgtaaaagttatcatgcaataaatatactcagattcttatcagtgagtttttttgttttgcgtatatattttactctatgcagtttgtatcaaaggttaagattcatccatgaattaatgtatttatttattcattcatttattcatcattcaaaaatatttattgaacaactcttttagaccaagatctatgttaaatctggaattggaaacatgaatataacacaggccttgctcctgagactcacataatctactaagggagagacacagatacttgaccatgtgacagtacatacatagagaaatgtacgtattctctgtgaacaaaaagaaaatagaaactaattatgctcaggagaagtggggtaattatttcaatgagagggcagtatttgagcaggatcttgaaaaagaaaaaagataaatttccctagtgaacagagggcattccattcaagagggaacatgatctggttggcctagttgtgacatggagcctaaggaaaatgatgagaggcaaggaaggggagtcggggatgggcacaaagattctgaattctgtagacagtgggggactggagaagacttctaagcacaatcaataagaaaatgtgtgtgtgtctgttatatgtatttagaaagatatctgtgtgtgtttgtatacacacatatccattaatgtatatatacagacatatacatatgtatgtatgtatttatatgtatttttgtatttaaaaatgtatgtatgtttaaaacttctatagcatggaaacacttttagaagaaatattgaattgttttagtagatactaaatgcctattacataacattcacgttaaaagtttgaaagaaacagaagatgatacggtgaaaatgaaaactaagccattcttctatctcaattttctagccacctacttgccttcctagaggcaatcactgttttcgggatttttgtgtttctttgaggtattgtatacaggtactagtatttgtgttctctgctttatagatgcagtgttcttaccttgctagataattccatatcagcaattaaggaacaactacgtttttaaaaaattaaagactttatttttttagagcagttttaggttcacagcaaaatttagaggtaggtactgagatttcctatatacctcctgcctctgcatgcacagccttcatcattatcagcatccccaccagagtgacacagttgttacacttgatgaagctacattgacacatcataatcatccaaagtccattgtttacactagagttcactctttgagttttaccttctgtgggtttgggcaaatgtgtaatgacatgtatttatcattatagtatcatacagagtatgttcaatgccctaaaaattctctgtactctgcctatgcgtccccacacccactcctgctcccaccaacccctggcaaacactgatctttttactgtctccataattttgccttttccagaatgtaatatagtttgaatcatacatttctatgattattgtgataatatgtagacttttcagactgtgaaatgtatattcacacagaaatatacatttaagtttcctccgtgtcttttttgtttgtttgtttttttgttgttgttgagatggagtctcactctgttgcccaggctggagtgcaatggtgcaatcttggctcactgcaacctccgcctcccacattcaagcaattctccctgctgcagcctcccaagtagctggattacaagtgcctgccaccacacccagctaagtttttttatttttagtagagacggggtttcgccatgttggccaggctggtctcaaactcctgacctcaggcaatccgcccgccttggcctcccaaatcgctgggattataggcatgagccaccatgcccagcctcctccatgtctttttatgtcctgatagctaatttcttttttagagctaaataatatcccattgtctggatatatcacagtttatttattcattcacctactgaagggagtcttggttgcttccaagttttgacaattatgaattatgctgctacaaacatccatgtgcagatttttgtatggatataagttttcagctcctttgggtaggtatcagggagcacaattgctggatcatatggtcagggtagcttagttttgtactgccaaactgccttccaaaatgactttaccattttgcattcccgtgagcaaagaatgagaattcctgttgttttatgtatttgccaggatttggtgttgtcagtgttttcgattttggtcagtttaagagatgtgaaatagtatctcattgctgttttactttgcatttctctgatctacagaacatcatctcatatgcttctttgccatgtgtgtatcatctttggtaaggtgtcagttaacagtctttcatccattgttattgttgagttttaagagttcttcatatgttttggataacatgcctttatcagacgtcttttgcacatattttctcccagtctgtaacttgtcttcttactctcttacattgtctttcacagagcataagtcttcaattttaatgaagtctagtttatcaataatttctttcatgaattaagcctttggtgttatatgtaaaaaattattacagtaccgcaggtcatctaggttttctcctatgttatcttctacaggttgtatcattttgcattttacatttaggtctacaattcattttgagttaatttttgtggagggtactacctcacttgtaatggctgtatagtgttccacagtactatattcaactagtcccccactgatgtatacaattagactttttccaatctttagctattgcaaacaatgcgacagtgaatattcttgtccagctctccttattaaccatcctttcccccccccggctcactaaagatcttatcatcatctaacatactatgtattttctttattgctttcattatcaaacttcactcctgtcacatattagcatgttagatccaaaaagcagagattttttttaatttgtttcctactgtaaccctagtcatagaataaatgtttaatgaatatttgttgattgaatgcctcttacacaagtatatctacaggaaaaaatcatagaagtcaaattgctggttcaaaagggataggcatttgtaattttgacagatattgccaaattgatcattatagaacagagcatttcaaccttgacactactgacattttggcctgataattctttactgtgtgaaggtatgtgctgtaggctgtttaacagatcctccagttgtgacaaccaaagatgtttccagacattactaaatgtcccttgttaagaagcactgattgttatgcaacctttgactctcactgacaattatgaaaatatctccccacagccttgccaatatcgtcttttaggaaacagttcactctgaatatctaatggtgaaaagtagtatctcatagttttaactggcatatgaattcacattttgatggaactttgctgtaacaaatccccagcactgtacattgtaatgatgaaggtaagtttggttttccactgtagagggaaggcgggggatagagtgaagatatgaaatccacaatcaagtgtagaaaaagtgctttttgctcttatttttcttcgttaaaatatctgttttataaatcctttcttatcttcagactattatgcattcatgggctgaatcttctctagaattatatcaactggccttgattaatgaacaaaatttggagtcaaaagccttggaatttgagtgcaggctctcctaattactagttgtgttaccttggggaagtcacataaactctgagctgcaatttactcatctgaaaattgtggataataacatttgctctctctacatcactgagttattgtaagaattattttttagactgcaaagcctttcacaattgcaagggtttatgataattattatgaaggttttatgacccgctgctttatctcatgactcacagtgtcccgagagtttttctcttctcagtgcttctgcgatcacctcaaactgttctcactcatttatttattaaacatgggcattgtgtagccttaccatatcttcaactctgtagcctaaataatttcagaacaattctcctcctaactgaacaagtcccagatagactcatcatttattcagcattcattaaataagtaccattgtcttccccaaaactgccttttcctcccaacagccccatttttgtcaatgccatcattttttctagtcttgagggtgggaactttgcagtcatctcttgtgcttgtgctccctgtcccatggatcctgcataccacaaccagattaaagtagactacctccttcttcaggtcccttcttgtgattataagctgagagtcccctgttgagtgccacatcaaatccaaattatatttcagtagcactccttgttacccatattctcctaaactactttttctttccttgcaccagactcattcttgcacctatgcttttgttcatcatgtttttctccctagaattttcttcacctgttcctttacctatcaaccagcaccaactttcaagacgtctatcatccctattactctatgttctctttttctttatagctcagcttactctaatctcttttatcacttcactctcattgttattggtcagtttaacttaatgtatcatagtggatctcaatcctgactgcatatcagaatcacctcagtaaagttttgtttgttgtcttaatataatcccaggatcatgattggggattctaattctagacagagctttgttattataattttagtagagtggtttgaacatcttcatggatattttaagcaggtcatttttctcttccagaccacagatttataaatttactggtagtaagaatgttaaagacatcaatatacccaatgctcaataattgattaactgatagtgtgatataaaaatatttcttattcatttcctgcacagcctataatttgtgtgctacctcttccagtttgtggctctgtgactttgtataaattgctgaatctcttaacctcatgtttctttgtatgtaaaatgagaatagtaacatatatgttgctaattatgagaagtagagctaatgtacataaattttcagagctacatggtggcttttttattactattaatactatatagtctctctgctgttgtagagatgcttaaaaaaccctttttctttcttgctttatgatttgctattttatgacttagtagatttacttatttacattactattggaattaagacaggatatcaaggccctatcaaatcaccatgtaatttgatacctaattacctttgatacctttgaaacctaattacattttcatattttaaggagcaaatgagtattctattttttgaccatcgttctactgactgttttcttggttacaagagaatatgcaccattacagtttttccttgtcagcagcaactccacgccgtgaacacgctaactttatgtatcttcttcactttacctgacattgccaagtaggtgtttcttcctcctaactgtaatttaaaagaggatatttatttttaacttagctcattttattttatttcatagtttataactatcccatttaattttaaaattaaaggaatataatactattctattaaatttagacttacagattgtgctcctgggatcagcaagaaaacataaagtactttgtttccacaaaagacacttcctatataaattatttttattattaagttctgtatctttaaatgagtcacttttaaatctttttcttgtcttactagtgaaaaaatttaaattgtattattaaaggaaaacatatagacatatgaatgagaaagtattcattaataacttgtcttcattaagttagatgaaaacaataaaaaaggaattaaccaaagtggcacattgccaatcataagacaggagaaagtttccagagcaattaaaggaaagaaattatttgttcaaccatggacatttatactgttttttcagtttcaaagttgtaaaagtaatgtatggaggctatcttctcctgcaccaaaacaagaaaccgtataggtttctttggaatgcctattaatcatgcattgctcccataaattagtcaaagctaaagaaaaagtgttgctaaatagtgcacattttcatttccctgaatatttgtagctgcaatttatacagataccaacaacactgtgggctcagaattaaaatgaaagtgcttgaaaacttgtgtgaattacctttcttacagtatatttatggagccaaacagacatatgtttgattctcatttcatccgtaacatgaatatattgatacttactttataaaattattgaaaggattacatgcatttaccatggtgcctggcacatagcgctcagtacattgtagtaacgggctatgctgttttgagaagattgtgtggagagaggatatcactgactttggagttattcatgcctggttttatattccagatctatcatctgataactggctgatttcggccaaattactactctgaatttagtttccttgacaataagctaaagtgaaataacagcaacctcatagggtggttctgaggatttaataagatcatacatataaagggcttccaatgcctgttacatatcatatctttcagtaagtagtagatcttattactcttattcttactgctaaaatctgtgtcttaggttcttgacttctttgtaaatatgcctttgaacaatgtggaagggtcaaacaactattaccccaggagtatattgactttgaagctaatgcagcttaagcctaagggcctctcatttgcacaagtcccttccaaactgacacttaatactcttcttaattttatattctctttcttaaagaagacctccgaagctccaaaaatttcaggtttcagaaaacctgggtctaggttatactattacctgaagggttttttttttaaaactaaaaaaaacaagagaaagtttataaggaagcacaataatgtatgctatctaatgaatatattgatagcaatatttatattaaattgctattttaagcctaaatcctataagttctattttgtgcattcagcttcaaaatgattctactggtaataaaaatggcatactaagcaatgaaaataagagataacttgagtacagcaataaaactcaaaggaaatgtaatcagtgatacagaattatgtaattttgtatactcaatattttctaagctacttttcagaagaaaaagaatagttttaaccaatcagtgagaaaggtaactgattaagcttattcaaaataaatatctgtcttcctcaaggcaggctgtgtcaaaagcatattgaggcatagatcttccaacaaattataaattaaatgtccattactcacacatgcaaaaattgaagttgagaaaattacataactgaagtcaataaaacaaactctggtattatataaatacactgtaatccacagaagatatattcatgtttaaaatggttagcttcaaatttttgagaaaaaaatacttcaaggtctttctggtaacatcagttggtaagttagaataaaaccttaataaaaccagtaaaaagactttgtaatttgcattgctcatctcattctttaaaagaatttattgatagattttctcattatacctacatgttcagtataaaatatgaaaaatatccaaaacgtttttaagtcaggtgcttttaaaatatgtggcttccccttgaaaagtatatatctactcaaaatatataaagtatattaaaatttgttcatcttaaaacaaaattgcaattttatgagacaatattaacttttgaggacgtcaaatgtagaaattgaagctcacagttaataacagaaaggatttgctaccatttatcaaataccttaccctggtattatgataagaaacatcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaaggtgaaaaagaaggttaacaatttgtgtaaaatcctctctcaagaacagaaattccaaaagtattgattacaatattcacaatggcatttcacactgtggctggtgcttttaaataggagtcagagaaaatatcatgttgcttaatatttaggcaactaattacaaaattctcgattaccaagtctcactgaagtgttcccttacgaaaacgtgaactttattaggtatcaactcattgacatggtccatttgaagaagcaatttattagtctaatggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattcagctgtactgagattcataatgctgtgagcagagaaatttgggggtggtataaaagagcatggagggaaattgtcttggaaattgtgactactgactgaggcaaaaatcaaccacagccaataggcggtttcaattgatatttgattggggaggcgttttcttgctaccctctttatacaaagaacattagagaaattttagtgaagaaaactactacggaagcagaaaaagagggactttactatgagaaatgaaactgcaatagggagcaagagcagggagaatgactctttttaacagttgtcagctcaaatattaaagggaagtgcacattgtatataaaaggaaaagtggcaaaaaatccattcccaaaaaatttctcctaaatgtctaccattagcaattcattcctttcagatttcttcattgagttcattcctcagttgcccttaaaattcatatgcccagaggagtaaaaatcttcctacatgaagttatttcctatctggactacaaagggagcacaagaaaattgctttgggaagttcaggcctcaggaaaatacggtgtttaaaaaagattactatatagcttatgctaaccaacacctcatttttgcttaatatttattttattctgtctcactagtaatatataagatatagcccagtcataatggatcttattcaggtatggctacgtaatctatggtacaaaatgtaagtatgagccacttattaaacaaattattaagaatttcagcagagcattcagccaagcttagagcccttctaagactggggacccctgcacctgcacagatcacatgctcatgaaatcagccctcattttatttgatggtagtgaactgtgtgaattccaaacttagttaatgaaagtgtttcgttacagattacctaaatattttggcttgtaaatgctcaacacaaatattaataccaaaaattcaaacccaaattctttttgggttaattggaggctttgcaaatcactaaatttaactatttgttcctatctccctccctttttgtgtgatcttctatgggaaagtataggatttatgaggttacacattatcatttcagatttggacctctcccttaaacctgaggttcaagagcctaatcttcactctctattcctaacttatgaatcatctagctgaaaatagccaaagactgctctctaatagccaccccaaaccagcactcatcctagaataaccaataatttccccagccccaggtgtggagttaggatgagtgtggataatacctggttgtgccaaacactaaaagtagattcactttgggaggccgaggcgggcagatcacctgaggtcaggagtttgagaccagcctggccaatgtggcgaaaccccgtctctactaaaagtacaaaaattagccaggcatgatggcaggcacctgtaatcccagctactcaagaggctgaggcagaagaagcttaacccaggccacggaagttgcggtgagccgagatcacaccactgcactccagcctgggcgacaagagcaagactccatctcaaaaaaaaaaaaaaaaaaaaaaaaaaaaattagattagtgaaagctaggggtggctttgggcaaggtgctctgagggcccagataatagggaaattaagcctataagagtcttgatcacctaagctataaaaaacacttctgggtagaagaagtttttacattccaattcaaacttgagtatgctgctgtttaagccaatatttatttcctcttagcatatgtttcaactttagtaccgtccaacaataagatacgtattctctattaaaatctccctcttcatcttttgttgacacagcactataattagtatcacataattcctaccactgacagaatgccccagaatattttgtcttatttttttttcaagattagctagcacttataacacttcttgctaacgtttcactcagttatagttggagttagtgaagtcatggtttgtttttttttttatgtaaagctgtcttttcttcttctcacccccatcccacaggcatcaaaggaagttaaataaaagaatgactattgtgacgttgactaatagtcataagacattagctaagaaatgaataccattgaggttttgaatgatcagctgttaatttttaagattatactttagaaaataataaatcctgcttttgatgagatgtccattaaaaaacttattttaaaagtaatatattttgagtaactacattctgtccaatgcaactctaactgcatacttctgaaatgtttacccccgaatgatcccttctaaaacatatagctttagcttgtcagtttactggcattgaatttcaatacttaagttaaaatatattgaatcagctttgcaatacttggctggatcttttagaatagtattattctttcatcttacttatagaaaacacctaagtaaaatagtattcatttttaaacttcaatttattgtatacagagctttctttcttaatagattgacttcaagaaacattttttcttcaatcagaaaatattgacttattcttctgaattgaatctgtataagatttaaaccttccagttattacccaatataacaaaattaacatgaaaccaaagctctcgagcaaaagttataatatttgaacttaaaaagacaaatatcctatatggacttcaaaatatataataaatcttaaggagtcagtgcaataatttttttaaagcacaattttatttaaggtacaataagggtttaagaaggagaaaatgggccaagcacgatggctcatgcctgtaatcccagcactttgggaggccaaggcaggctgatcacaaggttaggagttcaagaccagcctggccaacatggtgaaaccccgactctactaaaaaaaatacaaaaattagccgggcatggtggcatgcacctgtaatcccagctactcaggaggctgaggcaggagaattgctttaacccgggaggcggaggttgcagtgagccgagatcgcaccattgcactccaacctgggcaatgagagtgaaactccattctcaaaaaaaaaaaaaaaaaaggagaaaatgaatttacagaaaagtcgaatattcttttattaaagcagctctgttatacaagaggtaacactgttataggctgtctgctttcttgatgacatagccaattagtttgtaatctaggcagttatcaaggttaatcacaaatggaagacaatacatatttaaaataaatgagatagttcaggaataagtggtatattatctagcgagtaaattcagtaccaaaatcagtctctaggatcttactccaaagtagaccttggcctccaattatataaagcgtatgttaatctggacatggagtatctgtagctaaatagtatatgccactaccaagtaccatttggcctccctagaagaatgtgacctgatgaagaataaagaatatttcataataatgtacagttgctagataatcttacctcttttggtagattaaagatggcttcaaattctttgacacttcttctgttaagaggtggggtctaggtctcttcctcttgaatctgggtgggatctgactgtctgactaacagaatgtggtggcagtgaagtttgtcagttttggggtccaggcttgaagacaatggcagattcccctcctgtctctcgtaatattcattcttgaaacgaagctagaggctcgtacatcttaatgtttgaagagacctgtgtgcaaaggaaccagtgtccctgctgacagcccttgatgagctgacagctgacagccagcaccacctttcttggcctatgaatgtgttatcttggcaaagatcttgagagatgagccacatctccaagccctacccaaattagattcagttgtattgggaattctgggattggttactgccatttgcagcagggttagcatcttaagagtgcaggagaagggccaggcgcggcggctcacacctgtaatcccagcactttgggaggctgaggcaggcagatcacttgaggccaggagttcttctcagtacagataagcataaacattaattgtaatacatactgaaggttttaaggatgaaatgtactgatgtctctaactttgaaatgtctcaaaagaaaaggtggattaataaaggaacaaactgatagatctgtgatgaggttgtgataaagcaaatgtagcaaaatattaagaattgtagaattgaggtgataggcatatggtggttaatatacaattttacttttttgcatgcttgaacatttcttttatgaaatgttgggaaaaacaaagatgtgaggtgtttgacacctagtaaacattcaaaaagtacaaggattttaaaattgttactagttttatatttactagtaactgaataaaataaagtatttatatagcttcatttccttgaaaaattcttctaaaatattaatttcagtataacttgatatactaaaatatcaagttattgatattttaccaattttgactttgttatatcaagaaatgtaaagtcttgctaagcaaatagtatatttcctgtaatagatcttgaaattcagtaataatcctgtagcactaagaaaaattaattgacccaaattccatggtatttgatgtattttaagataagttttactaaatttaaatttaactctagtttaacacaagaaagaagaaatccagcatacaattctaactgaatatactgttttcaaataaacagttcatttaacaaaaactggccctgtgctagatgctgtgggacagaaaattgagctgcttaacacaaggccctcacccacaaaaggctttcagtgtggttaggaagaaatatgcaacccttggggaaaaaaggaacaatgcgtgagttaaaaatataaaacatgtaacaaagaagtaaatgattaagaatcaagtgaataatatagataatatgagctgagagttcagaagatgaaaaaaatcattatagccttgaagtgaaaattttgggagtttcactgcctatttaagccctttggaacatgaaagaaacttattgcgaacttgtggttttggtagaagacaaaacacaattgaataaagagtaatgttcaggggccggactttctttgagaattatggagaggagggaagaataaaaacagaacttttagccgcaatcagctagaaattgtagctgaatattacaacctctcttcctttcaagagatgcttatttattgtctggttcatataaagcattaggataggtgctgagggttactatgaatgaaatttggccctaacttcaagaggtttaagagtaacaataacaagagctatctactagatgacaagagtatgccaggctagtcgaagcttatggcctattagaagaggtaaggaaaaaaaactgtaatatagaaagtataaaatgtcaaatgccatttaaaaagaccagataaaatgctaagtgaattcagtgaagagttttcttatagttgtataaaggaggataagtatttatgcaggaggtaacactgagttggtctttaaagagcaataagtagattgtgaacagagatatggtgaaagagtaaagaaagggataagaatgatccaatgaacgaactaaatcatatgcatgacatcgaatatgtgattctttccagctacagtgcagactatggagagaaggatgattgaaagggaaattgggccagaccgcctaggccttgaataccatgctgagtgtcttgggctttattctgttggcaacaggaagacattaaagaattatgacctgaggaatgaaaagttgagagctttttggtttttattgtttggtgttagtctggtagcttgtgtaggaggaattggaggaagaaaaatctagaggcaaaatgaccacaaggcaatgaggacgtgaaccaaggacactgaaggagctatttcagaggataaagggatataaccttgcaaccaattcagtatcaagagcaacaggacagcagagtataccaaagtggggttcagtaagttattgacattgtttagaattgccaatacatgataataataaaaagccgactagtttttagttatattattgttcttaaattccctagaaacagtattccttttgctgcctgcacccagggcagattgctcccaatgtcccccacctggtaggccattgcatggaagcagaagcacttaaagaagcttcagaaattcaagcttagcacctgggagtttgatggtgcttctaatagaaatggaaatcaggaagataaaagcagatttgggaatgagttcagttttatacatgttaaatgtgagttgtggttggctggccaattgataatgcccaacattctcaatgtgatagtggatgtaactcagctgagaagttaggacagtgctctaggtcagcgagtcatctgttaagaggtggcaattaaagctagcggaatgcctctaggtctgagggagttaatatttataattgagcatctacaatgtcactcacatatctggtctctaaagctagtggatcttaagccaaacaatactcaatgtgcacaatcaagggcacctaccagaaatttccatcttgaatttcattccttttggctcctgccaaaagtacagctgagataattggcacttgaaagctaaatattaggaggactgtgcatatatccttttttattttttctaaattctatcactacaacttaattatttgtgcctaaataactataaatatcagaaaatagattacactgaatagattagaacttagcttttacaggaaatactctcaatgatttagaaggtaatgttctgccttagccttcctctagggttggtacaaaacatatagaaaatgccaatgtagtctataaaactagtatgaaacatattgtcttatacacacatgatatgtcctggaaaaatggttctttgagaggggcaaagcaagatggccattgatcatccctactgcaggaacaccaaatttcacaactttctacacacaagaaaagcaccttcataagtaccagaaatcaggtgagcaatcacactttctggttttaacttcatattgctgaaagaggcactgaagagagtaggaaatactgtcttaaattgccactgccactcctccttcatcccccagtagcagccacatgcacggagagagaatctgtttgatggggagagggagagcacagtgattgtgggacattgcattgaactcagtgctgctctgccacaggatacagcaaaaccaggctgaactcagccagcacgcacagagggagcatttagaccagccctaggcagaggggaatcacctgttccagtggtcagaaattgagtattagcaagcctcaacaccacaggctaaagtgctctggggttctaaataaacttgaaacacagtctaggccgtgaggacggcaactcctaggcaagtcctagtgctgtactgggccagtagaccttggtagggggcacaggacctagtgagacactagtcggggctgctaaggaagtgcttgtgccacccctccccaaaccccaggctgaagagctcatggcaacaaaagtgactcctttctgtttgaggagaggagagggaagagtaaagaggactttgtcttgcaacctggataccagctcagcaacagtaggatagggcactggtcagagtcatgaggccccctttccaggccctagctcctggatgacatttctagttatatcctgggccagaagggaatctgctggccttgaaaggaaggatccaggccaggcaagattcatcacctgctgactaaagcgtctttgggcccttaaaaaccagcagtgatgctgtgggctttgggtagaatgctataggctttgagtgagactcagatgtactggtttcaggtgagacccagcacattcccagctgtggcggctacagtgagagacttctgcttcagcaaagtggagggagaccagaagaaggaatatatatggaagttctcatatacatctatatatgtgaactccaaatcaatttttaaaaggcacagtcaacttgatagagaaattagcaaaatacttgaggagacacttcacaagaggatctgcaaatgtccaacaagcatatataaaggtgctcgacttcatttagtcatcagagaaaaacaaattgaaaccacaatgcaatgccattacatatccacaagaaaggctaaaattaaagacaagcatcaccaaatccaagcaaagatgtgaagcacccataaatctcacacattactttcgggaatatccattgctacaaccatttggaaaaacaatttggtcctatattctaaagctaaacatatacatactgtatgaccagcaattctcctagatataagcctaacagaaatgagtacaagtgcttaccaaaaaaaacatgtacaagatgatttatggcagcgctctgtatacagtcaaaagtcaatcaagattaagataaatacattttagtatagtcacataatggaatactgaagtgaacaaatcacaactacatgcaaccatatgggtgaatcccacaaacataatgttgaacaaaagaagccagacactaaaagagtatcctacttatatcaagttcagtaacaggaaagactcatctatgatagtacaagccagcatagttgttacccttgggaatgtggaggaagtgcctggaagagggaataaggcaagtttctgagatgatgaaaatcttttatttttctcctttaatatgggtgatggttacataggcctgttcccttcataaaaattcacaaagctatatatttaatatttttatagttttctgtataagctatatttcaataacaacccatccatttaaagaaaagtaatctttctccacgggctgaaatcggccagattgggtaattatggtcagctgttatatagtagcaactcttacccacaatgttttttattctgttgcctttttgccctgaatgataattcctgtcgctccatggatatatttagataatttaggatatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaagtgcttagtgatctggttggtattattcagcatggattaatttttttctaaaagcagacaatgtatataatttattgtggacatctaaagtctaatggcactgcagaggtgatggtgaattgttaacccttctcaatagtttatgaacaggatgaaaaactagaggctatggattcatatttgtctatatgatgccacacacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccattcacctcagcaggttcattttgaaaaatagaacaataatgcttaagagcttactgtgactattaagtatgataataaatgttaaaatacgtataaattgcaaagtacctacacatttaagatattattgagataacctttgagttttcacattcaaatataatgtcatttaagctcatagaatagttactctttgattcttgtaagtgaattacaggagatcagcaggaattatttagctcagatagtaatgagaaagaattataaagtgattcggggccgggcgcggtggctcacacctgtaatcccagcactttgggaggccgagacgggcagatcatgaggtcaagagattgagaccatcctggccaacacagtgtaaccccgtctctactaaaagtacaaaaattagccaggcgtggtggcgggcgcctgttgtcccagctacttgggaggctgaggcaggagaatcacttgaacctgggaggctgaggttgcagtgagtggagattgtgccactgccctccagcctggtgacagagcgagactccatcccaaaaacaacaacaacaacaacaaaaatgattcggagtcagaactgtgttgaagacctagctttatctcttatttgttttgtgaactaaaacaagagattaaattctctgaatgtcagttttcttttctgtaaaattggaatgatatgccttatagagtgttgtaaaacttcaatgagactctgtaatcgctacacacagggcttattggctcttaggattaagatttattttgtatgccagacatagtcctagatgctgtggatacataggaaaagacgtgagtcttgccttcaaatccataaacgattgtgggggtaatcacatattaagacataatgtcaataaaacatgataattcccatgatataggtatgcccaaggttcatggagtagtagtagaatccgaaaagattttcacaggagctggtcctaaaccgagggttgacaaatgagttagatgtgtgtcagttgcaaggcagattctgtattagttttctagaactgccgtaacagattgtcataaacttggtgactttaaacaataaaaatgtattctctctcagtcctggaagccaaaatcaagatgtcaacagggttggtttcttttggaggctctgagggagaaaccatcccatgcctctctcttagctgttggtggttgctgggcatccttggtgttccctagcttatagttacatcactgcagtttctgcctcagtcctcacatgaccttcttccctgtatgttttcacatggccttcttataaagatagcagtcattgggttagacccaccctaatccaatacgacctcattttaactaattatatttgtaaaggacctctttccaagtaaggtcacattttgggtggacatgaattttggagggacactattcaacccagtacagggactctctggttcccccaaattaagttctatttcatgtgcaaaatacatttgccccatttcaacatcctccgaagtctcttaacccattccagcattaaatctaaatccaaattctcatctaaaaattcaaaaagtcccaaatctcatcatctaaaccaggtataggtaagactgtgagtatgatctatcctggggcaaaacccctctccatcggtggatatgtgaaactagtaaacaaattatctgctttcaaaatacaatgatgacagaggcataggtttagacattctcattccaaaagggagcaaatgaaaggaataaagggatcactggttccaagcaaatctgaaatcaagcagagaaagttccattaggtttcaaggcttgggaataatcctctcatgatattctatcttgtgggcctttgttggggcatccccaccctctatggcctcttcatccgtggctccacccttagagtcattcctcctccattttctctcatctgtgtccctttcagtccaagcctagcagtgcttgttggtataaaattctcaaaaactgtgttgattgctcatgcaattcatgggagtctgtgccattatgcaagaaggccctccacagatcttttctagataatctcttgtctattgctggcttctgctgagattggttattagatctgttaaccacacacctaatctattcaatgaaatgtccagctacaacctttgtgttctctccagagcatgttttctcatcttttgctatccaaatagactgagaatttcccaaatcataaagtgctggtttgtttttgcttaacagtttttgcctcaatttatctcttccctctcgcattttaccataagcagtaagaagaaagcaggccacacttctcatactttgctttgaaatctccttagctaagtatccagattcatcctttacatgtttcaccttccacacaacacaattgagttgaacacaactcatttctttataacaagcactgacttgcctccagtttccgataatatgttcttcattttcatatgagacctcatcagaggcaccgctaatgttcttatttctagaaacattctgttcatgacaatttatatattctttaagctgatagaagctttctctacagcttccctcattcctttttgaaccctcaccaaaatcacctttaacatttatatttctactaatattctttttaagtcatcaaggcttttcctatcatatgcttcataattctagcctccacccattacccaattccaaattccaaagccatttgcagactttttttttaggtattattaccccttacttggtatcaaaatgtgtgtcagtttcctagggccaccataaccaattaccacagactaggtggcttataccaacagaagtgtatggtttcacagttctggaggccagaagtctgaaatcaaggtgttggccatgcttccttggaaggttctaggaagaatcattgcctctttctacgttcgggtggttcctggcaagcctaggattctttggcttgtaattgtatcactcccatctctgccttcgtcatcacatgcacttcctcttccttcttatgtgtcttcatatggccttcttagaaggatacaagtcattggatttaaggctcatcctaacacaattgaacctcatcttaattaattatatctgcaaagactctatttccaagtgaggtcacattctgagattctggatggacaagaattttaaaggggacactattcaacccagtatgtgttcttacagacctctaattcttcctcatcttctcttttaggtgacaagacactaatattaagttgctatggtgatagtttatttatttgacctactatctgcattctatttcttttcaaaatgtgtttcttatatgttaaacctttattatgtcagactgtggcaacacctagagaaatctaaacattatgtttttgccaagatgaggtcagaaacagtaaaacattgtttttaagttattggattaatatgtctgcctgctactaactgtggttaaataataatctttgtttttattcatagttaattacatgctcaagttgaaaatatcaaaggttctttatctgattctgtgaattgatatttaatacatggtctgccatggttacctagcctgggatttgttactttaacacatcaatcaatggcaaagtcaatgtgtaagctgctagtgatttgggaagcatctttgtattcaatagtcttgtaccttgtttgtgattgaaggtcattctttaagaaaagaatgatatctaagactgtaaattcattgtactttctaagctcttgagagtagagatttgcaacatcaatatatagccaggctttacccattcgggccactaagactgatactcatagttttaattattttcacttgatgaagctaattccaggaatactattctttactttcttggctcttagaagatatgtctattttatcatttggaaacttaggaaacaatatccttttggtttttgtgcaggcttttttctcatcatatacttgcaatattttacttatcttaccttcatagtaatccacatactagggatattatatttagaagcttcatgtcccactacttattaactatactggagtgttatttcttgaggtttattttgaaaatatgatccaagctcctatttcatgtgggtttgttgttggctaaaaaaaaatcctcttcagcaccccatttcccccaaaagatatcatgtcctaatctctgggacctgtgaatgttaccttacttggtaaaaggacctttgcacatgtgattaggttaaagaccttgagatgggagattacactggattattgggatagaccctcaatgcaatcaccagtgtccttatgaggaagagataggggaagatttgaaaacagacagaaaagaaaaaggcaatatgatagtagatgcagagatttgagccgtttaaacacaaactgatttctaatccctggcctccacaattgtgagaaaatccatttctgttgttttaagccaccaaatttgtgtaatctgttacagcagcctcaggaaaataatacaggtacgtaacattttcccttggaaaatatgagatacaccatactcctaacaaaaatgtaattggctgctggatttatatatagtagttatgtttctcagtagttctatgcagaaaatgcatcctctgagttgatactgggtttcgagtaacattcctccactttgtccttaactgaaatacttaacctgtcaaattaattctgaacttccccatagaatagatttttaaattgggagactatttcagtgatgtcttttataaagaggcacatcttttcctacctaaatagtgtatttcagatttgccccctctgtaaacattcatatttctttataaagcctcaacttctgttcagttttcatttcacattataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatgaacttgtatccctgtcaggagcactgtgatcttcaaagttctttcattcctagaaataacgtattatgaaatccattctcgagtggcgattttttatgatgttgtgttatcacacacgttataaaataaaggattctgtggggaaagccacttgtgtttagttgcttttcaactgcatctgaccagttctttaagtaacagaacttcagttaaatgtttcagtgaattcgtcttttgcagaaagcttcctgtggttagcaggttttggtgttgaagtccctgcaggttttatgcccaattaagcctctgattgggctctttgttctttattacccaagtatttatcccatgtaaatgagaaagggtagaaataggcaaatttgttttatctgacagcaagtcaacaatttagctctcaagtaacaagaaaataaaacttgttgagaaagttggtactgtatctgaaaaatttaagtctgctgtcaagaaaaatgaaaaagcctgaatcgctgcatctcctgacacatttcaaaatggggatacatagcacaaattatagtgtgcttgatggtgctgttgataatagcaccctgcgctcctcccagggcaccgagcactactgctgaaagggctcaactgcgggggttgtgcgcagatagttgcctgggagagctaaggactgttaggtcagagtttccaagaatagagaaaatacgccagaagaattaatgatttaactgggaaaatgcctttgtcattttttcctattttaaaatttctttgccctactctgtattttcccatcattcctcctgcctagtcttagtcatttactttaatcaggaccccctgcttcctacgccagggcaaaatgtctagaactatgggaaaattttgcctcgaagtaaaagtcaaaacaaatgcaaatctgctattagagttgagcagtttaaatgctccagtacaattgaggattaaattctggaaaagggtatccaacataaatacacaaccaagaggttattttttttaattagccatgattgaaggatagtgaagaagaagattaaaggcattaattatagaagagacaaagaataagcagacttttcttaaaatgtagtataaaacagttttgttagccagagaataaagatatttgtattccattaaatattctatgcttttatttttttcagacacattttcttgtacatttgtgtatttcatgtgtttcccaaatcaattttgagatcatagaatgcatggtctgtcattgtctctccagagcaggacaatctgacaagtggtcacccagcctctacccagtggtggcccccaaagcagccttgttagtttaaaaagaaaaaaaaaaaaaaactcttattatttgaaagagccttctttccttgaattgacttgcttattctaacttccacccacagtttctgttccccagaactgccacagggaggttctgaccctgaataaatggcaacctctcagatatcaaaaggctcacgtactaaatctttcctccaaatccccaaggcctctacggcctttctgttacgattgaattttagctgatttaatatctgttcctaaacagtgaccaaacaataattcagttaagcttatatccaaccagaggatcattatgtaaatttgagtgagggtagagagagtgaaggaaaatgaaatattctgcctcatttacctttagaaacttgtaacttgacttaaaaaaaaaaaaaaacttttaaactgaatatattggtgtcagagagatctagaccagtatgtttttaaaaattccatgcctaaggtaatatttcatctgcttttctagctttattctcttttttctatcttctactacttttttaataagcttaaagtagaaagaattaaaaggcacctattttctttactcagtttcttacacatacttcaagcttcacatagatgttcgttagcattaaaaatgttcgggggtttttaaatgaacacattttctcttactctgccatctgccaaaccagtgcagttcctatatgatttatgtgagataacccagaagagtcagagacataaataaaaactaaaaatccatcagtggtaattagaatctgtctaatgacaatggtgatgtttggaagaatatattatacatgttcctgtctcaggactttttaatatccttctcttttttgctgaaaatcttttctcccccaggtccacatagcttacttccttacctgcttcaagtctttactcaaatgtcaccttttcagtgaggccttgcagagccagaccctataaaattgtgcttcccccttcctcatgccaacatacttctaaccaccaacatttcctgccttatttttctccataacatccatcataatcttacctatgctttttctcattattatttgtgaaatatatcatgtgtacaggagagtgtacaaaatacatatgcacagtttagaacaaacacctgggtaagcaaacacctgtctaatcaccacccaggttaagaaataagaagctccctgggtgttcggaaaggtaaccactgtttcaacttttatgatagtcattcccatatgttttcttattattttatcaattatgtatatttgtgaataataatacagactttagtcatttattctagttaaaacaacagactaagatatctggcactctttgtatatagatgagttcctagacctattccagaatactccaaaacttattctcagcccaagcaacttgactcttccttcaccagctctcttaactctgtctatttcacccccaaccttccatctctttccaacctttcttccctagtttggcataccactactagatgtttagattcttctccaattctcttaacaggacagtcttcacttttgatatgagtcagaatcaactgaccaaggtaatcaaattttaatgaaaataggtaatttctttcattcctgaaacaaatttaaatagttatagagtttctgctatttgttacctattctagtaacagaaaacctcatgcttatctggacagccaaactttttgttctctggtacaatcctcagagtgactttgctttgcttacagttatcccatgtacaatttccatttagatttattccaaagatttcagcaagcatactgcttcacagatgatctcactttgttttgataatgtgctcaatcatttcatatacaatcaaaatgagtaatcagaggttatgcaaatgaaactttatcatcattgggactgctgcctatttgcaagtatccttcatcctcatctagttgaagttagctattattctattctacagaattttcagtggaacaatgtccacctttcttttgtacgctacagagtccagagaactgtactcattttctttttatgttgttagaactagatgtatcattcagctataatctgagttctacaatagctgtaatcactgtgtcactggcccctgaaatgaattcttagattgggcaatcactacactatcaacatatattgggtgtagcatctaaatcttctgttgagaatattgccgttttacttatctaaaacagtatgcagtaagtgtagcagtatatatctaaattaacttcttttgtagcattttatcagtgttctgccttttctctacattggctgcattttaccagaaacaaaagttgtggagcagtaaattatccatagatagtctagaagctcttttgataaaggatattcaaaatgttatatgaaaaaaatataagtttttctttagttttttcatttattagcttcagcatttttcatttatttcttcattcaaagaacaggtttttaactgatagctaaaattattatatcctctgctcaatacggttaagttcaaataggcaaaaatatacacagaactctacttctaaaaatataactgaaatatctattttcagtttgaaaaaaaaatcattctttctagagggtacctagcttcagtggcagactgatccagttctttgagagacatgttattgccagatatttagaataagtagtatttggaagaatacaaatatacaaatgattttttccatataagtagtaaaactttaaggagatgctttaaagaagaggcttaaacattttttcatcactaccacaaaataataatttcaccatttttaagggttcggcactgaactgattatgaaaagaaagtcttgttgcaagacttcaatgaaaataaaatatagtatttttaataattgtatggttagtcattatctgtgccctactgatttttggtcataaggttatatttgaagaaatgtcttcttttatatattcaacttcaactcaatcatgtaataaacttatctggcatgtgaagaattttatgtagtctctcatcatagaaaatgatggtaggttgcccatctggcaaaggttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgactccattcaagttacagcaatttttccatttacagcaaaattatagcaaaagaatctagtttagaatcatgcgttgcatttagtttcctcagtatacaacagtttcacagtctttccttgactttcatgggcttgataattttgaataattattttataatggattttagaatgtccctcaatttggatttgttcagtgtttcctcatgattacatccaggtaatgtaatctttagtggtgatattcacttcagcaaaagtgattctatattcttttcattgcatcctattgggatgtgcacaatgtcatcttgtgcattgctgatgatgtttgctttaatcatttgcataaggtagtgttttcttcaatataaaattattattttcctttgtacaattaataagttctttatgggaaacactattaaactatgtaaacctcccattccttatcaaactttcaatttaatatttccttatttatatgacaccttcctattttattcactgaataataatctgttactatcattattttgatgctcaaattgtcccagatctgagaggcccctttaagatggcttctgtgtccttttgaaaagtctctatattctttgagcatttctttactttctggcacaagatattccagtctcatcttgtactttctatgcctcagtgatttctccagaaagtcctggtttcttttagtggaaaatggtatttagaagccacaatctgacattaggtgtgctcattgctattgaggtattgctgcttccaggcctctctgtagacagagctggaaaacatagctatgtatatatacatttacatgtatatttatttctctgtctatatactgaacaccatgagtttatataaatggctaaaattctgatccagaatccaaggttcatttatctgttcccatatttataactcctttacctaattaggtgatgaacccggtttccattatccttaatgtattgagtcaaaaataaagcctccttttatgtgaccagtctcctggtctcagctttcctcccatccccagtgcagattccagtctcccatgtattagtccgttctcacactgctataaagacatacctgagactgcgtaatttataaagaaaagaagtttaattggctcatggttctgtgtgctatacaggcttctgcttctggggagacctcaggaaacttacaatcatggtggaaggctaaggggaagcaagtgcatcattacatggctggcaggagagggagagagacagcaaaagaggaggtgctaaatgctttgaaacaaccagatctcttgcaaactctatcatgagacagcactagagggatggtgcgaagtgctaaaccactggaaaccacccccatgatccaatcacctcccaccaggccccaccttcaacactcgggatcacaattcaacgtgagatttgggtggggacacagagccaaaccatatcatcccccattcaatctccaaaacccatgctgggctggcttctgccccacacggatccctccttatcctgctaatgcccttgtgctgagtgccagatcactcccacatctagcttccctcctcactctgcctgggcacctgaactccaaatccctgtgcagagttgtcccctgaatgcacacacatctcacctcactcaggctttggatccccacatgggccacaacatgctgcactctgctggctctcagacacttcatgccaggctgcctctctgtggagatgccgtcatcaccctgcttgggacagctttaaaacaggcaactgccatatgcggttgccttttccaccccactcatgttctgatgccacgtctgccctccttcacatgtacctcctcaccccaatggggctctgatgcgtgttctggcacaccatggtttccccttcccacctaatctggacacctaccttgctctgctgcccctaatggctttaggactaaattgttgaaacaggtaagcaaaaggaagcaaaagggaaggggaaggggaaaagctcatgcaatattttaacttaacacatctttctcacccactggactgaagttcatggccgaaggaaccacattttttccatctttttattctcagttcttaacaaagtatctgattcatagaggtaggtagcagtgcaataaatgcttgttaaattaacctcattcaagtggaaagctgagaacttaagcaattccagtctttggctcttatcagtgatctcagtcaaaccctttgagcattattttcgaaaggaaagtaaatcataagcagtttggccagttgtcctccaaagaggatctttctgaaaaaatgtaacaaaatgaagccttttcatgggggctaacccttctatatacaatttgctaacaatataaattaaatctattgatttattttgaaatcataaacttaaaaagagcaatgttcattagatgtagagcttttattcttaattagtatcaaaaatcattgatcagaattatgccttctttcttccattttcataatataggcaagtgaattagtttccatatagtttcaaccttatagctcctccaagaaatgtaataaacaaaaagataattaaatgatatttggactgaagcattacataggaataacaaacataaaggctttattctaaaatatagggaccttgacttttagttcctgttaatggcaggaacaagcttttatttgtgtcttttctgggaagtttgttcatttattcaaaatgtagttattagacaactcaggccagcaacataatttgtggggcccagtacaaaatgaaaatgcagggcctcttgttcaaaaagtaggaaaaataggcctttaaaagtcctaaaatatgacaccttttcctttcttccgtggtctctctcctggcctttcgaatagtgttttttaatttgcaatttaattttacactcaggcactgggatactcaccaagcaggtatcaacttttataggcacctgaaggctcacctggggcagaaggaagggctggggtgcaggcatccacagcccaccaactgcaaggcttcttctgccaatttttggactgacactggggatattagaatgaacaaaacagacaaaaagtccctgcatcatggaatgtacatgtcagcagaagactcagttaaaaaaaaaattgtatgtgtgcacgtgtgtgtagtatctgttaggtagtgataaaccctttgacaatcaataaacaaagcaggaaagtggggtttggagtactcagtgtagtggatagaaatgggctccaatttgaagtaggttaggaaagccttcactaagaagatgacattcaagcaaagatctgggagaagtacaggagccagccatagggctatctgggctgagatgttgcaggcagtggcaggagcaaatgcaaattcttctcagtcaatgttgcaaatacttcagtgagacagtctaattttctcagagacctttttttttctttttttgagacggagtctcgctctgttgcccaggctgcagtgcagtggcacgatctccgctcactgcaagctctgcctcccgggttcacgccattctcctgcctcagcctcctgagtagctgggtctacaggcacctgccaccacgcccggctaattttttgtatttttcgtagagacggggtttcaccgtgttagccaggatggtctcgatctcctgaccttgtgatccgcccacctcggcctccccaagtgctgggattacaggcaggagccaccgcgcccagcctctcagagacttctttttactccacaccccacctacctttccccacatcactaatcttgtttctggaatttgttccaccttctcttttccaaatttagttagcctaggtgagattcctgctctctcacctgttacaggaggcttctaacttcctgcctcaaagctctctgctccccataccactgcctgttgccctcagcactgctggagctcaagtctcaaacataactgactgtgtgttcttactcagaagacccattgtgtggctttcatgcaccataccaaaatgcagaagtatgggaccctatgttatgttcagaaatgccataaaatgatctgccccatatgctgactaaactggttttgtcctgttacagaccatcacctgctcatctacacctccatgcctttgctcatcctggaggatatttgttcagtctcagaacttgagggctaacttttcattccaatttcaactccaatggagttcttcttgaaatgtttcttgatctctccaattagaataaactacttacttggtttcagttttacttaaatatctctctgtccaccaagtaatgaggttgctttttttttcttttttttcttttttcttttttttttttttgagtcggagcctcgctctgttgaccaagctggagtgcagtggcgcgatctcagctcaccacaacctccgcttcctgggctcaagtgattctcctgcctcagcctccccagtagctgggacgacaggcacgtgccaccatgcctggctaattttttaatttttagcagagatgggatttcactatgttggccgggctggtcttgaactcctgacctcgtgttccgcccacctcagccttccaaagtactgggattacaggcgtgagacaccagtaataagctttctttacgtcggagatcctgtcttatttatctttacatttataatacctgtctctttgctttgcacacaatatggacttaatacatgcttgttgaatttaacgttattaatgcaactcatattattaattgtaatggtagtaaattctacaataacacacctggcaataatgcaaattagaatagcttgaattgaaacatggaatgattggaaagcagctttttctcctctacctgattccttttctcaggaaggagaagggaacatagaggcctctccctcatggggatgctggacagggaaaaatcagacaatcctatttcaggaaacagagaggtgggggttagttcccagtattctcccagcccattctctctggatcaggccaacaaaacattcaccaattaacgaagagattcctggaatcacagttgctctcccagaagtcccagccaggccccagaattctgcccatcaatttttatgttagagcagtcaccactaggtggtgccgaacttcagcccagggtaggtgaaatttgcatcaaatagactcagaacttccagatgtccagttgcacaggctcaccttggccatttagctaatctcataataacacaaccctacattttacacagctgaatttctggggcactacttattgcattatggcagttttgttgtatcattttctaaaaatctttcaatatcagatactctgccagccactttacaggctttatctctaatgctcacagtaacctgtatggtaatgggtactgatacttttcttcttttagtaaagaatctgagctgggcatggtggctcgcacctataatcccagcactttgggaggccgaggcgggtggatcacccgaggtcaggagttcaagaccagcctgaccaacatggagaaaccctgtctctactaaaaatacaaaattagctggacgtggtggtgcgtgcctgtaatcccatctactcaggaagctgaggcaggagaatcgcttgaaccccacgagatggaggttgaagttgccaagatggctccattgcactccagactgggcaacaagagcaaaactccatctcaaaaaaaaaaaaaagaagaagaatctgatgctaagaaaagaaatgtctcttgcccaagagctgtgccttgtacagctaagtgacaggtgacagacctaagaattacattcaagcctgtctcactctaatgccatacttgtcatatttctgctatacttcaatttaatgatcaaagaaaggaaggaaagagacagtggagaagaaaagtagggaaagaaacagaaagagaaggggagaaagatatgtttgacagaaaagtaaatgaagtatgttaccatctgtttttttcaaccccagaggtctgattcccccgcaggaaagagttgcttctagcctgtcctttatctctgcacctgccctgcttatctcctgcaccagaggctcctaccatgaccattaatggactgagtttttgtgtccctacgaaatgcatagcttgaagccctaacccccaatgtgatggtattaagaagtggggcttcaggaaggtaattaggtttagatgaggtcatgagggtgagttttctctctctctttctgtcatgtgaggacacagcaagaaggcagccatctgcaagccaggaggagagtcatcaccagaacctagccacacaggttccctgatctaggacttcccagcctccggaactacaagaaataaatgtctgttggttaagccaccccagtctatgacactgtgttgtagcagtcagagcaggtgaaaactgtaacttgttattctctaaggaaaatacaggtcttcttctcaggcctgtcttcagaaacaggttcacatccccatcttccagtcattgaactaaatggaaaagtttttgtcttcctagtcattgtctgcacctaaacacaggcttgcccatctgtagtcctagtctgttccttttctttggtgaggataacccttcctgtcttgctttaacaccctgtattttccgttcattagtgactcagacctctgataatggtatactagttaaccccctgtctcgtctgactttaaatgattgcctgttttgaccttgaggaaatatgagtccactaggaactacaatctttatggccacttgaaaatctttattccacttaaggtggaatagggtaccttgccacagaggaaacaagtaaggagagaaagagagtaaagatcagtgagaggaagagaaaactaaaactactagtataaaaagttctgaaatttcagcaaattattttgcttccaactgtacttaaccattctgccctttatttgcaataaaaatattggggtattattatctttgaaatgcagattatgtggttaaccattgttcactttctaaaccctgtaagtatttaacttgtggatggggaatattgtttgggactgtattggttgcaaaccaaaatgatctacactcacacagcttagtgtcaacattaacatgactttactttttagctgtctttgttaacatgactttactgtcctactgtcttcatcaacatgattttactattccaagaaactcttgccttggaagataaaaatagcaaatgattttcttgtccctttcagaaactttttgaaaattcatttaaaggaatattaaataattcaactttcacagttagcatcagatgaatgtttatgctccaaaattcattgtgaaaccttcagcttgtgtgtcttccaaacttaaattattatgtagtgtcttaaccaatgttaagacattagtgtcagcattactgacacacaatcaaatgctcccctatggaaaaacttgccttaaaaaaaaaagaaacacacacacacacacacacacacaaaacaaaaaaaaacagaatttctaccttccgccccccaccaccacacacacacacctaaattctcttaaatatcccgactttgccttcctcctcccagagactactaaggccatgtcaaggaagctgtctcccctatggtggtaaacaatgaactcagctctgtcatatgacaggctataaaaagctgattttgttgatattctgggaaagctaccattcagcaggcaagtgattgaagccatttcctctcaaacttatgaaagtaaactaaaggtctgattctgcccagggaggaagtttctccactctatcatatagaatccatatgtccatcatacttttatttgaaaagaagggatgctaactctcagaagcatgtcatagtaagcacagaagtggaaaaaaagaattgatcatttttgtgagggaaaacttaatgaaaaaattacaaaatcattataaatacaattcatttgaagttatgttttgagattacattattttctctctggcatttagacacctaaaattcactttaaaatatgttggtgaacaaatctcattctccagaagtacatttttaaaatggcaatatttcataataacagtataaaatgaaaataattgactatctcttgccttgtgggacttggcttttagtctaaatagatatgaaacaaaatgacattcatctatatgagacgtttgttaacttaaaagaaattaagtcagaagcctataaggctaatccataaatcagcaaatcagataaattagtaaaacttttccagaatattatccaggggctccttactcctttgcaatttgttacctgttttacatgtccttttaggaagggttcatttcccattgacaggcaaaaagaatatatgaaattagaattttcaacagcttgcaacatttgtgtcatttttgatttaacaattttagaagacttgttccaaaattacacctgaatttcattttctttgtagttttctaaaatgctgctactatcaggacataataaaagccacacagccagtactagaaatgctgtcatgtaaccactaagaccacactaaaaggcaaaatgctgcagctgaaagtatttttaatgacttgaaattgcttggaatgctttctagaagtaaaagggtgcagatttatttacctagtatacttacctaaattaatttggcaagattattttggttcaaatcctcattcaataaaatttatgttaatatttttaagtggtttttttcctgaaggatataatatattgcattaacacaaatttacaacagtcatgaaagtaaaaggtaaattaagccatttctgaaatatgaataaggactacatttttaaatagactacatttatgattttatgtgaccttgcagataaacatcactatgtaaactgttaatgagaacaaatagaatcacattctatttttagtttttcctgatgtatagtttccattagagatatggaggaaactttattcttgcataatttttgttttagaagtttgggtttttttgtgttttttttttaacattttaagcaaatgggctttttatatatctttttgattcggtacattccttactacagaatgaatcctagtgaaattctcactataggccatttttccatgtttttttcttttatggaaattttaaccatggttactaacatataaataaactcttttaactgcaaagtcagaatgggtatactttgttatgaacatattaacttattccagtttcatgtcttgtgtttttctgcactcattaacatctccttggtacttgggatcatggcctggccaatacgcataaagatgacgagatatctatggactacagtacatctgtttaataattagtaattgttatgcattgtaaatgaacgattttgactcataccactgacatttaattagtttttactatattccaggtacatatgagaatgtcacataattatcttctttaatttttacagtaactgttatcattacttcagaaaggaacaaaactccatttagagaggttaaatagaaggtccaaaacatgtagcaagtaaaaagtatccagaacttagatccaggtttgtatactactccctaattggggctcttaactactttgatgcattgccttttaaacttactttcttgattatctatttgactaacatctccccaggacacacaaaatacttgaattcatgctattatggcctgaatgtttgtgtccctttacagtgtatatgttgaaatcctaaccctcaatgtgatggcattaggaatcagggcctctgggaggtggttaggtcatgaggttggggccctcataaatggcattagtgcccttactaatagagacagagacctggctcctgctctttgctctttgccacgtgagggtacaatgagaagacagccatgtgcaaagtaggatgagtgcccttgcaagacactgaacctactggtgccttgatcttggtctcttcagcctctaaaactgtgaaaaataaacgtttgttgtttaagccgcccagtttatgctaaattgttatgatagcctgaactgacggagacacatgcgtaccacaaacaacaaaggctcaaggatccttaaaataaaaaccaagactttcagtgggttgtaacatcacgtagtggaggtaggtttcctctcctctatacctctcccaagtaggaaacatattaagatcacaggggagttaattggaactattatttcatatgtaaagaatgtattctttataacttcttgggaatatatcttaatttcttttaaagaagattagtctaagttatagtttagtctatagttttgtaggttagtctaacaacattttcgttaagtctaaagaataatttgcaaactatgtgtatgtgctacatttgtgtattgagtgggtgaagatcgagttcagcacagcatgcctcttaggtaaatatgtaaaattctaggagttatttttcaaggggtacaattctacacccaaacattcccctcctaattctacctcctaatcgtagaagaagcagccccttggttatttagcccaagaatccaatgtgacttatctgtaatcctattagtccattctattcccttgatattgggaagttttgcctgtcccaaaagaggccattcggaggttattcttggatgattcactcacttgtgaaagcaaattgtgttggcttcaagatgctgcatttttttgtaaacaatgccatgacttttacatttctttacatcttggagctacccacttctgcaggtccattctctctctgtcaccatttaaaattatgtaaggtaagttttcataaacccgtaaaataatggttacataaattggaacttcctaccactcatatcttagttgtattaaatcaaacatttactactatttccatctgtttcactccatgacagcatcacctacttgactctgttatactaagagttcagtgagaagagcatcagggagcttagttctatgtagtatcacagaaccaaaaagcaccttaaacttgtcagggttctgtttcttcagctgtagaagaaaccagggttagggttgggggttatggggaagataatacaagtacaggtaggcagcctgtgtgactaaaagttgtatctggtatgtttgtcacttagggacttttatggacctagattctaaaaatcatcccaataataaccttaaatcatgtcagaaaactctacaatggaatagatttttgcattcagaaattacgtgcattttccccagcatggtatccacttacctaacactttatgctacataaaacgataaattatctagtgtgatctaaagccatcagaaacatttaaaagttttatagtacagtattttaaagtttactaaccattatataaaattaataagatagtttatacagtctcttgctttattgattgtgggtaataacctgtagatgggaatatagtggaataatgtgcctaactgcctttaaaagaacttacttaaacttcagtaatttatttctgtgtttcttggattccttttacttctgaagtcttagtgaggaacggtcagatattgagttgctgtattcactaaatattttgtggagaatttctttaaggaaagatgtggattttaatgcataaattttttagacagactattgaagttgaaatttcatttcaagaggcagtcagctttgtttaactctatatttttagtatccaaagttactgagccagactttgctttaattaattactataggatgtgaggcagttccagtgctgctttttctattaacttgcaatttcctgtaggaaattaataaaatgaaagagggggtggccggcaagaataaatatatgctacagttgcaagtcactaaaattcatcagaataaattaaactgcacaggtttcctttttttataattctataaagcttctcaattcttaaggcaaatttgacaaagaaacagggccatctaaaaatgatcaactttcatataatatacattaattaattgattagaatatgaaatttgtcagatcagtgttgtttaatggttaagaaggtaaattctagaaacagactgcctgagtttaaaatctggctctgccattactagcatgagactttgaacaatttacttaacctgctgtacctctttatgtttaagatgcaaattataataacacttatagggttcgtatgaggattaaattagttaatatgcatagtacctggtatatacaaagtactacacaggcattaacagcaattagcatctgttttttcatcagtattaacatttaagaaaaatcatcttactttagctatccctttctgcaacctctggagtcaaatcttaaggtgacaaatttaagtttttaaaatatttgcaaattttgctttgtttttctgagtcctttttaagtgagttaccaggaactccaatgaatgcatgtcgttgtactcaggtacttttttttttttttttctttgagatggagtctcgctctgttgcccaggctggagtgcagtggtgtagtggcatgatctcagctcactgcaaactctgccttctgggttcaagtgattctcatacctcagcctcccgagtagctgggattacaagcgtgtgtcaccacacctggctaatttttgtaattgtagcagagacggatcttcatcatgttggccaggctgttctcaaactcctggcctcaagcagtccatctgcctcagcccctaaagtgctgggattataggtgtgagcaatttcacttggcctactcaatatacttttaagtgaatactatgggtaccaaattcaagtgtctgataattttaccccatgagtaaaaggatttctcttgctgagatttcagaaattgttgagaaaatatttggaagaatgttagcaattgaccaggatataaaaagaaacacagaaattactcgcatttagatctgcacctcaaccacattgaaagggtggcaggattttcagaatgtggttgccttttcattgtcatgcttatgttcattctacaatcaatatgtattgccactgaaataaagatataatacaagatagaattaaggcctactgctttgactctattgtttatctagttaatagcgttaacaaattttagttctagcttcctttgaactgcatgtaaatgctgcctagtcaatgacatacctgaaatagcttcttgttctttattatgtgtttatgtgctcatctgagcgtgtcttgttactaggactgccttataaaagtcggttttaatttcccgagttaattaaaggtttctcttacaattacagcctccctagttttcaggggtttgttctttttgtgtgtatgtgaagtggggaagaaggtagttggaagagtactaccttttatcattccatcttatatgatttatcttcgctgtgtgtattattcacctattatttttcattaagtaacaataagtgattgaaacaaatgttaataaaatgattaaaatatatttagtaacaaatttatctgtttttccccctttctagtactggtttaagtggactggagtgagaaagacattattcgaaagatgttgcaaatttatcgtgttttcatgttggaaatgacataaatgactttgtccaaatgatgtctttttcagtgtagaatacttaaaccagtgctaggaagaaagttttttattgtaagaaagtagatttctttttattataagtaaataaaatatcctgattatggatatttcataattcgttcattcatcagtttatggacttttggcttgtttctagtttggagctattatgaataaaagctgctatgagcatgtgtttataggtcttcttgtagacacatgatttcatttctcttacgtaaaagtccaggaatagtactgctagattgtatggctaggtatatgtgcaactttatgagaaactgccaaactgttctcaaaggggcggcaccgctatgcattcccactagcaatgtgcaaaattttcagttgctccacacaccattaattcttgaactagtcagcatttttaatgttagtcattctattgggtaccttatggtgatttgtttttccatttccctcatgacttccgaggttgagcatcttttcatttgcttattgaccactgatataactttggcgatgtgtctgttaattttaatgatgttcagtttattgactttttctccttttatgaatcatgctttgatgtcaaactgaataattttttgcctaactcaaggtaacaaggattttcttatgcttccttctaggagttttattgcttttattattatatttaggtctgtattgtattttggcacatgttttgtttgtttgtttttcttaatgttgtatgtgataagggctgaaggtttttttcataagaataccgaattgttccagcatttattttgccaccattggattaccttaaccactttgttgcaaatcaatcaactatatatgtatgattctatttgttgacttcattctgtttcattgataaataggtctatcctaacaccaatcccacaatgtcttggttattgtgactatattaggtcttaaagtagtgtgaagcctccaatttgtacttcttttccaaatttgttttggctattctagatcctctgcatttcccgtataaattttagaatcaactttttcaatttatcaaaaaaatcagattatgaatgagattgggttgaatctatggaccaatatagggggaattgatatctgaagtcttgtgtctcttctaagctacaagttaaataatattacctcttttatttaggttttctttaacttctgtcagtaatggatttttagtgaaatattttaataaatttgtacctaaatttttgatactactataaatggtagcttttttcattttgatttccaattgtttgttaccattgaatactgaaatgcaattaatttttgtggatttatatttttatcttgtgacattgcaacactcaagttattaattgtagtagcttttttgtagattccttagggtttcctatgaaacaatattgtcatcttcaaataaacacaattttagttcttcctttttcatctgtatgcctattatttcttttacttgccttgttgcactggctaggttgtctagtacactgtggaattgaaacgattcaaacaaatacccctacattatttcatatattagggggaaacattcagtcttttaccattaagtatgatgttaacttcaggttttgtaagatggtctttatcagagtttaggaaattttctattcttagtttgctgagaaattttttttaggaatggatattgacttttaacaatatttttcttattttttgagaaaatcttgtggattttacttagtatagtttgttattatggtaaattaaattgatttgtttttccaatgtcaaattgacattgcctttttaggattaagctcacttgtcatgacatatgttttttgtgcatggctagattcaatttgccaatttgtaaaaggatttttactgagatgttgataaagtatactagtcagtaatttttattacttgccatgtcttttgcaactttaatatcagaataatgctggtttcatgaaatgactggggacatgtttcctcctcatctgttttctggagagtttgcatagaattgatattatgtcgtcctcaaatgtatttgatagaaattgcccactgaagctgcctagtccttggggttttctgtggaatagttttaatgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctcttgtatggagttcttgaattgtcagttagattagtttcattgataatgccattatgtgttccacatacttagttctatattcttactgattcttcctcagagaggagtgttaaaaatctccaactataattgtagtcttatttatttcttctgtatattctatcagtttttgcttcatgtattttgaagctctgttatctttaagcacatacacattcagctgtctactattagctagaagctgataggtcttcttgattaattgacttctttattattatataatgttatacattttcctggtactattccttgatctgaagtcgtctctttgtgcctttaatatagccactccagctttctttctttaattaaacatttttagatttcttttttattatacaggtaagaaacatttaattataaaaatatgtgaaaatttgaaaatactgatagtcaaaaataggaaggtaaaatcagctgtaagctcactacccaaaagtaatcactgttaacaactttgtgtatatacctatttttaaaagttttatttttatggtaaaatacacatgacataaaatttactatcttcattcttttttagtatacagttcagtggtattaaatacattcataatgttgcacatccatcactccagctttcttttgtgtttgcatgaaatttctctacctttttatttttaatctgtgttatatatttatatttaaaaataggtttcgtatgggcaactatagttggcttttacttttgtatccaaaatgacaatctctaccttttaattcatctatttagaccatttgcatttagtgtaattatcagtatggttgggataaaatctattatattattatttgtttacaaggttcttgtttggatcttgttgtcctatccctgtagtctcatacatatttcacacttcttttcttctactctacatgtagccttcataagcttattctaataccttcaaagggccaattttttataccccactgatatttttacaagctattctctgcctacttaagcagacggagttttgttcttgttgcccaagctggagtgcaatggcacgatctcggctcactgcagtctctgcctcctgggttcaagcaattctcctgcctcagcctcccaagcagctgggattacaggtgcacaccaccacacccagctaattttttgcatttttagtagaaacggggtttcaccatgctagccaggctgcctcaaactcctgacctctgttgatccacccacctcgacctcccaaagtgctgggattaggggcatgaaccaccgtgcctggcctttcccctttttctcaaccacacttaacaaattattgctcatccttcagatctcagtaaaattgtattcctctaagaagcttttcttatatttcaagtctagagtaggtgcctttccctactttcgcttcactgtccctagaattaatagaattaatatcaatattaattatttaatttaaactgtgaatggaagaaagtatgctagagagtgaatatggatgtcttctcttcctttataaaaggagaattccctagccagattgccatgacagcaatccattctttcacactgttagaatgtcattttgaagtgcctctgtggggttcttttgcccaccctgcctgggatcatctaaatgacgagttaataggtacagcacaacaacatggcacatgtatacatatgtaacaaacctgcacgttgtgcacatgtaacctaaaacttaaagtataataataattaaattaaattaaatttttaaaaaatgagagaggtccctgacatccctgcagggatatgggttattatgtatagtctgtccaactataatgttgcatttttgtttcattgtttcttagagattaataccccaaagaggggtctatttcctgtaatttctgtatttatcaagctgaaaaagcatgtccataagtttagaaaactgaagctgagatgatgaaaatactgtgctgttgtttttcactaatagttgcctgattatatcactgaaagaatatcaaaaactgattttatgctattgcagtaagatagctgctggttgtacttggtatccttatgaaacaacattcttttggcattagattatcactaacatttaaataaccttctctaaattaatttttaaaatttccacaacaaagtgcatcaccattaaaacatcacgttagtggcaattataaaatggtattaaataatagaatagatgcctgaataataatatgtagttttttaaaatccttaaaagataaactacagtaatgggtattgatgaaaaatgtggttggtctatttatagaaaagctaactatagcagacatttttaaataatattttttatttctcctttaattaagtttgttcagacattcatagatcatcttgtacctacaaaaagatattatttgacaaccaagtacactctgaaaagaagaactttataagttatcttttttaattttccttcattgacataatgacagtgaatctcattatgttggtgctaagaatctaccattgtgttttgttttatggaaagaaaatttaaattatgtcgtgtttaaaaaatgagtaaagtaggtcaacacccagctcactccctgacatcacataaatgtaagattaagtaagtgaatgacctaatgttcagccttctaaatattcctatatttcaatttagggagcaaatatgaaagtaaaattaatggatcagttcatacttttaaccttgagtcatgataataactgtattgaagaaaatatcatgatcttgatatggtaggcaatggcaagttacttgccccacaaaatatttttaagtaaaaaataatttcccaagagaattttcaagactcattattggctgaagatcagaatattccagtggttcctttaataataatacttttatatactcattttaatcaaactatagagttcaacttttgaaagcaaaagtttaaattttgaaaataaatttttgaaagtacaagaagatagttatatagacatatgtgatagtgagttaccagtcccacagagatccaagtattaaaatgagcgattgctcactggacaaggcagactaaatgtttttttcctaagggtttcttcttaacattcctgtctcaggaagggctttaattgacagggtaaggcagaaggacaaagaggaagaagcagcactggtttgatcattgacaaagcactttcattttatgcagcctatcttactgtccagcttggtcagaaaacacaaaaagttagtcatgagacctgagtttgagttccagctcttctacctacttggcataaaatctgtggcaagttaccaagtttctctgggccccagtggcttaatccgttaaaaagatgattgtaatgtctacaccacagaattactatgctacctaaattccataattatgtgaaatgaacattttcagatggcaaagaatattacatatcttagtttcaggtaacatacctgatcaagttagaagaaaatctgaggagcacatttccaagacaacccacctacagatttctgatatgaacagacagtggctattaaacaaataaacaaacaccacaaaattaatcctaggtgatggtagtatgaaatgcatagtttatttctatacttatttcaggcttaacttattctcacttctaactgaatataatagagtctcacaagctaagacctggggctgaggatctcctcccgtattgtgagaactctacattgtagaaaagtctagttttattatttgaaattaatagacctattctgttcatgtgttaatatttgaattatttaaagtacctaaaacgaagttgctattgaattttaccaccacagatcaacacatccactggtatgtggtgtgtgtgtatgtgtgtgtgtgtgtgtgtgtgtgtgtgtgtgtgtgtattgtaatatagaatatgctaaattcataagtttccacttgtgtttttttcagtacttttcttaaatcacaaattacacgaagcttaacaaacatccaaaaacactaacctaactggaaaatactctaccatctttaggtcaatgttagtggactgtcttcaagtggaggttgacttcagaatagaggctcttttcatttttaatctatcttttctccttggtcttttatcaggaatgatgtaacaaaagtatatgtatccgtgaatagaaatgtgtgcaaagaataagtggcagtagtgggagaagcctctagatctgtgtctatttagaaaggctggaaaataagaaaatagtagaaccctgaatatatgctatacattttatcttctcagtgatttcctgccttataattctttttaaaaatcacattatagcctcaaattgccaggtaagaggagaataagtaggaaaccaggctgatttcataaaccttcagtattgtcccacataagcatgcattttgggcctgattatgttctctgcaaacactgtccagaaacagattcagtgaattacagtcttaggactaaccaagacaattttgagcaaaaagaaacccctctctaatgtgacagtagaacataagaaacatcagtgttatcactgaaattcagcaagtgcagatgttaatcactgcacatctagctctacctgccaaattggtcagattctttgagtctgtggccacacaatgtgatctgccaactgcagtttgtcacagtctgccactttgttctgcaaaagaagactgcctacattgtatcactaagttcttttggctgttactccacgggaatgttgctaaacaatgagaaatccaatgaaacattccattggcttaagaatcagatattgtataagtcgttcattcattaattcaacaaatacatagtgagaagttactctgtgccagataccggggcactcataagaatttctatagatttaacatcgttagtaatgtatatatagctaacaagtaaggccatatattgtcattagccaatgtcttatcatcagggacagacacatacatatattacagaaggacgtgaagaagagtgagcgacctgtttagacacacttataaggacacacacagacacacacacacacacacacacacgtgaaggaagaaaacagccttacctgttaagtttcagtcctctactacgcactttaactattttcctattttttagcagaaccaccttataagatgttaaggtgtttcttcacgtaatgcctgtctctttcatctgtatcatatgccctcatcactgtgaggaatgggagaaagaaaattggtaactctgatccatactatgcctctgaaatattttagcaacagttggaatagaatcatgtctggagctatgtgtgcgttagaataggtatttaccaaaccttatttttctatttcatcaaatagaaattctgcttttttaacctaactgttcctcttcctactgcattgctggataatttgcaagaaaattgattccctaaacccaactctcaggctagattggaaataaagagcttatagacccttcagaatccccatgcctttagaatccccaaggcctccatctgcatgtttacttacacaaatttggccctagagccagtgaaacacagggacataaagacatcctcattaaaaccaagaatttaagctccatctcgtggtcggatttgaatgaccaagaacataggttttccttgattctttgaattgaggatcaatatgattatcctgtactatttaaaaatttttcggaaaaaaatcatgaaattatttatgaggtcataataaacatggattacattcccagcatgcatttcatgaggctaaattatctgaggagttctagcacctgaaagaccataatttatttaaccaatatttattaagcactaagtataaaatatggcactagggctcaggcaaaaatgaatgagacacagccttttatctgaaagtcatttacaatctaataaagccagatgcatacatatatgacagaaggacatgaaagaagagtgagccacctgtgtggacccactgagaaacacttaagggtgattatgttgaggtacaccttagcaatcttaattttccttcttctacctttttgtttcactagtaaaaataaatcacctcttatacaagaaggaaaagaaactgtttcatgcgctgaattaacacttagcattaaatgcctatgctaactggcccataaaaaagtagttttttttttttggtttgtttttaattgagagatattttaattgagcctatgacataggctactttcccaaatacaaaattttagcatatggctttgattttacgttgtgtttttttttttttttttctgttttaatgtttagtcacacaaacttgaagttatcgtggctccaacagaaaattctagatgtcattagccagtgttttatcatcagggagagactattttacaacaaaattccaaaacaaaacttttcctttattacacagtactcgttctccattccctcctcttttagctgctccattagtctgtgcaaattgcctttcattttattgctttccagggcttctaagtgcttgtttagaaacaaattttcttaagtccaagctaaagtccagggtttatttgattccgttttttttttttttttggacagtcagccaatgctttactcactagtttcagtttctgtgaataagtgccagaagcatggagctgctgagctttatgaaaaggtatagacttttattaccatgaagccacactgcaagcaagtcttgcctgttctgtccctaaactactttcaggttaaccaacagttggaactcatttggcttattgtattattcaggattttcaaatgatttgccattatattgatggcttaatgccctattcaaaaatgtttcatagttttattataaggattttaatctgtattctgctctcatgttagtctagcaatcagcagtcattaatatgatgcgactctattgtagttaaactgttgtcagagaaaaggttattttctagaaattatgttggctgtgcccttcctaacagttcttcacatctctaatatttgaaaagccagtgatatttattatgctattttccttctagtcacttagattacactttcctcacactaccaggaatctcctaattggcaaatccagaagaggctctccagtcctttccttacttcactggctgtagctttttgtactgccagttcctccttcactaagtcattcaaaaatacatattgagtcctacgcttgtcccagatgccatgctagtcactggcaagacaaggtgagcaagagaaccacggtcatcacccacacagagtctattgtccagtggcagattccaagaaaacctgcaattacagcccacaaaactctcttccctttcatgtcacaattgtgttcaatccagattttatctaccttatcagacgtctctatcacagtatcatttgctggctgcttgcccttgtgttaaggatgactgttgctcaggcatccctcctaggctctctttttaccccacctgttctctacagataatttcagctcctcttcagatttcaaccacactccatatgcctgtgatgccagttctctggatctgcaagcccatcagccaccagcttgctagacatctcccctttagtgtccctttggcatcttaaatgaagcatgttcaaaattgaactcattaactttaatatgtactctttatactgtttcccccctccagtaatacttgatttcttggttaattgcattactatctatctagaatattttcactactgaattctgtgaggatagagaacttttctgatcaggcctatatctctaggttttaagaaatttaggaattcaaaatatttgttaagtaaattaagaggttttcttgactcttcttcctcaccgctagcatgagttgttcaagtgatcccctagtcctgcaaattataccaccaaattctctcaccaaatccatcccttttttattatcattctgcctaattcaagccctttcttttatacttttaacatactgtttcttctctgtatcactgtttctatctctgtccctctcagtagcaccctgtactttatatgaaaattaagttttacttcataagtaaattcagtatagatgcaagtgcttgaaataggcagagtttttcatgttcttccaccccaagtcactggttcttgccactgaacactaaactaaacatgaaacattgccttatctcaaagcaggtctttttctcctcacctccttcattcacgtataaactagaattctatttccaagaaataagtcaaaaaaaaaaaaccctaacacctggctaaggtggaggaataggactaggtgggagaggtggcagtgaggttgtttgcttggagatgaaaccaggaaatgctctaacactgctgtgttactacagccccaaatccacatgtgaaaatggcctccaaaatacggctcaatattaggctgctctctttttatcatttatgtacatcctctttcaaagcatgagtaggacacagctttttctctgagcctcactctaaaaatcactgaggttttaacattgtcagaaatttcataatttattggaacatgatattcattttccccttcatcatttcattctgtcccacataagtaaatgtcatcttcatgcccatcaagttccctctactactgattagtaagtttctgttacaatagaatatattgattgtcttccctagttgtgcgtatctccagctttacacagtgtttatggcagggagccccattacctgtgtgctccagaactgtaatgcttcaagtaattccttcatcaggatacagaaaggagatggaaccatctttgggggaaattactaagtgctttttgcaacatatgtcaagactttggatattcgtgatttaaaaactgatctctgatagtttgttttttcctaatgaaggcaggtcggcctgaactatatcacatccagttactacagcctgtcagaggcaaagggctctggttccagtgttttctctatttagtccgtttttcatagtctctagagcaccccttcagatcctcatctgagaggcggtacaaagtcgtggtaaagagtgcatgctctgaagtcacactgacttggctctatcaaagactaactttgtcacttctgtctcacccctttgtgcctcaatttcctcattttataatgggtagatgatatggtttggctccgtgtccccacccaaatctcatcttgaattgtaatccccataatccccagtgtctagggcaggacctggtgggaggtgatgggatcgtggggatggtttcctccatgctgttctgatgatagtgggtgagttctcatgagatctcatggttttgtaaggggctctttcccctttgcttatgcactttctcaagcctgctgccatgtaatacatgcctttgcctctctctcaccttccaccatgattataaatttcctgaggcctccctcaccatgtagaactatgagtcaattaaacctctttcctttataaattatccagtctgaggtatatctttatagcagtgtgtgaacagactaatacaggaaataaaagcacctacctcataaatagttgcaaagattaaatatatgttattcaatctttcttagaaaagtagcttgtgtgaatttgatcctgtcattatgatgctagctggttattttgcccgttagttgatgcagtttcttcatactgtcaatggtctttacaatttggtatgtttttgcggtggttggtactggtttttcctttccatttttagtgcttccacataacaatattaaccttaagtgtaaacgggccaaatgcccccaattaaaagacacagactggcaagatggataaagagtcaagacccattggtatgctgtattcaggagacccatctcatgtgcaaagacacacataggctcaaaataaagggatggaggaagatttaccaagttggaaagcaaaaaaagcaagggttgcaatcctagcctctgataaaacatactttaaaccagcaaagatcaaaaaagacaaagaagggcattatatgatggtaaagggatcaatgcaacaagaagagctaactatcctaaatatatgtgcactgaatacaggagcacccagattcataaagcaaattcttagagacctacaaagagacttagactcccacacaataatagtgggacactttaacaccccactgtcaatgttagagcaacaagacagaaaattaacaaggatattcaggacttgaactcagctctggaccaagcggagataatagacatctacagaactctccaccccaaatcaacagaatatacaatctactcagcaccacatcacacttattctaaagttgaccacataattggaagtaaaacactcctcagcaaatgcaaaaaatggaaatcataacaaacagtctcttagaccacagtgcaatcaaataagaactcaggattaagaaactcactcaaaaccgcacaactacatagaaattgagcaacctgctctggaatgactactgggtaaataacaaaatgaaggcagaaataaataagttctttgaaaccaatgagaacaagaacacaacacaccagaatctctgggacacagctaaagcagtgtctagagggaaatttatagcactaaatgcccacaggagaaagcaggaaagatctaaaatcaacaccctaacatcacaagtaaaagaactggagaagcaagagcaaacaaattcaaaagctagaagaaggtaagaaataactaagatcagagcagaactgaaggagatagagagacgaaaaacccttcaaaaaaatcagtgaatccaggagctggttttttgaaaagattaacaaaatagataggccactagccagactaataaagaagaaaggagagaagaatcaaacagacacaataaaaaatgataaaggaaatatcaccactgatcgcacagaaatacaaactaccatcagagaatactataaacacctctatgcaaataaactagaaaatctagaagaaatggataaattcctggacacatacacccttccaagactaaaccagaaagaagtcgaatccctgaatagaccaataacaagttctgaaatcgaggcagtaactaatagcctaccaaccaaaaaaagcccaggaccagatgggttcacagccgaattctaccagaggtacaaaaaggagctggtaccattccttctgtaactattccaaacaacagaaaaagggggactcctccctaactcattttatgaggccagcattatcctgataccaaaacttggcagagacacaacaagaaaagaaaatttcagtctaatatccctgatgaacatcaatgcgaaaatcctccataaaatactggcaaaccgaatccagcagcacatcaaaaagcttattcaccacgatcaagtcagctttatccctgggctgcaagtctggttcaacatacgctaatcaataaaatccatcacataaacagaaccaatgacaaaaaccacatgattatctcaatagatgcaaaaaagacctttgacaaaattcaacatcccttcatgcttaaagctctcaataaactaggtattgatggaacatatctcaaaataataagagatatttatgacagacccacagccaataacatactgaatgggcaaaagctggaagcattccctttgaaaactggcacaagacaaggatgccttctctcatcactcctattcaacatagtattggaagttctggccagggcaatcaggcaagagaaagaaataaagggtattcaattcggaagagaggaagtcatattgtctgcgtttgcagatgacatgattgtatatttagaaaaccccattgtctcagcccaaaatcactttaagctgataagcaacttcagcaaagtctcaagatacaaaataaatgtacaaaactcacaagcattccatacaccaataatagacaaacagagaaccaaatcatgagtgaattcccattcacaattgctacaaagagaatgaaatacctaggcatacaacttacaaaggacgtgaaggacctcttcaaggagaacgacaaaccactgctcaaggaaataagagaggacacaaacaaatggaaaaacattccatgctcatggataggaagaatcaatattgtgaatatggccatactgcccaaagtaatttgtagattcaatgccatccccatcaagttgccattgactttcttcacagaattagaaaaagctgctttaaatttcatatggaaccaaaaaagatcccatatagccaagacaatcctagtcaaaaagaacaaagctggaggcatcacactacctgacttcaaactatactacaaggctacagtaaccaaaacagcatgatactggtaccaaaacagatatgtagaccaatggaacagaacagaggcctcagaaataatgccacacctctacaaccatctgatgtttgacaaacctgacaaaaacaagcaatggggaaaggattccctatttaataaatgttgttgagaaaactggctagccatgtgcagaaaactgaaactgaaccccttccttacaccttatacagaaattaactcaagatggattaaagacttaaacataagacctaaaaccatagaaaccctagaagaaaacctaggcaataccattcaggacataggcatgggcaaggacttcatgactaaaacaccaaaagcaatggcaacaaaaaccaaaactggaaaatgggatctaattaaactaaagagtttctgcacagcaaaggaaactatcatcagagtgaacaggcaacctacaaaaatgggagaaaatttttgcaatctatccatctgacaaaggatccagaatctacaaggaacttaaagaaacttacaagaaaaaaaaaccccatcaaaaagtgggcgaaggatatgaacagacacttctcaaaagaagacatttatcctgccaacaaacatatgaaaaaaagctcatcatctatggtgattagagaaatgcaaatcaaaaccacaatgagataccatctcacaccggttagaatggcagtcattaaaaagtcagatgctggagaggatgtggaaaataggagcgcttgtacactgttggtgggtgtgtaaattagttcagccattgtggaagacagtgtggtgattcctcaaggatctagaatcagcaatctcattactgggtatattcccaaaggagtttaaatcattctactataaagatacatgctcacatatgtttattgcagcactgttcacaatagcaaagacttggaaccaacacaaatgcccatcaatgataaactgtataaagaaaatgtggcacatatacaccatggaatactatgcagtcataaaaaaggatgagttcatgtcctttgcagggacatggatgaagctggaaaccatcattctcaacacaggaactaacacaggaactgaaacatcattctcaacatcaaactaacacaggaactgaaaaccaaacatcgcatgttctcactcatgagtgggagttgaacaatgagaacacaaggatgcagagaggggaacatctcacaccagggcctgtcgggggttgggggactaggggagagataacattaggagaaatacctaaagtagatgacgggttgatgggtacagcaaaccacatgacacgtatatacctatgaacaaacctgcacgttcttctgcacatgcatcccagaacttaatgtataataataaaaaaggacctagcgtatatagactttctatatttagacattattaacttggtacactcatgcttaaagttgccctgatctgccacccccacccccaacatggcatctcgttacctaaaatatgcttaaagttacaaatcctttgcctacaaatggcacacagaccctttgagatctgtccacactgtgcctctccatttgtatctctcaacttttcctgttaatcgtcagtgtgttttaaccatgtcaagctgcatgccagactctctctggacttcccaaacattaataaatactagtcctttgtgacccagctttctggccaaatgctgtcttctcctggaagattcctggctctagcagttagtcaacttcatatagttattcaagctgtgcaagcttgtatagcctatgtatcgttgcattgtgaccttttttttcccttagggtctttcccacttgaactattccacctgttaagctcagtgcctagcgcaatggtgcactgctgaatgaatgaatgctgtaaatagaaattagtattatatatgtagacatgggattttagcttttattaattaagcttttggtcatttagtgtcatacatcttgaagtttttgcaagggtgaactcacatgaaatatacacatatgataaaaactacctccttggagagctgtttcctggggaatctatagatggtcatgctagctatgactgttctctagtatatttttggaaatggatcaaacaatatactatcccatttttttttcaaatctgtttccctctgaatttctcttgggttgctggacactggcaccctctgtcacagctttcttgctcccacagttaggcaagcaggaaggagtggtacccagtggcttcccttcttcgctcccatagcttggcgggagggagtggcagccagtggcatcttctctcccattgttcagcaagcaagagggagggttacatcttttttactccagctgcctgcagctcggtgagctggagggagtggcacccagcagctttttcactcccatagtttggcgtatgggaaacaatgttacagcccttttactctcacctcctgcagctggtgagcaggggtgttagagctctttttgctcccacagttcagcaaattccgggttcttgtcccatgactaagaggaatgaagtcacggacaccggagagcgagtaaggcagaatagaattttattgagcaaaagaaaagctctcgacagtgagtgggcacctgaaaatgggtagccatctgtgaagctgagtccggggttttttatgcatttggaatgaggaagcgcaggctgtaggtaatcttagaaaaggcaacattcgattaaaaaatgataaaaaagcattattcagaaagaaccaattgaaaaagagtgggtaacaggaatagaagttctcactctagttcatggactctatctggaattggtagtttggttttcagacttcagaggatccttggcttgtaggtcaagtttcaccagggacccatccctgtctgcctagaaatctgtctcctgacacctccattcaagtgtcatacatcaaaaagctacatattatcaaaatgtgtttccccacagacagattcctttgcaaaactggatgggagtgaacatcatggctggccgtcttgtgctgtgtgacagaacattaacatgcccaaagccagaggtctagaagacagtgtccctgccacagagggagcctccaacgtctgaaagtccgacagcattgactttaactcattgctttataaaaactgtaaacaactaaacccatgaggcaagagccaaagtattacagctcagtcaggccacaccccctgcaaactgtttctggataaaacagtcataacattggcttgtgtgctgggatttcacagtttaaaatatgcatgattagtgcctatgattgatgtgttaactaatgaagcctataccagtttagcagataatgctggcaggacgtaaggtgtctcagacaatttcccatgtggtgttgcatcagtctaaatccctttgaggtcacaggcaggatattggtcgattttaatgttgacgattatccaaaagaatgaccacatcatgaacacattacataatgtggtgggggtttcagtcttcatatggacaaaagaattctaacatcctaatggatgtaccaaacttctggctgggatagatatgaaatttagagaagagatgagagctgccttgtcaacagattggctccacatgccacatgttggcataggtaagagatgacatatgaacaaaagcagttgtcgaatactgacacaagggagctttcctggactcagtgagcatgaaatagactagccttaagcagtggtcacaatgaaatcatggctaaagaatgtttccgtggggctgtctctgaaggcagtaccccagagctccttcttgctcagcacccaagacaagtggaccacagagaactgcagcagtccaaatggagccgagggcagatccattaacaaaggccccaactcacatggaatggaatgaatgcttcaagaaacaccaagcctgaagccgggcacgggggctcacgcctgtaatcccagcactttgggagaccgaggtgggcggatcacctgaggtctggagttcgataccagcctgaccaacatggagaaaccttgtctctactaaaaatacaaaattagccaggcgtggtggcgcatgcctgtaatcccagctactcaggaggctgaggcaggagaatcacttgaacctgggagccagaggttgcggtgagccgaaatcacaccactgcactccagcctgggcaacaagagcaaaactccgtctcaaaaaaaaagaaaagaaaagaaaagaaaagaaacaccaagcctgatgcaaggcttggaagagcagactgcctgcagctgttaaggctgtgtggaaaggcactgtggaaaatggaaatcaaggaaataaagcagagattcttcatggcttgtcagttattttactctaaaggatatttcaattgcaatgaaaggtttaaatagacaggtagctacagtacaatgtttgcttctcactctggtacacagcatggtggtagttgtctacctgtttttgttgttgttttctaattcctcaggatttaattaatgttttacattcagtattatttagacaagctcaaattataatcattatatttacctccctaaattttattactatttcagtggcctagggggagttgtttgcagatctaaccttcataatagtctattaaatggctgccaagtttcaccacctcgatctagtctgtgcgagtagtgaaataagtatgcatttatcagcctgtgcaggacaaatctaagagtctcctaataaatttaaaagagcattactaaattcctctttaaaaaatgtaatgtcccattattagccctctccaaattcccaatgtcattagaaacctcaaggtgtctacatgctgatagcatttttaggggagagggccttggattcaagataaagagtcctaacttctgcagatgggcattatttcacaatcaccctttttttcagttttcctatctgtagaatttccctccataaatatcacatgaagaccaaaagccataagtgaagatttataaaatatttttatcataagagtgatatgccacatagcatttgagggaaaaaaaaatgcactgaatgaccagacctacaggaagataatcctttatctctacagattatttctactttaggaaaagaaaagggaaatttatggcagataggagttgagagcagcagaagtgttaggaggaagaccagtagagcagaccagccatgactgggttggagtttttatagggaagagagcaaagagattttaagcgggtaagacacataggtagataaaaacaactttttaggaaggttaattctgtattacatgatcaagcttatgtcaatttccactttgcagtctcttcaggagatttcagcaggctttctttttaaattttctttttcaaaaaaaaaaaaaaaagtaaaatattccttatctgcaatgcgagctgagcagcacagtgctccttggtatttataactcatttcccttcctgagctagcatatacttttaagccaaaaaaagatatacccttttccaagaccttctctgtcttatgccaccaaggaattccacttcagtagttgcaaaatcaagggattttcttttcctttatggttttggagactccccaagagctaaagcagaaaaaaatcaacactagatggccctagaagatgtactcttcatggttttgtctcttgtctgactgcccggagaagagttccttaggcatttacaaacacagcaatgccaccttttagccccactctttagggattttacatgactaattttaattgcataaaaggaactcatctttatcttggtgtgtgcagtgcaaaacacttaatgtagggtctgactctattctacagtaagtgcagtaagtgttagctactattacctcatcagcagacctgcaacaagagagtcctttgttactacagaattctcctgccctaatactgccaaagtctgcagttctagctgcatatatgcagttcctggtgcattggcggatctcaataatatttggtttgtggatatacaagtgaacaaagggctttgggtttttgtttttgtttttgtttttagcagaaactaattcatctggctaaataacctaagaatatgtaggaaaaaaattacaaccagaataaattcttgtttgctctttataaatggatcattggcaacctttgaggtaagatttgatgcatctcttcagtagaaattcagcaagatcaacctcctcattatgtggagcagcacactgagtaataagaaatctggcatggctacagtatcttgcacataggccatgctcaataaacatttattgaatgactgtcttgttaccaagactttgtagcaataagctttaggggttttagcctgaccatctgcttggctgggatgagtcgtgatgatagttcacattgggtttgtgtttaccagttcctaaaattcaagtgtgttcagatgtagatcctctgttagaaaatatagcagtatctgaaaatgtcttgcttttcaaataaaaggtgcagaggtgtgagtgtttttgcactgttggtttcagatggaaccacaagcatttggcagcatattgaagaagctgtcacaatcgagcttttcctcttggggaacctcaaccaaagctcagcggtcatttcccatggaaaactatgtgcctttggccagttgtgctaagataacttattggcctctctgatgtcagctaatttctgtccatcagtcctcagtgcctgagtgactttcctccaattcatatgaaagtatgcagaaggaaagttttacagctttacaacacagagcaggccttgcctttttatcccttggctgtgagcaccagtccttagccacatacattctcttgtattctgctccctttcctgtcccacattcttcatagatttttccacgttttctggaaaaaaaaatcaagaaaagcaatttcctaagataaatgctcccacctgcccttgttcttccagaaacacggatgggctggttggttcgttggtatttcccggtttgcttcccttttccctaagtgcgtcactgactctttgctcccgggagagaatgagcatgtggaagccagaggaggcctgttcacgcccctctcccctcctagcacctcccggcctccttccttgtatgtgtttccctttaatctctcaatcttacatctttcatatttgcaagagtgtacagaactatttgaggagagagaactggagatctagaacttttttttaacagattttatttgtcatagttccttaataaagaggaatgagcatctcatagatgagtgcatatggatgagcatgatacagcccagagcccacctgagctcatgagaaaatccccccagtgaaaagcacgccggggtgagggtggagcggagcgtggaaagcaaaccaattggaaaggtgttccctgtattaccaagagcccaggagtcagtgtttagatgttcacttcttgcaccggctaacatgacatagctactttgtgtcctcaagcaagtctcttaactctcagaaccttagttttgtcatttgtaaagtttgggtagtaaaggctgctctcaccacctcacatagtagctgcaagagtcaagtgagtttttttttttcaagtgagatttttaaaaagctttgtcaattgttaggtgctttaaaaaagtcaacagagagtgttataactgaaagagatactttaaaattgctatagctacctgctattaactaaaggcattaagaaacttgaaaaccaacaccaagaaaaagagtataattaaattccccgacaaatagtaatttcatcttattcaaatagtcttcttctgaagtgatctcagaaaatatggagctatttacaggattaatatgtcctaacttcccttttatgaggtaaataaagggggaaaaagctaaggtcatagaaaatttgagggttattggttgccagaattggcaaaattaatttatatttctgctttgaaacctgtttagtttctgtagaaaggggaacttttcaaattaaaactgtagtctgggtcagaaagctatcaaatagccaaggtaaaatagggaggaatccaggattttcccaccattcactcgtgctgttgactcctgccttgtgggcctcatcttggtcaggagctgccactcaccttttctcacctgcagaggctccaccaacctaagtgggaagattggcttctgttaccaagaagcagagcataatgctaagggaaggatagaaaaccctttctgttgtgtttcttctatacttgctcatcatttgacattgtttttgcactcccttcattccttcaaatctcatagactttctggattctgagtctcagaccttgaactacaacgtatgcgtctgtctgtctcctgtggtatgtcattacttccagatgctagtatggaaagtggggaagaattaggcattggaattatgataagtctgagtccaagtctcgactcttccactctccttgcacaggcaaaggaaacattaggtattcaaaaatggccactattattatgtatgtcacttctaaacccacaactgatttatccattctctaaccctttacttttgctgtccttgcttgcttgcttcaaagccaccccttcttgatcctgcatctctgtctcaaccttttatctgatactcacacctgaatcccctgccccagctctgacaagatcatgaattagagtttcattgtagaaagatctatggtgaagagatgcaatgaagtatcaaggtaattcccttctaaatggaaaatgaccatcacaagtatttttatgtcccagtatttcattttagtgagatttttaaaaattccttcaggacatgtaagaggagaaaaaaaaagaaattcaaatagcaaactaagaatgtatggtgttcatttgtaataagcaggaaagttaaatatatttttaaggagataaaggagctaaatcataacatagctgccattcattgaatgcctactgtatgcaatacaatataccaggtgctttaaataagttattgagtttactcgttgcaaaaaccctatcagtaattagcactattattattctcttttataggtgaagaaatttgggcctagaaagattagtctagttacctaaagtcacgtgatctgtatgtggtagagccaagattcaaacttgattttacttttcacggcatagcgtgctcaatgtagaaccagcctgcaagagtttcctcaaaggctgtgtcacaccagggccacatataagctcctgggctattctatcataaatcagaagatacaggctaagttataagaataagttattattatagtaagagtgtatgctatgttaaacagaccattaaaatgataaaattaaataataatcactgacatttattgaacacttgccctacgccaggcagtactctaaatgctttgtaagtatcaatttagtttatccttacaacaatccagtgaagtacatattataattattgccattttacagatgaggaaattgagcacagagagttaagaaacatgcccaagtaagcggcagttaagaattaattctaggcaataatgtaccagagcccacatgtttaccctctatccaatacaaactgcctagttaatttaatcctgtgttctaattcttttgaattctaatataaagcacattatcttgtaaagctttagtttaaaggtctgccacataagcaacagggcctgctcttcaccatatgtgttcataatctggataattccctgatggggatcatttggagcaaacatttcttatggaatgattttctatgactgtgctatgctcaactgccggagcacttcactgctatacctcaatggaatgccagcgaccgactgtctttctatctacagttaatttggtggctaccgctatgctctcaggagccagttgtctatcatatccctgcataccccacacctttagtccactccaagaacttgctccccacagtaggcctgtgagtctgaggttatatactcttattctactggcatcccattagaaactactttctgcggctccaatattccttctttattttgtcacttgggatttcaatcagatattttaaagcttcctgtcctttgagccatattattttagattctctaatggtgggattatacctgtaattttttctgaactttttgaaacccacttccctaagtttagtatatatgtctgaatccataaggctcaacaactcttcttttctgacccaatcgcctacttctcccttgcctctcagactcttccaccttgtttgcaaagtttgtttgcctgtctctaggcaaacctctatattttattggaatgttccctttaccattttgctctggtaaggtaatatgatcagtttctacttgttttgaatagaatgagattgccaacagacaggcagctgttgtcggatttggaatctgtattagcaaagcatcttccttgtttgttctccaatgggatgtctacgtgtagaaccacagtgatgtcacctcacaccttcccctactaccttccaccatgtgttaatcttcaagataatgaattctcctctgctgtgtattttcttgccttagtgtgatagggaccaatatttatcttaaaaggattgatgtaaatcttccacccaaagggtttagtttgctttgttgcagtagtttttacaactaagatgacatattcatgttctggattcaaaaaccttttaatcttgctaatacttggaacatgtattagtacttagcagtgtccaccaactgctttttagttcaccttccacttctcaagggagtgctcagtaaatagtacatgctcaattaataatagttgacattattattattattagagaaaagacatataaagttgcagttttccaagagacaatatgacttagcaggcaaacagaggatattggcgtcttctctgccatcccttttgacaccttacagaaccttggtgagattaattaattactcatcttccactgtccctgaatgcaaaataagggtgaccttatttcagaggaaaggtgacctcttcctctgaaagcttcatgacttaacaaaaagtaagatacattgaatcatttgaatgccaactgtgaagaataaaatattgagtaatgcttactcagttctttaaactattgacctagccatggagttagcaccaagatcataatttctgcccttttttgaagataaaaatcaccatcagaattgccagccaaggtaggaaaattgaagaggaaggttacagtcctgaagagcaagcactcatatgggagaattgggaaaggcaataatatagcggcctcagaagcctggtgaggaacaaaagtataaatgcccaataaccttatctataccacaacatataaaattgggccttggcccagtcactcttagctaataaagaaatttatctttagaactgtgaatattatagtaggactgggatgtgctgcctgcattcccacttcgagactgagcctctcattttcacagctctgagcagagtccttctccagaaatcaccctctgctgagagaagctgcctctcacaatggccatgccccctcgctgaggacagcctccatccatggataggttcagagacttagcctcttgtctcaatgtgatacaactctaaagaaccacccactcaggcagaggctgccgcaccacaggtgaacttctccctctgccacattctgctctgtccccccacaccgatgttgttcctgtggctacttcccaatgaacctcctgcacacatgtctcagaatctcagaatctatttcctggggaatccaacgtataacgtatactacctttgcattctaaggagcaattacaactattttcaattttaagaacatcatcaatcatacaatgatcacagaattcccataactaagtgaatctccctcttgacctttgtgtgggctgcatttgccatgctatgtgatatgtagctagtttctcaagtgcaagtgacttgaatggcccccaaataggggaaatattctgaggtattgagactggccagttaccgtattatacttatgatcatttccaaaacaaaagaaaaagatggcaagtaatcaatactccttggccattctgttgaaggttggtttgtgactagggagactgtattagctcctgagggctaaattaccacaaacttggtggcttaaaaaaacagtctgggggctagaagtctggaatgaaggtgttggcagagttgattcctctgagaccctgagggagagtttttccgtgcacctcccctcgcttctggcgttgcctgcaaaccttggtgctccttggcttgtagatgcatcactgcagtctctgcctctgtcttcacatggtgaactcttcggtgactctcccgtgtggcatctccttgtatcaaaagtagggcaggcctaccctaatggagtatgacctctcacctaatcttaacaaattacattggcaaaggccctatttccaaaagaggtcacattctgaggttctggataaacatgaacttttagaagatgctattcaaccctctgcagagaacaactgaggaaacaaccaagatctgcttcccagttgatacctgtatttgtgctgtggatcttttaattaactgccttaaaagaaaacacagtgacccagatgtgtgcagtgggcgccacccaatgacagaaggctccttgaaggcttaatcaattagataattagtaggaccaacagggagttggtaaagcagcataagtaaaaccagggaaaggatcattacccagactctgaccattaatttttagtcatactgaaaaaaggagctttggggaaaagacagatttgaagagatattttattcactctcatatacttcattttctaaagcaacatgatgtggtagttgagttcacacagtaaaatattagataatttgaggaaaagacctaaaggaatgctacacaaatatatttagtttggccacataaggactccacgtatctcaggtcatgcacaggggtagcaagtcctgtcttgtgagttccataactttgattcctgcaggaagaccccagagacctgcaaaaagcatcctccgtctactaacatcctttctctcatttttccctcttacctgacttgattataaaattaggaaatttaaatttaggaaataatgaggagacagctagtaagcaaagaggcttcccaagccacacacacacacacacacacacacacacacacacacacacacacacacacacacacacaccagaacacccttaggaggcatttctaagcatatccatccataaaatatttttctgtttgctgtataagcagaaaggtttgcatagaatatgtcctttgtaatggcttttgcctctgagctttctaacactagcattgatcaattatcatcttctccacaatagactaatgtttgaacttggaactcagttctagaccagacactagaatactcgtgccatactttcggaccaagccagagagaatgacttcacccaggagagaaagataagaaaagatcttgatgtgtaagcctcctttatttacttgccatcaatcaccaaaacaaagtggaaggaagggaaagggaactattaacattgacccatataaaattgctgatattcaattggttttgacttttaaaaattgcatttgcaagtgattctacctaatataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagtagaaagtcatttattatgtggatctattaacatctgattcctcattaagcattaagaatattgccaaatctgcacttttattctttctgctgacagttagttttcacagtgcttcttgatttacttttatgattgaagtttcaggaataaatgttttaatttaatgttccctcagtataacagatttgactaatagtttaataaagggacaccgcaagtttctaatagagagaggtttgcttgtgttcacgagggatgatgcgcacatcttgatgaaggctgcccatgacccactgtgtgctgcacgtgtccgtttccatccgagcatctcagcacagcatttgaagcaggtagtgagaatcccagtcatggccaggaaggatgtgaagggctaacgggggacctggatattttggagggcctcagtcttcctctcttgcctcttctcatccctctttacagaatatttcctaggctgtatccccaatgaacttctatcgatttccaatacaacccatatgtctttgcacctctgtgtgcatgcccttacttctgccagaaatcctccttcatcattctcctggtgaactcctagtcatcttctgcaaggtaaagtccttctccagaacttcacataccctctcctgcctgcctccctccgttactacccccaggactctatgcataactcttccagtgcattcagctccaaattagtcagagttgcatttagcttaaaaggatgcttcaccagagtgggtactgtgcctatgtagcactctgccaccaataattagcacatttaccttttaaaaagaattgatctatcagctgtattcttatggtggccttctacattaatgaatgacataatgtgttttagaatggactagcctgggaagtaataccaagatcttgatttttctaactttcccaatggtttacatctatctattctagattgagattttgtttataactttgagatttaccttgtgcacaatttggaaaagggaaaacaaacatccatttattcataaaatatttcttaaatgcctcagtcttaggtgccagggaaagtctgttctcggcagcatataatgcttacagtcaggtcagattccttgataacagcagggaacaaaaatgggaagaacaggcaggctttccggggcagtgttgatgtggtaagtatgggaagtttggcattgggattagatttttcctaccctgaaaaccatcaataaaaatctctcctcaaggctgaatttcttaattaattcatttcaagccattaacagagattttaaaaatatggtctatgtcctcagatatctttcttttgagttgagcatattcttcatacggaacaaagagcaattccaaagcaaagtgaaaactggacagaatggtgtaataacaatcactgacttactgagtacttactgtgtgctatacttcatgtatatatattactcctttaatcattataataacactgtgagtaaggtatttttagctctactttacagatgaagaacttgaggcacagggaggttaagtgctttaaccaaactcatgcttggatgagagcatggccttgaacccaggcagttgggtgctaaaggttgttctcataaccaccacgttacacttcctctcaatgcttaaaaaggaaaaattatttactcagaagtattgaaagagagtagagcaaagaggtcctggagtggcctagcatgacctggcatggcttcttgcaggtagagagatttaagccaatatagcaggaatggtagatgttggcaagaagtctacgtgaatggaggggcctgaaaaaaaaagcctaagtctgggcatgagcaagatgggaagtgactgatttggcaggcacagttgtctctcacacttaacagtacctttcaaggccagaaaggatgttcttaattttgaaactcatacatcaagtatagtggttaggttgctttttgcactgagctgtggagaaaagtacaggttgttacaaacctaattaagataattatttaatagaaatctattttaaagttttgaaaaatgctaacaggaatcaacttttaaggataatctattcagagtcacctcctattaacagtcatgttattaaccaactcagggcaaagcatgattatataatagctcaagaagaggtagtgttgtctcattttactttctgggacctaaacacctagggaaaaataggtgataaaactgaagctgtcacaatccagcctctttactcccaaagtcagtgccacacaattaaaataactacaaaactcagttaatctagatagtatactataaagataatccttaaatatgggtacatatgagtgtgtgtgtttgtgtacatgtgtgtgtttagttagaaactttgaacacagattgaacttgaaggcatttcagcaaggagagatatttggtaggatatgaaaatgaagtttacggttggaataccttcagaacctcaagtgcagcatcctgattctgtgaagattatgttttattcctttacctattcccacgtgtaatactttattctctttgaattggcttctaatgcaatttaaccctgtttttgagtgtccactagcttaatttcttttattaatatgaattcttctccttcctactgaataaacccagctaatgtgtttttttctcctttatcatttcatgcaaagcaaaaagtaaataaggaaagaatatgattttcgcttccatttttttccccaagcctaaacaatggaatcggagaatctgtttttgaaatctggaatcttagtatttgctgatcctatggaatcaggacacttgattagctgcgagccaagtcatcaggcccacttaatacaatactcagtaaattaattcaattttactgatgtgactaaaaactaaatttcatatcaatataaacacttattaagctgcaaataccacatcatgcaagctgttgaaaaagactcatttttatttatagatgaattctgataagaatagcattagaagtattttagtagggaaatgttagagtgattaatgtgtagttgtttgcatttttaatatttcactcatatatcagattaggatttgtgcatactgtcagaatttattctgttcttgtcaaaatacttattactgctgacaggtataacatatccacattaatccttaattccttgattcaattttctaattgcttttttggcatgcgatggtggccatttagtcttatgtgatgtattcatcatatggtataaaaatgttctttaaaaattagatgtgccatttaaagtaactgagcaggaagaaaaaaatactaaggattggaaattttaaatttcaccatacttagacaaactattagatactggtatgtcacagattctggaggttgtccataaatcatagtcacagaatgttaaagaggaaagggaccttaaaaatcatccaacctacctgttcattttccagttggggaaactgacttagtaacaagcccaggatcacacagctagctagtgggagagctggtctgagtacttatatgttctgatcactagtcagaaatggggtaggtatttgcatataattgttataactggtattctaaattgatttttactattaataggctgacagaatgagagactccttagcttcttaagctgtatgttttagtaatattgtatagtggctgaaaacctagattctagaatcagagttccagtcctggatctgcccctcactagctgtcttaccctgagaatacagtctgaccgctctgaatttcaattacttcatctgtaggaaatggaaaataacagtatcctgctaataggactgctgtttaggttacatacaataatgcatgtaaaaagcttagcatagcacttggcatctagtaagtactcagtaaatgttacatattattattattagtgttttactatccctttaatatccacaatttggagagaaacttggtcatgccttgtcgcttatttcaccatgtgacctctgtgacaacttcatttattcattcattaactctttcacttaccatgtgcaatgcactctagtagttgctataggtaagacaagaatctaacatgatatctgccttgcagaagcagggctatacaacatgtacatcaataagtataataaaacattgggagacataggtcccaaaaaggtggcacaagcaccgtgcttggacatttcaaagagaggaagtgagcataggggatatagggatgaataagaaaccggacctgttctcaaggagcttgatccagtgggaaatagacatttacccagctgttattcaaagtagaaaataaagagggtcacaaaagttaaagttaaagaactaaagagggagaaactaaatatctcagatcagagaaggctttatagatgaagtgacatttgagttggctttgagggacgcataagatcaggaacgttggagacctgtgggaaggatgccttagacagtaggaagattaagagtgaagaaggcacagatgattctgaaaaccctgggaacagttgttgaacagttattaatagcacttaatttgactaaaaaatagagcttgtgcagaataaaggatgtgattagatgagtatgtagggaatgtcattttggactcaagcctcttttgacccaagacatggtcagcacacgttttaagagttaatgtctttaaagaactttctagttagtacccactactttttattgtcttactctagaggataagtcagtcttcctacctattacaggcaatatagcataaagttaagcatacaagctcagaaaatggactgcattggtccaaattcctggttatgccacctattaggtctacaactttatttatgtcacttgaactcttagaccttcagtttcatcatctgtaaaatggaaacagtcagtgtctcatcgggtaggtattgacatcaggcatatagtaagtgcttaataaatgttagctattattactgtgttacccacctgtgccttgaagcgacttagtttacaagttctgctttggaactactgaaaaggtttttgagaaaggatgtaacatctttttaatcttgagtccttgaatgttctactaaaccccacttaaattgtagtgactcgtccaaggacatcagataattctgttaagccctcacctgctggaatatggtttctagtgatgggtctcagtgtgatttacagaagtgaatccctcactcgccattggagagggccagtggaagaacaagtagccagctttacccattgatgttttccaaacgtgcagtgattcatgtagcaggagtttcccaggattgatcctgagctcaaatgaacacctcattttcagaacaaattattaggagttttaagaactataccttgaaaatcttcatgattctagaagcttctctggtaacatttttttctgtttgtaatagctgaaaaatagaaagcatttaatatagaatttttgcccctaaaacagcaacttgaaaataagagtacaacagttttaaaaacactagactgaacaaaagcagtctttttaaaagtgctgtgggcctaatacacagggactgctaattacgtaactgtcagtgatgttttctggcagagcctaacaccagcttcttgcagtacaacgaatatgaaaatgcctagaagtaaatcacagttgctgagtgctgtgggcaaacaaacccaggccttatctctttgaaaggcagcaatggaaaatacatgataaattgcacagctcagtgaacatgttatgtcattgtgaaatgattttgattcatggttatgtagttatcacgaaacaactgccaaaccccagggtatcagaaacattatcatttgtggggttttgctattttctgttgtaaaattcaagtgctataaagagatgtttgggtttttttgtatataaaattctgtattgaaagtgatatttgccacatactctttggaaataatattttaaattatgtgaatttcttccagaagtatcaaagagctgtgctagtaactaatattttaaacagaatgaataattcatatttttgctaatatccttttatgaaaattattttacctaaaatagactaagttgtaagtcaatttgattttttaaaatagaagtataatctccttttatatagcttatcaatatacagaaatttctgaatgttttctatacaatagcagtagaactaagaatgaaagagtaattttttaaaggaagattttatagaagtagcttttatgcaggcataatttcctttccacgtttgagatattctactccactgtccttatttgttgctaagtctctgaagtttaaagtgttaattagaccatattccacctgaagtttagttattttttgttaatttttttctccgttgatgctgttgatgatttgatgttttgaaatattttctgcttgtgttaaaagtggcagaaagatagcctggcaaaaagatcaaattgatgtactactgaatcatttgtcgtttttctcaatctcctaaaccaagacccactgtttctcaacttttttgtataaacatacaattctactgttctaatttttgcagtcgagttttttttttaacatgcctttggatatgctgaatagtatcagttaatacactgagagtttaaaaagaaaaaacaaagaaaagcttgcccgttggtagaaatgattgattgtttcttaggtatggtttttccaatatatcactatcgtttaaaccttgagtttattttatgttctgttagtatattttaatcaattgacctttacatattgtttgcatttattaaattaaaataacttttagtagcctgtaaatatgatttgaaacatttcatagtatttttcttttagctttggaataagacaaacctattctctaaatatttacatcactggagaatatctatgtacttatgctgatttttacttaacattttcaaaaataagtctgttaaattaaatgtaagctttaaagtgtaaaaccatagatcatgtaacttgatacaagtattgcaacatggcttacagcattttcttggaacatttttatgccctttgcttccaccaccatcgccactttcacctttatattgaatgctcccaaaatgtatctatatgaggataattttaaaacatgagatttatgttgctataaaggagaaatcctttataaccacataaaaccattgtcaccagaaatttcagtccaagttttacaagaaagcaggcatattttatctttaatgcctcattaaactttctagaaacgacagtattctagaatattctaggtgaatgactgcatatgtctgtatttcttcttaaaagtttaaatatcatcagtgaaaaaaacctgaacaaatcatttgttctaataattaaagccgtggtacttattcttctatttaattttgcctttcctcagaaatgttgctttgatatatcaaccatgtctcttctatagctctttaaatgatggccaaaactaacattcctaggctaaactgatagcctcactattccaaagatcacattgtgtttaattccaaatttcatatgtggatttgtgtacacgtgtgtacttgtgcatatgtttatgtgtacatgtgtggaggtgcatgtttgcatatgcacacatgtcataagcctgcattgtgtgattaagaatgtgaactcaggaggcagcctgcctgagcttaaatgctagcccaactactgctaactagctatatgaatctgagcaagctttgttaacctcttgcttcagtgttctcatgttacagagttgttgtgggtttaaataagtcaatatatgtcatgcactttgaacacctaacccatagtaacaacttaataaaatactagctattactattattattattatatatttatttactctatgttatttctaaagttatctatacaagtgcattgatgggtgattagtaagtaggtatttcactaaaacaatattaaagatatgccaacctgatctcacatttacatgtggattcttaaaaaaagtcaaagacatagaaacagagaatagaacaatattcaccagggacagggagggggaggatatgaggagatgtaggtcaaagggtacaaacttgcacttatgtaggatgaataagtctatagatctaatgtaagcaggaggactgtagttaatactgttgtattgtatactgaaaatgtgctaagagagtgtattttaggtgctctttccacgaaaaaataggtagctgtatcaggtgatgaatatgttacttcgattgactgtagtaattatttcactatgtatatgtatatgtatctgtgtatgtatatgtatatgtatatcaaaacatcatgttgtacaccctatagacagtaaaaataagaaaattaagatatgccaacagaatattttgaattgtgatcacttaattagataaactatgctatgttatacatcattggtgagaggaaacaattgggaaaaaggaacaaaagttgcataactttgtggctcacaagctgctcgtcaaatatagtgaaatttgttgatttattcaagtgtaggccaagtgcacatccatagtgtgcaaggagctagtgttaaaataacacatggtgtgtcctgaacaactaggaatgtacagcacagctacctaaaggatagataaggtgaaaattaaaatagcaatgctatgtcaattttgcaaacttaaagtgggttttctttttcagggggcacccaagccaattgccattgaaccatgtgctgggaacagagctgctgttctgactgtgtttctttgtctaccacgaggatcatcaggtgcccctccccctgggcagtcaggtatgataaatgaggagccttcagcagttaagcaaaacttgtagactgaacagaagaaataaacaataccactaaatagcgcagtaaggacctttgcaaggttctaatttagagcatggtaaaattttatgagaatacaaacttttacccaactatctagatacctgcattgttataaaggtagatttcccagtgtttctccgaaaaacacatgttgaatatgtgtttatttgtgtattatacacacatgtatgtatgttcccattaattgctggaattacaatgagaaatctcattagaagggccaccatgttctagacccttccagccagcttcctttcttccagtatgtgtggcatgttggaaaccaaattataaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgccaattctctgtccctttaacctttgaagtcctttttgactgatatgaaagagacaagtagcagtgtgaaccattacctcagctgtgttttctaacaactgcattatgattactaatgttaatgttatcttagatatgcatagtactttactctttctaaaatgttttttctgtttttcacatgtgatcctcatgacagggttgtgagataggtattataaaactaacatcataaatgaggggagtgagacgtagaaagcactgtatatctacactcaaggaataattggggagaggggatactagagtatagagcaaaagaataaaaaatacttactgctagcattccaggtaattgttcctgatgatttgtagcagaaagcctctctaaaatcaacagcccatgtctttacaaaagcaagcatttggatgaatactgaaaatgtctacagggttgatagagctagacaaaagattgaaatagcttaccatactttttacagagcctgaggatgaaactatgatgagtatctgcgtacataattcagaatgagcttgttctttgttttctaaaaacaatctagtagatttttcaagctcttagaggagtaagacagtggttctactctttaaattgcagcattatctgttatctgcatcaatttggaagatgggtaagaggggtagatggactgatatgtcataaagcaagtaaagtaaaatgttaatggtaggatctaggtgctaggaatactgatattcattataaaattcttttaactttgatatatgtttaaatatttaataatgaaatgttgggaaacaataaaacaaaatgtcttgatttcactgcaagaaaaaaggcagtatctgtagagaaaaatttttccaatatcatcatctaggttttcccagaacaaggcaaatactgacaccaatatatgaactaagtgactatttttttcagtgctcgtccaaatatttagtgtatgcacagccaattaaaacttcacatatttgagaggaaatatatcccagtgattatttgggaaccatattggctcttgggaaccaaatgctgacactggttatctcattgctgaagtttggtttattctgtgtcttcacagaaagtccttatatatgcctgtgcttatcccagtgccctacacatagaaatcagttaataaattattttgataatgatgatgacaatgataggagacttgggaaatgtgacctttagcaaccacttgaatctgttagcttcagctaatttcagtaaaatgagcaacagagttcaaattcatttaccctttcccagattcctctcctagaagccctctatgttctcttgagcctcctccactatttgtgcagggtgacaggttgggggagttgaggaggaggtagaggtggagctttgttggcagactcctgaccccaaccccactgtgtgaaggacagggtgccaggggtcttctcttggctattgggctatttatttctccaaatgttagtgtatctgttcagttattaaattagcgttcattattaagagtcttcttatagattaaaagtcttatagtactttgcataatctcaaatttttttgtcaggctccttgtttgaaatgtagcttactaaaattttttttttatcaggctccttgtttgaaatgtaacttactaaatgtcagtgtcatgtgtactctccgttggcatgaataagagcatttaagaaggatgagcttgaggatctgcaaaggcagaagcatcctatgagcatggtggatttctctcacacagtgaatttcaaccctgaaaatgagtgacagaaatgcacaggagctagtttggccatctcttttcaggagcagctagtgattttttttttttaatttaaaaaatagcattatctttggacttgattttctttccaccagcaactgcttcagcaatatgtggcaagtaatgcttagacatggccattttagtttctttctgaaatgtgtgaactcccttccttatggatcttgtcttaaccagaggtcaaaagaaaaactgtgccaactcatcccttagattacccatgcactaatctctttttaatataataaatttaggtgcttgggagaaattctccctttagggggcttagaatagtaaggcaaaagatattaagtaggctttttggcattcctagagctgggctaattaggtttcctgcttccccgcccagtaaacctgctgcttcatttctgtattttctgtgagcagccactgcaatccgtgccagactcttcggttaaggtgggatttatgctgttgtttatgcatatgttcactgtgcagccactttgtcttctgacctcaaagtggttgaaagattgacatctccatgaaaacaggacacattaagtaactctcctacatgacacttaacaaccaagcatgtctccagtcaccccggacagcatggtccccaagcgttttagaggcacattaagatgaaatgtggacaaagtaaatagagctcttcagatgcataaattgaaaatgataatgattgctgtcactttgtgatggaagattatggatttcataatttgtggattcttcctaatgagaagcagattaacttttctcactgaatcaaaaatcccaatggcccaaatatccactgctgaaaagaagctatgtgctacaactggaagtagaattttgccatgatcctgcctcatatatgattgactataccattaccaaaagaatactgccagaaagtctaaggttttgaaattctgaagttttctacgttagccttagaagtttgggcagaatgattagattattttgaataatctagaaatattacataatgtttaaaatgatagtttactcatggtgtcatggatgtctttcttgtttataatgataacaataagataactttggtttaatttaatgaaaagaggaaagggaaagaggaccaggcattatattaagcgctttatgtattcattggtgtgaccctcttaatgattctgtggagatgattatcccacttttactatttagaaaaccaaaactctagagagattaaatgactttcccagggtaaatgcagctagtgagtgagtgagccagaattcaaacccagggccactggctcctcagccagtgtgactctccctcatcactgtgtccctgtggataaagatactggggcatagcccttattcctaaaaaagctttaaatccagagtcaaggaggaaggacctagagggtctctgctgagcagtgggcttattgtagtaaggacaattttatctttgccggtgacttcagaaatttggtaaaatgcaaatctgtgcatgccgtggcgcatctgctcatgaaactatgactcggtgtatgtaataggaagaagcccgtgaactcataggaaaagaaattaaacttgtatgtctgagctctggacttggaatcacaagccctaagatctagacctagctctgccactgactagcaatgtgaccatgggcaagtctttcagtctctgggtcttctattttcccatgtgaaaaatgatggggtcgggttagattcctaggatgcgtttcactctaaccccactgcacagtttaatactacaaattatgctaagtcatgacagtttggggtggggagagcaaataacttgcttctgagtggtaccttgatttatcttttcagttgctcagagccattgggaaacttaattttcatatgtattattagtgactaaaaataattagcattgctccttacatttaaaaaaatcttaaaactgtgttaatgaaatcttcctagcatgtttgaaagatgtagatggtttatagtgcccctattttagaattgagtaaaaggaatctaatactaccagtgagaggtacatttcccataatctcagagatggattggaaatggactccgggtctgctggctcacagtgtagtactttctcctctgaacacagttttttaaagcaaatttccagtttctagcagcctctgaaatttctattccttcacactttgtttttcttttataattctgccaccatatcttcacacttgtagaaacacatctgttgatataatcttagcactttctttgttagaggtggctagaataagaaatagaactactgaattatatcaaaacttcattataaaaatctggcatgttagttaccctttaacctcaaatacaaatattgtttataggcagcgtatgtgtcttcacaaagaagaaagaaaaagtggcattcatggtaaaataaactagaaaattaggcagagagcccaggaaacaacagagataagaacaaatatctgagattcttgttaataaatatgactccgtgtcaaaaaatatctgatattaaaagactttaaaatcaacagaagaaactattttaccttgtatccaaaatacagttattgtgaatccccacttgctacccttactcattcaagaaacgtgtaaaagtgtctattatatgacagcactggatatactatagtgaaccaaacagtgttcctgccctcatagaggttacagcctatgcagagataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactcacttagggaaaacttctctgcagctaactgccgatcctgtgggtcttcagccaacacctctcacctgctgagcagcagcatctcaacctggatttcctcccgttcagatgtaaagtgagccgtccttccccctttcctctgtcacttcccaccattccccagaccagctcttctctcctgacttgtctgtttttgtaaagtctgtttcagaatggctcaagtttgaaaccttcaaattagcctgtcttctctctctttgtgcccttttacatctcagtaatcgtgaagttctatagattttatccctggagcggacagagaagacatcttattttttccattcttattccctccatgctttgttctgggagtggttgcttctcacctgggttgctcccaaaggaaggcacagctctaatcatatcgcttcctcatacctttgcagacttttcattgcctgttgaaataggtccagacgtttactctggaatgaaaggtcctctctgacttctcctcaacttctcttccaggtttagcaccctcagagtcctaagcctacctgcacagcaccactggctacatgggggtccttggacaattattttaaactctcagacctttagtttcttcatgtataacattagaaaaatgactagataaaatatctttgtgattgctgctaggcctatcattccatacatatttttcttatgattctctgagtgtaggtgtggtctgtcatactgctgtttcttgtacccgaaatcccctgtgttaggctgcttattttcaaagcctggttcaaatgctatttcgtcttccttgagaccttttcagtcccttccatacaaatgtgacctcactgtcttgaaatcccacaccttctaacatatatccatgccttctaacatatatcagagttgctatgttcttttcttttttccccagtagtaagctctctgaaggcagtggcaatatcttatttcatctttgaatccctagctgctaacaagtttctggtacttaatagttgcttgataaatatttaattgatgaataaaattatctttaaattttggagactcttcaccaaaaaagatgtgcaaaagatgtatactccacaaatgtatactttacgatgtaaagtttcacttcaagcccataacctcgatagactggattttgtgtttttataattcatgtaggatggatcaagctacatatctcagggaccgaaatcaagcccaaaactgtactttcaatggattacatctatgaaaactaacttgtttagctttaagtttcaatgaacatgagaatattagtgaaagatgacacaaaacaataaagcaatttatatttccaatgtagcatgtctgaaacctatcatagagatcttctgttttcatgatttgaacactgatttattccttggatagtaatttttttaactattttatttaagtttgaaagagcccaactcaattctaccctttatgaccagaaaaataaattactttgaatcttatggaaatgtccacatattagttatactcaggacagataacctcacaaaagataactggcaaataaaaagcatcaattgttggtgtagtcattaaaacatactgtttggaagaccaggcacggtagctcatgcctgtaatcccagcactttgggaggccgaggcaggtggatcacctgaggtcagaattcaggactagcctggccaacatagtgaaatcccgtctctactaaaaatacaaaaattagccaggcgtggtggcagatgcccgtaatcccagctactggggaggctgaggcaggagaaacgcttgaacccagcaggcagaggttgcagtaaaccgagatcgtgccattgcactccagcctgggcaacaagagcgaagctccatctcaaaaaaaaaaaaaaaaaaaaaagccatacatactgttcgttgtgaatctattctttgcaccatgctgtcctttgagttactgtaaccctatagggcagcagtccccaaccttttggcaccagggacgggtttcgtggaagacaattttccacagacctgggggtcagtggcaggggtgatggttttgggattaaactgttgcactacaggtcatcaggcattagttacattctcacaaagagtttgcagcctagatccctcacatgcgcagttcacaatagggttcgtgctcctttgagaatctaatgcctccgctgatccgacaggaggcggagctcaggctgtgatgttcactcacacccacccattgcacaacttctgctgtgagtgctgtgaggcccggttctcaataggctacaggctggtacatgtatgcagcctggggttgggagcccttgctgtgaggtatatgcagttgacccttgaacaacatgggtttgaactgtgtgggctcatttatatgcagattttcttctgtctctgccaccctgagacaccaagaccagcctctccttttccttctcctcctccttctctgcttactcaaaaatgaagacaattaggataaaaatctttataatgatctatttccacttaatgaatagtaaatatattttctcttctttatgattttcttaataacattttcctttttctagcttactttattgtaataatacaatatataacatatacaacatacaaaatacgtgttaatcaactgtttagattattggcaaggcttctgataaaaaataggctattagtagttaagttctggaggagtgaaaagttatacagggactttaaactgcacagggggttggcactccaacccccattttattcaaaggtcaactgtgttatcacttttcttttatatatgagaaaaatgaaccatggatattaagtaacttgcctacagtcacatagtaaataattatggagtcagaatttaaaaccagaaaacttttacatcaaaatgctctttataaatgtttttgttttgttttgttttttcatttcttagctatgagtaaagaccattagctgtttgtgttttgaggacagcacaagctttttcttttactgaccagtgtcactgtaaaatgacatggtgatggtccttccatttcagacttttaaatatatctttccgtcacttttgtgagaaattgattaatatgtaaaggaaacaaaagaaaataaggatgagaagcttaaagaatagtgaaaatggctaattaaacatgctgcagaaaagagtcaactttaaaagttaattcaaatactttaaagactgaccaattagaaacaaactcacatgacaaatcaggattcatggaaatgaaaaatgagaccactagcactgaaacgtgaccaacacatttttcttttcttttttcttctttcccacctgccacctctttctggtatttctggaattcactgttaataattactgtgctcaaagagaaaaacaggaaaaaattaaaactcaacaagacaacttacaaaaccaaagaggaaaatcaaaatgtgttgcaatacccaagctgcctttgaagcaacaaaacaacaaagcaagaatgttgtgggtgtgaatacaatgttatgggtcaactattgtgaaagacagtatggtaattcctcaaagatttagaactggaaataccatttaacccagcaatcccattgctgagtgtttacgcaaaggaatataaataattctattataaagatacatgcacgcatatgttcattgcagcactgttcacaatagcaaagacaaagaccaaaatgcccatcaatgatagcctggataaagaaaatgtggtggtatatatacaccatggagtactatacagccataaaaaggaatgagatcatgtcctttgcagggacatggatgaagctgaaagccattatcctgagcaaactaacacaggaagagaaagccaaatactgcatgttcttatttctaactgggagctgaacaatgagaacacatggaaatagtgaggggaacaacatacactggagcctgtcgggggagagaggggttgtggagagagcattaggaaaaatagctaatgcatgctgggcttaaaacctaggtgatgggttgataggttcagcaaaccaccatggcacacgtttacctatgtaacaaacctgcacatctgcacatggacctcggaacttaaaataaaataaatgttaagggtaagtttgtgaggtcctccatttttttttatgatagctgacaccatggtttatataaaactgccaattggtaaaaaaaattacttttaattggttatgaattaaatagtcctactttacataggtttgggagaatttaacagaagtttgctgccttcattacctcgggctgctataataaaatattagagtctcggtgacttaaacaacaaacatttgtttctcacagttctggaggctgggaagtccaagatcaagatgcctggacaatttggtgtctggtaagggcccttttcctggtttgcagatgatcacctatagctgtatcctcacatggcagagaaaaagagctctgatttcttcttataagggcactaatctcatcctgaagctccactctcttgcccttatctaaacctaattagtcctccccaaaaaccccccacctccaaataccattatattagggattagtgcttcaatgtatgaatttggtagaaggtggggcacaaacattcaggccatagcaggcttcttctgtagttaaaaagaatggaagggttctgagtctcagaatgactagaaccaaggtgtctggatctctcaagcagggagcgagagatccagagaccttggttgtagtccctgctcatattacccctccctcatatttattgtaacatgttgcaaaacctaaccagaaaaagaaaataatataattcacctcttaccagcaggcagtactgcacaattctgccacacagagcccagaaaaggcaggcagaagggaactccctagatccagaaaggaaaattaagtgacttgagaaaatatgtaaaggctaagactgggtaagtggccctgcaaattccttctagtcacagaaacatttttctgggggtcacctcatagggccagtggtccgtcagcaaatccagaagtatgttcaagttttgatcaaaactccatgttatactgatagctggtttaatctcgggtcctcccacagactgtttaatggtgccatagtatctaccaaaggcatttttgagtatggatgtccccttactcttaatggaagtcctggtggaggagcaagtgccagcagtaaaaatgtaattctataaaaggtaaatgttgattacaattatattaactccttaagaccacagtgatctttctctaagagcttgtagggaaaaagttaatggccctctgaaaagagagtaattcatttccttttatccactttataatttgcaaatttgcaaatgagcatagcccatgcaagttgagcaggcttctctcactgatgggtagcatatccaaagctttcatgcaggtaaaagcactggaaaaaatatgagagagttcatcttcttccttaggagctgggactgaaactggtccacaggacttcagggaggtggtttgaggaatcctacatggtccctgggatcatcatttagaagctttgagggaataaagattcttgttctctgaacctgctgtctgatataatttgaattgaaccttgaagcccctaaaaatctggatgcagtgaccatacattcagttccatttattcaacaagccaggcaaggatcatcaaatcaataacatgactgtgccatctgccttccctttgctcaccatcacaatgaaaaatgactccttaagtgttctgcaaggcaattaactctgaaggcagagctgtaatggagagaggctgagttacatttgtattcagaactttactggtaaaatggaaaggaagctgttgtccatattaatagatacataaaatagatacataaaaaaaaatgtataaatgggataatttggtattactctatttatgcataatattatacaactgcagaaacacagagctaggaagggcactgaaatgacatatggctcctccaactgcatgcagccacagctggtgaccctgtccagaatcatcttggacagacagactgtttctaaagacattcccaaaagtcatgctgataacttccgggactaattcattctgttatttaacagtcttcactgcaatttgattccattttcttttgttctctttcttcttgttctcatctctctagaaatagagaacagctaattatgctccctataataatccatcatgtggtagaaggcagttttgaaatcaccacccagccttcagttcaggttcaatacagcactcccagtccttccatctgggcctttgaagagcctggctcctagcctgagtcatctggtgactctcagaatgctcttcaaccttcccaaatattattgattcaagagacatgaaatacaaagggactctgtatttctgtttgttctggtaccctctgcaggtaccattgcctctgcctagattgtcctacccatcagcccctctccgatatacacacctccccttttgcaccaagagaatttcgaattcaaaggtcacctctttcatgaaactagtccccatgtttacccatcctcagtcctctgctttgctttttcatttactattataaaatttttcttacgctgtctccgtcccacccaggcgagctaagggcagggatgtttcccttattatttctgtaggggctaaattgtgcctacaacatagtaaaagacaatttgcttaattatttcccccacttttcttacctgtgcatgttggtgctaatgtcccagagtccaactcttaagctagctgtaaattcacactttctactgccctttgtcatgtaccttgctataaattaattatagatgcttctcaggttttaaaaatgataaaccaccctaatctctggcctgaaatttggcttatgaaaactttattgaggttaaatcagttccttactactaactaggcctgttgtctcagccccatccttgtgacctatttgtctcaagtcttagtagtcatttcgcaatacatgattttttctatgtttaacaaatttgtttcggtcttttgttatttttttccagatataaaaatatcactttgatactctggtcattcataagatcattgtttgatcatttttaacaccattctttttccttttctcaaaaatgaggccaggagcagtagctcacacctgtaatctcagtgctttgagaggccaaggtatgaggatcgcttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacaccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtgtcacaagaaaaaaaaaaaaaaagaagtgggagagaagagagcagtggtttcttatagtagaattctaattaatggatgtagaaataagggaaatagaaaaatcaccattagacaaataccacagtagtaattgttaaaggtaagaaccattgatgaaatctaaagttaataggacaaaacacattgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattgagggacagtttacaaaacaaaaccaccaaaactcttcaaaagtgccaaggtcataaaagacaaagaaagactgaggaaataatacattggagtctaataacatatacacgcaataaaatcctgcattaaatcctggaccaaaaataatatataactgagaaaactggtaaaattcaaatagggtttgttgattactcaataatagtatattaatgttgattttccagtgttaatcattgtactctggttatgtaaaatgttttcatttggggaagctgaatgaagagcaaatgagatctctgtactcatttgcagtgttcctgcatgtctaaatttatctcaaagtaaaaagctaatagaagtattttgtcaggactcttttataagttggtcatattccaaagttcaatctatagtttacaggctctattttgtcatagaaatcatatttatttcattatatggttcctgggccagcctcaaaagcttacttaacctacaatttttatatatgtatgtgtatctctatttattaagtagtctcactgtattcttgaacataacatagtatagccatgttcccattatagaaaaatacccctatcttacaggtaaagaaatgaggttacagaaaggtttctttacttgccccacattttttattttaagattttagagcaagcaagttgcagacctgattttagagccaggtctgtgtgacgccgtatgctgagtttccctgctgaggtatctgaggctttgtctgctaggccactcactcacacattagctgctgaaaaggggcaaatcttatggacacttctgtgctgtcctctggaatctttcccttgattctttttcttttcctggattgttgaacaaaatgttcatgtttattttgttcatgagaattgccttgtttttagaaatagtgacttttaaatagtttgtggattttttttctctaattctgcctatcattttaaaaccatgttttatagataaatcaaaaagtgtagaactcctaatgcagcatttggagcaaagttaataaaattttaaaacaagaggatatatatttactaaattacactgtgcttataatgtgctgccatatttttgttaaaattttttaatgctttagataattaagcatctcaagactataatattaggctaagaagctctttcccattaaaatattcataaattatgttgacacgaacatggtgttctgaacaattataaggagtggggctcctaatgcaaatgtcattcctattatgactttttctgaacttagaaaatacattcaagtagtctatggaactgtccaaaagatacacagaaaccaaaaccaaaacaaacaaaaaccaccatttatcaggtacttactgtgattcagtcactatcataaaagtattttcttatgttttctcatttaatcttgcagtaactctgtaaggtagatactactgtgtctatttgacaaattagcaaaatcaaagttcaaaaacctaccagtagttagagagttcataattgacaggaccaagatatgaacctagtttttgtgtctactctacagtttatgcctttaatccttgtacagtactctagtgtttcctgacaggaaagcattaaatacagcatagaaaactaagaaggaaaaatggcaccaacatgaaatatgttaagcttatatttaatctgctgttttatgggagttttttttaaaggagcgagaagaaaagctacaagggattttaaagagtaattcaaagatcaaacatgatttttatcttttgtcccagagcacttcagattcaaacccaaggcttcaccgctgctgatgcacatccgcctctgagtctcgtaattggtaaatttacatcatgtgtgtcaccagcagcttaagaagggaacagatgtcagttttaggaaatcctgtgaatttcaggcttgctcagactaattggtccaattgataaaatgctaatgagaaagtaaattcaaacctttaccataataagtctgaattctgaccagtaaagatgaatgtaactgcctttctgaaattcctatttttcacagagtaaaaaacatatttttttctttaaaaaaataaagccatatttgtcctttaagaaagtgttaatgttgagctggtaatgtaagaattacctagaaattttaattgaaaatattaactgttttatacaattaaattcattttttggatttctttttttagagcaatagaattccatgctgtcacttgttagatttaatgtcatcttgataacacatctaggaataccaagcaactaactgcttaagcattaacgttttttccatgtcatataataagaggaagtttccatttacttataccatctttaatagaaaagaatggtacaagtcaaggtcaaagtctccttactggaagcagcagcctggcaggctgcttaggggtcctcatatgctttttcctctcactgaagtagtcctctttcctctcttccaagttcagtgtcattagcataacaggatcagacaactagagttcatcttgttcagccctctgtcttgtgccgcttccatcttatattttttaacatagccacagattgggaacacacagtttctcacagtaataattccacatcttatttccttttagtgtttggaatgtggccaccctgtgaatttttttttttttttttaattttttgagacaaagtctcactctgtcgcccaggctggagtgcagtggcacgatcttggctcactgcaacctccacctcccggttcaagtgattctcctgcctcagcctttcaaatagctgggatcacaggcatgtgccaccactcccagctatttattttttaatttaatttaatttaatttttttgtattttagtagtgatggggttttgccatgttggtgaggctggtctcgaactcctggcctcaagctatccatctgcctcagcctcccaaagtgctgggattacaggcttaagccaccatgcccagcccatgatgtgacttttatacaaacatagagcttatacattgaattggttgctgcccttttcaagactgttaccttggaaggtcaaatgtatatattcgagtgatatgcatcttagtattttaggtaagagaagactctgggagttacaacttattctagctcctttgccttctctttcatcttcttccaaaatttcttacattaccatctattattgccatcttcatttattccctagcccattgtaatctgacttcagtactcacttctgtattaaaactctcaccaatgaggttacccgtgaccgccaagtctcttaatagggacaattgggtgcactctcattttctccaacccactcattaccctaagagttatcatctgcctccttaactaaactaagagcagcatggaggcgagggccatctttctttatcacagtatcctctatgtccagcacacacctgatatcacagaccgtcaatgcttcactgaatgaatgaatgaatgcatactctctgcctctcattttacacacagagacacagaagccctaaagaaggcatgcagttcgcccagggtcatacagctgattattaggagaaccagcatgtgacctcaggtctcctaactcccaggccaatgccaatgggtttcatataatactgatgtggctcaaaagaggtttcggctccttttaaattgttttcaaagcccacaatatattcttttgaatatatctggtggcaagtctttattctttttttttttttttttttttttttgagacggagtctcgctctgtcgcccaggctggagtgcagtggcgcgatctcggctcactgcaagctccgcctcccaggttcacgccattctcctgcctcagccgcccgagtagctgggagtacaggcgcccgccaccacgcccggctaattttttgtatttttagtagagacggggtttcaccatgttggccaggattgtcttgatctcctgacctcgtgatccgcccgcctcggcctcccaaagtgctgggattacaggcgtgagccaccgcagccggccaagtctttattcttttaattggtggcttttatttttggaattatcctaaagctaccaggacacacaacgtgtttcacaacctataaggcattacaaaatctgcaaaggggtattaaaagagctgtccagtctacttttagcctaaagaatttaaggcctcatagtgggagcatgattagccagagcaatttgcataaaaatatacaatgggaggctttgactctgttctcatctgtagtagccaggaatccccaacattagtgggaaagagctaggctccttgggcagtcagatatttgtctacatgtgtgtgcctgtgagtgcatgcctgcatgcacaggtgctgtggacaggggaggtggaagaggggccaggggtgttgggatattccttctgggaaaggaggactcatttctcttctactgttcatttccactcatctcccaccaccacacacaaacatatgctagtctcccccgtagctcatggctatttatgttttataggttgattttctgattataaaattaatgttttcattgtttaaaatttaggaaacagaaacaaaaatcttacaaccccgagataaccaataaaacacatattttattcaggactttagacatatttggatttctttttacataagcggcatcattttttaatgaagttctgtattctgcatttttgctgaatgttataaaatgagtatttctccatgtcattaaaaattattcagcaatataattttaatgactgcatattgctttttatggatgtatcataaacttcctaattattctcctcttcttgggtatttatgttgttcccagaccttttttttttttttttttttttttttttggtgttataaataacgccatgaaaaagatttctgggtaaaacttttgtccacatctctggttatttccttgggacacattacttgttctgaagctagtatgtatgaaccatacttaggtttatcaatacatattgctaaattgtttttcaggaaaattttaccaacttttctcagccaactgaggtattttgaatatcacaaaaaagtaaattatggtaaatggccatactctctccctaaggaaaatggcagtgggacatagcaaggcagtcagattttccaaatcaaggggttgatcacaattgactagctattggctcctgcctttggcaaaccagaagcctggcagaggcctaatagaggaagagtctagcagaaatcatctgaaattaagataaggccatccttttgcatatgaagggccaggtagcaaagtataccaatatgtagctagtgcttttggaatatgcagtttattatttgacacatacctgcatcctaaaagcatttgaggtaagcactggttatctgggacccaactgctcctgaaggactaacccctgaactccccagcctgcataactaagtaaccagattccaaagcagagattattatcctcatattcagtgtgacctaaccaatccatcttgacattatttctgataatatcgtgcatatctttatatatcaatcaaggttttatgaaacgcagtaaaacattaaaatggctaagagcatagactctggagccagactgtctgagatttaattcctagctctacaatttagtagctgtgtgatcttaggcaagttacttaatctatctgtgccttagttttctcatcataatttgaagataataatagttcttttctttatagttgtcatgaagagtaagtgagttaaaacatataaatttctaggaacaatatcaggcccatagtaaatgctatatacaaatttcctactattattatttcgagttgctaagaattaactttagcagaggaagtaacattagataacacaaatattttaaagcaattgcttgagttttgggaataaaaggaatgctttttttcaactaggatcccaataatatttcggttctgtccttgaaaagtttttcttttttttatcatgattgtactcagtaaacttttggatctctcagacatatttgaaagcagtgtcttatactggggacaaggaccattagcattaccacccatctgatactttcccctttacactaaggcattattcccataatcttacaaatttcccataatcttacaacccagatataacaatgacaatgacaacaaaaggcatatttccttttaggacttttttttttttgccatagcctttctcttagattcatctggataaatctcactgataggttgaggttatcagagtgtgtctagaatttgacagtaccggtcctagaaaggcctggtcagattctttgtgtgtgtgtatatatatatatatatatatatatgacttttgacaatgaaccatttgaaatctaattccactgcatgatccagatgaataaataagctaaatgaaaagcatccaaggaaaggaactactcaaagaagcaggaactgcttgagcagcagaaattgacatgaccatggacatgagggtctataaactctgggctatcatggataattgaaagtcataattttccaaagggcttaattgaatatttgaaaatttgtatgaaaataaactgagtcaactaaataataataaacacagctaaactaaacaatataaatcttcaaaagaagaaccctaattaaaaagatagattgcacttcctggactttgccattctggttgttttcaatattatgccactgggaaaatacaactgtttctaatcaaataatttaaactcccatgctggggcttaagtgtgtgttctcccatttttctcttgctacttgttttggggataaagcagctcaaattattcagacaccaatcagatttatcatcctgtgccttttgatgacatccatctgtttatctaagaagccattaaagacttattgagttacagtgctatggagaaaattgggttatcatctatggttaaatccaattcttgcatctgccatcttttcagcttatgtggtatattctgaaattaccgggacttgcagacctgcactacaagaatacatttgcttcctagcctttctatgtcatttctagagaatttctaatgtatgcacaatttgtggttcaggaatatgttgacagaaagatgtcagtgctttctgttgttaaaagttcaaaagcctaatagagactatgccagcttaaaagtcttattcagaagtgggtactgtccaattccaacgtttgtgtttagactagcctattcaaaggaaaatttgactctaggtcacaaaggtagaagtgtgttaatcagaagataaagataaattaatatcaagtcaaaattcaaacggacaaaaaaagtgagagctcatcacaaaaggtgttaaataaacaccagcaagtaaactgataagacacaaaggatccaatcttgctagggaatgactaggtagaagtccagtgcttatctcacaagtcaagcagcttaagcaaggctaaaagtcatgttttctgagctggtgaagaagcagtggactgtgtggagaaaactaattgaaataaagtgaatatttgcagtttccgggagatactgttatatcctgactgcaggagccccagagaaagagcaactgtaaatcaggcagatgcttcagtttgccaatttttctagcatttgtcagagaaataatgaggaacccatcaggaaaacatttccttgatttgtttatgtaaatcaggccagaattctgggaaacccaggttttctgggaatcttcaagaattacagcatagctgctcctcctgaaattctagctgaacacactatttattgagcatttaagaagatctttccgatcatatttcagtttcctttctttgttttcctcatagtaaggtaagtaccctgaaatgggagacgatagccgtgcgatagctgagcataatcagttgagatctacatgccagatatggctggtttcagaaagatattcatttgtctgtctacctgtttgcttcctgtgaccttcatataacttctacctgtactgtcagcagagatgctgtttttgtgtcactggtgatgccacagtgaaagaaaaatcttgccaaggcaaggatgacaaggaaccaggacctagaccctaaagtagcaaatattgtggggaagagtctcctgggagtactctttcacaacctactaaattcatccaaaagtaaattttagtaggattgaaaaatactcagcctcttgttcagagtgagaagctatatactgtatgattttaagagttatgcctttttgtctttaccaccctagtcaacgcacaaaatacttgctctaacttgctgaaattctatgattaacaattcatttatttgtcttaagctttgttaaccttttaacatataggtatatgtagattatctgaccctttctttaaggtagtttctggctgcagaaagggaggagtgaggaccctttgggccagaaggagaagacacctcgtttctccaaagcttttgtctgtgatttactgtattgattgactatttaggttagcattttgattttcagtcaaaacggcagagggaaatatattggccacttttcagtcatttattcaaagaccaatgagactgagacaatacctgtggactattctctaatattttattgagtgactttattaattttagtgtttagataggagaaatgatattgagaattctctaagaaggctttcaataattgcatcgatcagttaaaggtgttgatccagatgcaaataactgctggaatggctaatgacaaggttctggaaatgtactaggaattactcaagacagaaggtctgagaggatcaaaattggtatccagaaatggcaccaccactctcccctctttcactgtttccatcttcatgtctcctccacagctcttcatgcttgtcaacttggggaaagtcatggttgatgcccttctgacagcctgctggagaagatctgttgccttttctggcagtcagtgacgtcttctgccacaactgggctttactctatggctttcttagaaagcagcatccatagctggaggagccttgagctcactggactgagtcctttcagcttgaagctgacctccctgattgccctgcctctccattgcagtttccgttctcacactgaccaatactaattgaaggagatagcatcacctactggtaatcaggtccctgccttgtcttaggttgccatccaataacaacttgagaatttataaaatattgtttttctttacaggtgtttcttgagtttgtttctcaagtactaagcactatcagagaaagaaatcaatgttaattatacacaaactgtaggaatacaaaagaacatttagataatcacttctctgaaggaaactacaatctcttcaggcagataatagataatatgggtatcttccatttctacaaaagataaaaatgtaggtgagagagaaagagcacttactaaaagttaaatggagtcagcagaacctgagatttccaagtgatagaaacctggacaggcagcagaggtggagaagcacagtctaagtggagagtcacatgagcaaaggagactcagaaatcagagttctttggaagtgggaggttgctaagaaagatcgaaaatgccaggaaggcccttacttccaagatgagcttgaatttgatctggtaggaattgggaaaccattttggatttctgagcagggatccaagctttaaatgcacagttttgaggacatttacttttctggagtatacaaactcagctgttaaagagtgggatcagaagctaaagatcagctaggaaaaattacagtaatccaggcaggtgagggtctagattgcagcagaaaaagagagtctctgatgaattcaaaagttattggaaagtggaaattgataggacttggtgacaaattgaattaaattgactaatcatttattattttgtgcatctcagcattctacatctctaccagtgaactcattaaagagatttttatgttaatagcgaagtttttaatgtaagttgatttgagagatcttttctggttgaatacagttggcaggctgttggatttagtaggcaaggccacatttatctggcatcattaaaattaggtaacctaaataaataaaatatttagacaattgaagcttgctgtcattgcccaatttggggaggcagtccagagggactggccagatcagataccattctgtggataagttatcctgagggacaagtggagaaacaaattcaggggcactttttctaagaacgggaaggggactcccaaagaaattccccaaactaagacatcagtctctgagacaaaatagaacatgaaatgaggatagagattcaaggatctaagtagtccattcattaatgaaataatattacttatgtgcattgagtacctacttccgtgctgaaagctttgcataggtcatttgttttacttgtatgtattgagcacttactaggtgttggctgagcaaagaacctaacaggtatgttcccagcccttatagagcttatagtctggtgtgggagatagtcatcaaacaaataattatacaaatacatacttagttacaaattgtgatcattgcagtaaagggaaatatagagtggcatggaggtaaaacaagggttctccacttagatttcacagtcaaaaatggtgttcctgagtaaataatattctagcagaaactttgaaggatgactgggaattagccaggcaaagactaaaaggatgagtgtcaaggacactgaaaggcaaagtaggagatcaaatactgggaatcttgaagtcggaagtaggtatttggtttaagctttggagcaaggtgaaactggaacctggaatggctgtaattacaaattgtcctcagattacccagctcagaatctacagacacacgctaaatgaaaaaggcagcatatttaatggtcagaacatcacaacatacaatttgcagtcagatgaatgtggaccacttcttgggtgttttatcctgggaagacacttaccctttctcagctttaatttttcattctgtacaatggggctaatactacttatctcttggggattgtgaaaggctcaaatgagataatgtctgtaatatacttaattcagtacctgacagacaatatatgctcttccttcatgtcaccaagtcttttgttattctatttaattcatatttattttgataacaacatgaagatacccacatacctagcaaaatgtaggaactttataacaggcattttctttgctgctcagaagcttatctgagtcttttccacctattccctgatctgtaattgtgtttcatatttttgaggctctctgaagtgaaatctccagattgggaaagggttaagggattcatatgtaaatagacatagaattcagtgtgtgctcaattaagatttgatgaatgaatgattactgtataattatagagatctgacagtgataaccatagttaattcattgctaaggtcgtgtacattgaaaaataattttaaagcattttttagtaatttgtgtttttaagttgttagtaaactaaattgcaaccttttgttctctgaatattctcttaactataaatctaccatgttttaatcagagaaatgttgtgacagttccaggaaaggaaacattttttctgtttaaaacatttctagcatttcagccaaacaatttatctagaatggttttccctttaaaaggaatagtagacaattagaagcatagtacagtacattttctgccttatggttccaagccaaaaaccagagaacttttgtgctttataagcaattgtaaactaaaatgagtaactggtatatggtaatagactaggctttgagctgctattaccatagaatacttttccggctttcttagaagcacgagaacaaaattgggaagaaggcatttatctgattgaagctaggatgctacttgcattgtacttcactttaggtagaaaggcagtcattttatttgctgttaatgtgaaaagagatatcacttctctttagaatgtagccagcaaatcagtatctaaagcctatacacatggctagaaacaaagctacccatatagccttagacctccctgaacctgatcaggccccaggatactgttctgctcatcacagtgggaagctacaggtttgctcaaaccaagtccatctatgggagttactaaaacctctccttagcacttctccagaatatggaagtttgggaaagcccactccagggggtccctacatatacctacataaaagcttcatttatttgtataaacaggcagatcagaaataggttagtgacaataaatgggtaaagtacactgatgtttaaatatttcccttgcaataatacctggatgagattattttatttggactttgggaacaaaagcattgtttggcaatatttaaatcctagtaaatataaacagtaagcaaattttacaattaatttaaatagttcagccaaccacataactatataaatcctatgttagtttaatctctctagggacttggcaatatttttttcttgataggcagatttcacatatattttattcatttattcaaaaatattaactaagtccaagaaaattcctaagcaccgtgctaggcactaatgccaaacggccctgcactaaatggacacttagagtcttgtgtgggattcagacaggaagcaaatagtgtctcagtattctctctgcagtatccttccctcttaagacgactcccagatcagaggggagcagctcctgtagaagtggcccagggctaggagacctgccactccccttctccccactgccctctcagcgctcctctgtagggctctgcagatctagtttgaagattgctttacatatggttctgatgtgcagaaaaatggaagaatctttgctgaatctatttcatttggactaaatctgtttcagatcttactggccagcctcaccatactggccacacacatgcaagaaaaagccttcattccaaccaacctaaagccacactatttgctcattacaatgaaagacataatttacttattgcatggcttaggccagagagaatgccagtaggaagactcttctcccaggaaataaatagattataagaaacaataagaaataaatagatgtggacaagaagcctcaatatgcttacctgtctacacacacacacacgttattgaacctgatgaagggttctgaacttgcagaataccagataattgacatatcagtgcatctctagtctgggtagattaatctggggtacaagtatattttctctgttttttatgttgttgttgtttctacaagcagtttccttttgcatttcctctgtgcaaaacaaggacctggggatctgcttcatttataattagagcaagaaagtcctgcttgacattgtattggagccttacagtttcaagactctcggttgcataatgcatgtgttttgttaataccgttaataccatgtaatactagtgcccctgatactgtgtataaatgaggcatacaagtagctccttcgcccagcagcaacatggtctgtacttgtagaaaaatttacctcctgaccccctaaatattgattgtttgattggagaattgagagattccagtggtagggatcagaaaagatgaaaaagatgaaaatgtgtaggcataaaaatagtatgaggaagagaaaaattataatggcatcacatatatgttgcatattctatgccaggtagtgttaaaaaggtttatgtatgtgcattcacatactcatttaaatattacagcacccccccaggggatacacatacttactgaaattttagtctgtgtaacatagcaagatcctgtttctactaaaaattacatttaaaaaaatagctgggcatggtgatacatgcctgtagtcccagctactcaagaggctgaagttagagaattgcttgagcccaggacctccatgttgcagtgaaccatgatcgtgccactgcagtccagcctgggtgacgtgcaactctctatctcaaaaaaaaaagaaagaaagaaagaaattttatagattggggaaaccaaagtaaaatgccttggccaagatgacatggcaaacaagtgacagagtgaggatttgaacccagacagtccagctgtcaagtcaatgctcaaagcatgatgctatgtagccataggagagccctatatgcaggtagaggaaagatttctttataaaccaaaagatgggtgtagactcagtgagtctgtataacggggtaaagggagttgtgagaaagggaaccgagaattttgaaaggaatagagggctgaactgaagctgaactggggaagcccctgactgtggtaaataaacagaaaataaaaacaatagtagtcacttagctgctttaaatcccctttttagcaatagattgtaaatgataatcactgtgagttttttttaagggaatactagagattctggtccaactgtggttcgagtggctgcaaggaaagcattttcaaccagcagcggaggctgcagtcattcacgagcatcaggaaatcaggggagcctcggagaggctgtgggtgatggatgggaacaagttgaaagaatagtatgcagaagcctggggtcagggtggggcagtaaaagctgagctcaggagccaggaaattgttcagaagctagaaatcaaaagtcatcagatggtaaaagccaacacagcagagatgatgccaaaagcacctggaaacaaggcaaaaacagcttcagacaggagaaagcagcttatattgctggactaggaactgaaattatttcccaggataaagtcatcctgctggaggctttcagtagagtgcttcacctcaactggcagtggctgtcagccaaggagaaacagatgcaatctgtagctctaactgaaaagcctgctgtcgcaaggacccagagatctgagacagtggggtcaacctgagcctggccatgggagagggtgaactatggagaaaagtgaaggaatcccaggcttcggctagagaagacctgtgataaatagaaaggggccaggtacggtggctcacgcctgtaatcctaacacttggagaggccaaggcaggtggatcacctggggtcaggagttcgagaccagcctggccaacatggtgaaacccagtctctactaataaaaattttaaaaattagccaggagtgctgatgggtacctgtaatctcagctacttgggaggctgaggagaatcgcttgaacccagtgggcggaggttgcagtgagccaagatctcaccactgcactccagcctgggcaacagagtgagactccatctcaaagacaaaaacaaaaaagaaagggagtggtactgtggaactggaagggcctggaagaatttgatggatgttgtagaacatctaggccaattgtgtccctgtcatttacctaatcagtattggatttttcatcctgagtcttttgtgcatgtacgagtagttaaaccctttatgctcttaagtatttatcttgctgcaatgtatggtaatcaatgaggtttgaaaggactgctttagaagagaaagagaggaagcaggtaatcataagagttgttttccccttgagaaaccaaaaagaacaagctctgaatagaggtgtgaggccccttcccactttaacattctgtgagtgtctgaatgtcctaatccccccggggtgaaaatgactcagaggcaggtggtacctactgtatttttgtggagctgtcctggggcctgtgccctcaatgcgtggcctgtcttttctgggacttcaggctctctctatgaagggctttccctgttttatgctcagggcattgcctagctaacatgagcctatctctgggtatttccactgagggtaggctgcgtatccagctatacatgggagtaccgtagttccagggccaccactagctttcattgcctttgagcaaatgctgtcctgctccagagtttatggcttggcacagagtggaatctgcatttcagccggtgcccagcccttagccaggagtcttgtgcagtgatgaactcgcacagccatttgcagtttgcagcgcccctatggattgcttctgtttctgccggatggtgatgaaggagtgctccaacacatcaactctgtagcacaatagctttcacccacaaagctttgtttcctatattctctctggcttacctaaccaaaatattgaagtcatctttgactcctccctcaacctttacattcagttaaatactagtgttgatcccacctctgatttctcaaagactatttctgtagttcaaaaaccaaaagaactaacattgacagagccctgccatatgctgggtactttaggtctcttttactcattataggctatcttcttcttccattatgttcatttcgtaaatgtggaaagcgagacttggagagtttcactatcatggcctcaagctagtaagtgctgcctacccaggtctgtctgcttctaaattccaagctcacctgccctgcattacactgtgctcatcaatctgctccaggacctaccattaaatagctttgccaaccccacacttgccctccaccagcctatcttccacactggtgctggaggtaactcccctaaatgcataccacctatcctgtcacctgcagatttttgaggaccagccatttctgacaggtaaagttcacccttcccagcctgtcatatgcagtctttacttatttccccagccttggttcctaacactcatgccccatctccaacaccatcagactgagaccaacacgtccaggccctggggataaatggtaaagggaagatgttgcaggattggcactcagcattcaaaaacagttgttgtctctggggaagagccacaaaaggccttgaataaacactgagagctgagcaaataagcacatgcattagaatgcctgcagggtgcccacactagttaggggtgtggcgggctttgggagaaaggctggtggtcaggtctgccccactgagggctgctgggaagatattcaccgaactgcctaaataagtggccttaagacgcccctaacccaggttctgacacccacattgtacttcctagtcacactgagttagttgttctttcccataggtaccctgtattttcatacttcattcacatgtgctatttcgtacttcattcacatgtgctattttttcagcctgtaagacttgctgtcatctggaaaaattttccactctccagggtcacacattattgtcatcttctctatgaagccttccagactccttgtaggcagtgttacaactctcctttgtggttttatagaggaagggagaatgttttggtaaggaaggggtctgagttggagaatgagaagaggatgaggagtagaatggcgtctcttccccgcagagctcttaggtctttgctcattctggtgcagtggcattagccactttgtatggtgaatagttttgtaaaatagacagatgtctacaggtacttcacccttgccatatagcaagcttttagtgctccctgcctcccaatgggccgccagttatttatggaaggaataaaccagttacaatacatcatagctccggctgtttgaactttctggctctagccatccttgcccatgttctctgcccataaagcctttacagatgcctcaccactgtcatggtctatcaggggaacagatgccagtagctatccaagctgcgacctcttgataatcccaaactcctgttctctaaggcaccagcgctgggcagggctttgcgcagatggtaggagtgcatcttctggaccctggacaactctatacccatccaagaacaacatccatgcaagaaactctttacccctcctgcacatccagtctgcaagctccaatggagaataagttatatttcttcccccactatccttcccactccatctaagacctgtcctcaataaaactctcttctattaggaaaacaaagctcttgtgcatatgagtgaatgagctacagctgttgggagtgaggacaatcctatctttagataaacaccccacagaaatgggtggatatgtgtaccaaaggacttatacaggaatgttcacagcagcataatttttgtagctaaaaactggaaacaatctaaataaccatcaataacaacatggataaatgaagtgtagtatattcatacatgggtatggtataccgtaatggaataaactactgctacatgcagcaatgcagatggatcctgtgtgcataaggttgagctaaaacacccagccacaaaagggtgtgaactatatggtttcatatgaagttttttaaaaggacaactaattaatagtgctgggagtcaggaggagagttatatttcaggaggagagagcagaggggatcttctagagctttggtatagaaagaactgatttaggggtgaacgttctgcctaaggcctgggccttctgcctgggtaagaatctctgaccagttcagaaatggcctacattcatcagatgcagaggcagtcttttcaaactgtccattcagcctgcagtgggggcatttggaatggatatgaagaatgacattttgagtagcttggtgtccactctgctcatgggacagaacctaatgattgattcagtaagtaaaattccaggaaagaattgcgtgcatttagatatgggcttctgtggcaacaatgctagagctgaggaaaaatggaacaagctgtcataaacaggcaaaagaaaatagcagtttccatctggaccttacctttacatggctgttttagccgtgatcattccaaaatgaatttgaaatcacattttacctcatttctctttatatctggcccaatatttcttttggtaatccatggctatgaagcccttataaacagaatcctggcctattttcaaggatgggagatatgacacaccaattaactctaggaaggtttgaatttagggtggttttatttcaccatgcagaatgtttaagccatatctcaacatagccagctactgcaaattccaatcccagaatcacattgctcccatagtggatcatctggctgtcaggagattctcagcaaacaacaacaacaacaaaaagcattaggccgcttcttcctaattatgtctctctctaaatatctaattatcattgagaacaaattgcatgttacagagataatattatggggaatcgttaatctgttgggcttctgcttttgaattcctgagtcggtactgcagctgctgaagcaaaaaattctgccacctggacacttcattatgatttcatatttaaatgcaaaaaaactgccgaagagaggttctatttgatggacttggcttcttcaggcatttcgtacttagctacgcatcacatgtacaggtcttccaaatatcccaggtacctgggaatagtgaataattgagcatttacagggacagaattacaagggaacaatgggaatatagtaataccaataaggtgacagtggaattgacttctctaattatactttctttttatccatgcacaaaggtctgcagctttttgtaacattcctcagtaactgcataggacttccttaataaatgctgatccaaaaagtacacattcccaaagattacctgataattgcacctaccataatatgcttaaagctaattaacattcagacttcactttagagaatagaaattaccaggtacttatcccataattacatctttgtgcactcactattgtaatccctggcattagctatgtaattaaatgatgaacagtgactgtgtaagtagagagtacttatgtaaaatttgtgtcttatcaaaaataaataaataaacagattcaaagactcaggtctcatttgaaattccattgttctcagggagattgtatagcatgtcaagaattgataataatactgttagctccttgaaggtgggaagatgatagtactgccactctgtcaggaagatgcccactgtggttcatcttaccaccagggatgagcggcgccaagcaagtctcacggtttttttcttggcatgcctcaaataacaagtacttagacactgtcttactaaatctgacctgtctctaagctatgaaatccagtagttttttgtcagatgctttgtgcaagaattcttttaaaaaaataatgttttcatctgatcacaatgctaacatatattcatcgtggaaagtttgtaaaatattgaaaacccacagaagaaaatagaaatcacttataattccttatcaatgttaacttttttccgtatatgctttcagtctctcttgtagatgaatctcactgtatctacatatatatgtatacttcttgcgacctgcattttagaagcggtatattgtgaacattccaatgaagtattattgtcttttatcatatttctcatgactccattataatctgtaatattggtagtccctaaattatttaaccagttttgatggacgtttaggctagtttttcaacattaatttctatcattttactattcaccatgtgagggttctctaaaagaagttttaaatgttgtgttttcatgaaaacatgttaaaggtcattcattctaagttattaccttgtgacaatgtcagtgcctgcgtttgcatctgtattcacagtgtgctgtgctgcgtgtcactttcattgttgtgagctgatgagaaaggacagaggtctgcttaataagtaaatgatcatatagttggttccaccgagtgaaaccaaaggacctcatagtatgcaggacaaatggaagttcaaatagcaaaaagcagtggcaggattgagccatcacatggaggtagcagagatacatcaaactcaaaactaaaaaagaaaatagaaacccaagaagttgataccatattcacagcagacagcaatcaaggctctcataaaaatcattagtttcgagaccagcctgactaacatggagaaaccccgtctctactaaaaatacaaaattagccgggtgtggtggcgcatgcctgtaatcccagctactcgggaggcagaggcaggagaatcgcttgaacccgtgaggcggaggttgcagtgagccaagatcgcaccattgcactccagcctgggcaacaagagcgaaactgtctcaaaaacaaaaacaaaaacaagaacaaaaacattagtaactctaaattaatgttgttgttttgaatgtcatgtgatttgtaagtattgtatttaatttgtagatttgttttacatttgtttggattgtatagttgtataagaaccataatcctaaagagccactatgtaatttcatattttcatacatctaagtaacagtaaaattaatttaagtcaacagtgagagtctgtaagaagtttccatttttaaaacagatccatacattttctcaatttgggttacattgtcctcatagctacatcattatgcatatccttagaataaattatttcctcagggaaatttcttaaacataaaattattgtcaaatgttataaacattctaaggcttttgatgtttctgtcaaatttgagtacagactgttcaagttacttttctccctttagtttacccttcatttttaatactttctgcagtagtacattcgttctagtttgccaaatatttattgagtgctaaccatgtgcaggcatcatgtattggcattgactagtgaacatgttaaaaatgcatcatcatggaccccacaccagaccaactgaatcagaatctgcattttcaaaagatccctaggtgatacgattgcatattcaagtttgagatgcattgttctaagaactagacctggaggtcgactgtctctctgacacttcctcttgaccatctcgaaggtgccccaaacacaatatgtttgtcttagttttgggagctgctattacaaaatattacaaaatatcataaactgggtagcttataagcaacaaacatttattaccctcagttctgaagttaggaagtgcaagatcaaggcaccagcagatttgctgtctagtgaggggcagcttccttcctaggtggatgtcttctcactgtaacaacacacagtagaaggtgcaggacagctttctgggctctcttttataagggcactggtccattcatgagggctctgcccttgtgacctaatcatctcctaaaggcctcatctcctaataccatcacactggtgattaggtttcactacgtgaatttagggggcggggagaggcacaaacattcaggctgtaacaatgctcaacatagagctctttttttttttttcaccatgcctagttctttttccagttttcctcttctcagtgagtggcatcaccatccactctctcatgcaaaccagaaaccttcctctactttaccccccatatctaatttatcaccgagttcactatctctcacatccctcctattttttcactctctctccactgccaccctccttgtctaagctactcttgtgtgttgcctggatattttgcagtatcttctgaactggcccccctgcttccattcttatcccctctagtttattttccacagtaagttgtggaaaagagtaatcttttggataggcatattggaacttatcaccagcttgcttaaaacgtccaaaggaccttccattgctctcatgataaagacagaaatctgtaaggtggtcccacgagattgagtcttgcttgctctctagacttgttctgtgccgagttctctaaggtagcagtcctctctcactttgctttctccttacccttcagtttagctagtgaacttctattgttccttagattgtagctcaatcatttcttcctcagaaaaccttccctgacctccctaattagattctttcctcttgttctgtgatctcaaattacacaacttattcccctgcgtttttatcactgttgtaactcaacattcatttttgatgtctttgattaatatctggcaccccattagagtgcaagctccattagggcagagaccacatctgttttttcagggccagaagatgataggtgatgtcttacaggtccttaccgctctggctctcttcatgagtggttcttccagatggaatgcccttctcctccactgtcacttaaataaataatacctgtctttcaagattgaattaaaggaacaacccctcaatatgatcttcctggcggaagtcctcttcaaatcctcttataaggtacttattaccttctacaataattactatgcatttttctctctctgtattaatcaacgtaagtaaccattagttgctgcaaaagataaacagaagttgaatttcacccatacccagttcagcttgggctaactgaagcacttcttcatccagtgacttgacgatttaggcccccttcatcttatcaggccattttcctagcatgtggctcacaaggcagccacaaagcatggagaggcctcccagtctcttaaatgacaaggcacagaaatggcatgtcacttgtgctgacatttcgttggctggaactagtaatctgactcctcctaaatgaatggtgcagtggaatatagtcccctacatacccaggaggatgcatagagctagatatgagtgaaaactagtcatctctaccaagctgtagtaaactcttgaaagaggacaagatctaagcccaaatcactttcagaacactaaagtattcaacctctcccatatttgccaattaatacaagttgctgattcaatgaatggctgaggatttcagaagagggagacaaaagcagagagaagcagaaaggcagatacagagcagcactagaagacagcatctctctcttagtccattactatttgtttcagctacttacacacttttgggcagtgctaactaaattgataaacagcctgccccacccccacccccacctcccaaagtcagttttttggggtttttgtttgtttttgagacagagtcttgctctgtcacccaggctggagggcagtggtgctcactgcaacctcagcctcctaggttcaagcaattctcatgcctcagccacctgagtagctaggataacaggcatgcgccaccacgcaccacccgcagtcagtttttgttataatagcttggcttcctatatgtgatattattgaaaagtttcagaataacgcccatgtgctggacagtgtgcaaggtgttttacatagactgctatacagtcattctttcagcaattctgcagtacaggcattcttatcacagaactcacaattttctgccttagaatgtgcattgaactctgtctgcctctaaaacctgtgttcttaaccacgacaccacattgaagtttattaaacatccgaatatttatcaaccctgagaatgagcgcatataagtaatgtgattaatctacccattataatccctgtgacttagccttgggaaatagactctaaggaaacacttgtagaattttgccaagacagtagccaaattccaaggaatatatgtgtatttaattaagttacatattctaaagccagggtgatgagcaatttggataatgtttctggtgtgtgtgcattgggggagtggtggtttccagatgagacaacagccacaaagtaccttgtcatttcttccattgatatatatactcatatatgtttgcacagataagactagcttttggctttatgcttagttttatgtacagtacaaacattaaatcgtgaaggtgttcatcacaggaaaaccagagaagccctcgtaagccttataaatcattgtccttatacccagctcactgtgggtggtggaccgttagagcacatggggacagagtggcagtctgtgtgatgttaagaatgcaacctattaagcagagaatgagaagttgaaggattccatttttcaccagctctaacatggttaatctttaaagctatttattgaacacaaagacatttgactgagcactttgtagtatgcatctttctctaccactctcattcatcacctattttcaccgaatctttgttaagatttgcagtaatggtgctgtataaaagggcctttatgtgactcacagtccctataaaatatgattttttttcttcagatcatcttttgaaaattgctgctgcttgttatttcacatatttttttccaagtgcattaagtttacctgcaacgggaaaagattatttagagaaacgtacactttctatttcctttaatagcttgtgttatgatatgtttgatagttcatgaaggacactgtcagatttggagaatgagccaataaactttaggtcctaagaaatatagccccgtaatgatgcctactcatatgcagagatattttatcagcttaatggtaccttttagtgtctgacaccttcggtttacaggtttgctcgatggcctgtttgcttctgtgccaaattagtgttgagggaggtttctgatgagaagaatattcagtttggatattagagttatggccgtcaagttggaggcggtcagcctggtttaatctcagatggtaccttttactgcagatgccgactggggactcatgaaatgcccaagcaactcttgtttggctgtaagggtgcaaatcaaggtgtgtgggcaggggagagcatctcttgcctacagcattaacagacattttattttgtaaaatatgttctatcttccccaggttaaaaaaaaaatcatatgctcatcttattttaaacagattcttttagtggtaaatgaaagcttgtaacctgtaaggtagcatttatctttatattcaaagcttgggcagccatggaagaacattgggagtgaggacacttataaaaggaggagaatgtggggtcaggaagcagagaatgcaaagaatagtgttctggaagaaaaagggaggccaactgttatctctaaactgcctatgcctgtgaacttcatccaagaacagaacatccaaaaaccaggcttactagccttgtctttctttttggaaatacagagtttcgcaaataaataaggggatacttaattatctccaagcaaacatttcatgtgaacagtatagcaaattatattgtgcatatataatgccaatgtttggagcagatgaagatgactgagttgcaaggtggaatgatgatcgtgaatcttctgtcagttactcctctgtcctggatctagtcattatacatttatttttcaacgtcttctgttttaaaatgactcttctccaaatactagatcacttagttcctttttgtagataatttgtatccttgaaatggacaggtacttcaaatatcacaagaaagggtagctttagttttcttttgttttaccggttagattatctggctgaggttgatttaactcagtcaggtaagctagtaaaagtttgtctttccttaataagactgattttttttgttgcatttatccaacaatcttgtatattctaaattttgtgcagtttaaataggacattgttaattcagttcatcaattcattacaaatgtgcagtacggatgctcacacatttacttcctgaatggtagatgcagggtaagaaaagcaaaaccagcttcatgatatctgtgatcaagatacatattaaggtgaatacggacaagattctactgagtctgctgaaaccgtttcaaatattttggggttttgttgttgttgttatattactctgtttactctaaaatcaggcacttgaggctttttttctcgcctcagaaagatatttctgaaattcatgacattgtaatggtgatttttattaaagcaaaatttgatggcttttgtttatgagacctgccaaacagtgcaaacacaatcagttaactatttcctttggaaggagtatggtaaatttttgtgtaagagactgtttacccaataaggggggatttatagtttccaaaagtgtaatataaaaacaatcttcagtttccccatgttatatatacatctagtaatatactttctgtcctgtgtagctaccagcaattttaatatatatagttactcttaaaaacttttatatgatacaccacttttttgttaccttctaataagaatagtggattctaggctagcaatatttcatgctgatgatacatatcttgtaagactatgaactttttgaaagcaggcatagcaagcatataatttaaactctactgtatgcattagagattacagagggcctgagtttcctcaagccacccatcttattaagtcatagcactgcatactacataatggatttgaattccgattgaaatcattcatgatcagggaatatttactctagatatagaaaattcaggcagctgggaaaaaagaagggatcgagttgtttcacaagcctgcttatgcgcctgtgtttgtgattgtaactctaattatatttgtactgtattataatgaagtaatttaattaaatgttccataagttgataaaatatttgctcaaaagttgtttatattaaaattatattaatactttagagagactcaagacaagttgcttttaaaaattgctattgaattctttataaacatatatgtcatggaaacctagggaggagagaatttccataaacagactatgcttcattgtgtgccaatgcctcaataataggaggaaaataaagaatgtgtagaggccatgggcttggcatctcaggaaccactgctgacaatgcaggttcgagtttcatcatatagataacggcaaaagctggatttcaatatcttaggcatgaggttgagggaaatgggggcagaacatggagatcatgattgtgtggcatcattcagcagccaggtgaagtggagaggcgggagttatggagaagttgatagtctatcgctgggaaggactttaaaagagtatgtatgagagaaaaagactttaaaagagtaaggtgtttaatgagtatgatgcagaggaaagagcaaggtttcggatttgcaatctgtgtgccttttattaatgtatttaacctctgagcatctagctgctccttctataaaactgaaataatatatgactcaacagattttgggcgaataaagttatatgtagatgatatagcataattcgttctttttctttatatcttgccttcttctgttggaagactgtattctactgagcatgttgatgggttagcataagcactttgggtgcaggcctggggaaagctgaatagccctggattcagaaaacagagttccagccactcctgcagatgattcaggaggctgcggctgggcagcagaggtggcagtgggcagtgaagggctagcaaatgagacagatgcctggcatgaaacgcgactacttccataggacccccacgcaaacaataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggaccaaaaaaaaaaaatcttaggaaagactttgtacttctacaggatgaggaaagagacaaggggaatagatggaaatttcagtaagacttcagttggcaaggaagccctgagctgactcctgggccacatataaagccaggtgtcttcaacataactgacatggaatcagtgatgctaattagcataatattagatcaaagatgcaccaaagggcattgttgaaggtccactgtccacaaagtggttggaggaatgggactgagatgatggctgagtttcttttctttataggacatgcaattaatgactgcagccgaatttcggctcttgtgttccgtcttcctaattcctgagcattggtcatgaacttgctagccttgccacaatttatccagtaaacaatgttttactctcacctttacagaaatctaagagctttgaaattggctacatatagatgtaatgtatgtagggcagggagcacccaagagaatttttttttctctaagattacaagatatttaccagacctctgaaaaaaattgctggagttataaatgtgctgggaaccacctaaaaatcccaaggaatattagtttttgaaattggtgccaagatattgaccattgttgcattcttataaagatctagaatatgttcttatgaaagaaatttttatcataattgtttaagtcagcagcaaaatcgcggggtgtctgttatgctacccacaataatactcctggacagagagaatgacaatatcagttctttaaaaatccaacacaaatatctccttccttctgtttgtacaaaggcaaccataatggcttttgcttccggcagactgaagtaacatgtggggtctctgtagaaacacttggagtctacaaaatgagcttttagcttatcccctggtagttaattactatacctctaggtcaattagatggctctcaattgctcagttgtaactgtggtttcactcacaagctgtgtgtggtaattctagtttacttgttttcttaagtaaaactcaaattgccgtgtgcatgagatccagaataatgatcaaaactgaagtatgctgaagtgggctatgtaattaaaacaatttcatcaaaagcttcgtattttaagttgccattatattggtaatgctctcttggttcctccaaagaccatttctaaaagtaaaaaataaaataaaaagagcattttaccttcataactagcactaataatcagatatttgcatgatctgaaatgaaacaagaggtacacagtccaaggtggtcgtgtgtattgaaggaacaacactgcactggtccaccggggatacagctgaataacctggaggtatttgttgtcattcagtattcccgggtgcagtgccttttcagctgccgcaaggttaggcatacaggagcgtgttgcacacggctgtgctcatcctgccgttctaatgtgaatgcattatttccagctttgtggaagctccagcacatttataatcactttctactcactcttgactatgactccttcatctgacaaaccctcagtgaaacatcttctgcctgtcactgtccccctccactcaggaaagccacagaccttgtttgtgcattcagcaaacacttactgaacatccactgaataccggacactgctgaattccagggatataaaagcgagtaagactcggacccggtggtcaaagatgctaatgtcttgtgaagaagacagacatttagacaagtaattacaataaagtgtaagaactcttactcaaagagggaacacctaattgtatccaagagtgatgtgcagaagaggaatcagggaggccttcccaacggagctgatgcttgaactgggtctagaaagatgcaaggaatttgccaagtggttcaaatgagaagtcaagatattagcagacaggggaaagaacatatatgaatgtggaaaggatggctttgtgtttactaattcgatctaccaggtggatgaggttgccataatccaagaaaaggaatataaaaggagagaaggggatgtgtacaaggagcccagttagcgtcttctgtgttattgtcactgtcattatcatcatcatcatcatcaaaccatgtttgtaaaattcttctaacacgttcagcagactgatttttttaaaaacccataaaaacatattgcccattctataaagattcagtagtatgctgtcttcctaatatgtattctgagattatggttctgcctgtactattaaattataaagtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagataaagatgaaacaaatcataatatcatctgttggcagtatctgaagaaatgggcatgctcatgcgttgttggagggagtggggcaatttttaatcaaaattggaaggtactttatctagcaacccctcttaggaattaaagatatttgaagaagtattcaagggtattgatttcagctttttcgatcctaatgaaaattgaaatattttaaatgttaatcggaaggagatacagttgatctatgcagacatacaaagcttaaatgcttagagggatcatggagctagttaaatgaaggagtggttcaggtggaagacaatagggagtgatgggatcatagagaatgggagagtgtcctcacaaagggacaggcactctcggctccagctatttgtcaccatcagggaatgctgagcccaggctgccagatttttgtggaagagaagttgaaaatcgaaatttgagaatgcagtccccggatttttaaactaaaatgtaaaagaaaacacagtgcggatcataaccaacactttcgccaactctggatgtcataaatttgtttcttctttgtttatctaataggtcataagtgatcattcatgttagtcgtaacttgcatttctttaaaattattagcaacattaaatatattctcgtataggtcatccttattttttttttttgagacagggtctcactctgttaccaggctggagtgcaatggtgtggtctcagctcactgcaacctcccgtcttcccgggttcaagcaattctcctgcctcagcctcccgagtagctgggactataggcatgcaccaccacgcccagctaatttttgtatttttagcagagacggggttcaccatgttggccaggatggtctcaatctcttgacctcatgatctgcccaccttggcttcccaaagtgatgggattacaggcatgagccactatgcccggtccccttttatttctttgataggtaggtatgtatgtatgcatgtgaattgtctattcacttccttttcctagtttcctattgacaaatttactttaaaattaattaatcaaataccaaatttagctttcaaaatccagtttgcaccatgtgatttgtgcagtgaaagacttccaggccatcattgtggcaggctgttctgctgcccccacgtgggctgtcccatctccaagacaggattgtctaccccatgctctactgtgtgcctggcagtgctactgtgtgcctggcagtgctgctgtatgagcagtgcactggcccagcccgttaatgtggggccaagcatgtgtctccttttggccaaacacatacgagtggaggtgacacacaccttgtctaggagaccttaaggccataacaggtctccactccactgttccacactctgcatctgtcctaaacagggaccacctgaatcctggaatgagatggcacatgaagcagaaccgtaatgaatgacgaacccctgatatgttgtgtagttataagtcaccaaaactgttgggttcatttttgtagcaaagctgactaatttttaaaattgtttaaaatatggcagttttcactgacatgaaaagatctctacactatatggctgagtggaggaaaacagcagcaaaacagaatacataatatgaaactttttttgtttctttacttttttcttctccttttttttcttttttttttattatactttaagttctagggtacatgtgcacaatgtgcaggtttgttacacatgtatacatgtgccatgttggtgtgctgcacccattaactcgtcatttacattaggtatatctcctaatgctatccttcccccatcccccaccccacgacaggccctggtgtgtgatgttcccattcctgtgtccaggtgttctcattgttcaattcccatctatggtgttctcattgttcaattcccatctatgagtgagaacatgcggtgtttggttttttgtccttgcgatagtttgctgagaatgatggtttccagcttcatccatgtccctatttttttgttgttgttgttgtttttgagacggagtttcgctcttattgcccagactggaaggcaatggcatgatctcggctcaccgcaacctccacctcccaggttcaagcgattctcctgcctcagcctaccgagcagctgggattacaggcatgtgccaccacgccctgctaattttgtatttttagtagagatggggttcctccatgttggccaggctggtctcaaactcccaacctcaggtgatctgcccacctcagcctcccaaagtgccgggattacaggcctgaaccactgtgccaggcccattatatgaaatttttaagtaaaatgttgcatattaatatacctccatatagctatatgtatttttaaaaaagcctgttagatatgcagaattggtaatagtgattgtcttgagacgctggacttgggacagcttttactgtagtttttccactttcctgtattcttgatttcctgtaacaaatcatctttgtaaaaagaaattaatatttctacatgactgatggttaaaagaatctcaagagccatatagaacataaaatgattccaccagaataatttttcaccctcaaaaaagtaaatatcttcatctcataaaaacttgattatagagccaagactagccaaggcactcctgaaaatgaagatcaaagagaaaagatttgcttatcaggatttcaggaattattataaagctatactaattaagacaatatgctactggcataatacaagtatgtgaaccaattttaaaaagtggagagtctacacatatccagaaacttgattcatgacatagttggcattgtagacaagttggaaagaaacagagtttccaataaattgtgctggaaaactggttgtccatatttttttataaaaagataaattgggcccatacctcctattataactcaaaaattaatgcctcttggcttaaaattttaatatgaaaggtaatatcataaaacatttagaagacagtctacaaaagatcttaatgactttaaaggaagagaaagatttctttaatataaatctcaaacgatgaaaaaattaattcagctacattgaagttgagaacttctgttcatcaaaagatttcatttaaaaaaattagaagataagctacaaaacaggagataatatttttaaaacctgcaaaaggcaaaaaataatatgtagttatttttcagtgcttatgatgtgccagatgcttatactaaggctttacatgtattaatgcagctaatttcacaacaaccccatgagacaagtagtattgtcatccccattttgtagatagcactgaggcacaaagaagttagggaacttgctcatgcccacgtagttaggaagtagcagagctggaatttgaacccaggctgacttgctttgaagtctgttattttaatcactccaacatgacgttatactgcctcagctatattaaaggatgataattcaaaatatatgaagagcacctataatcaataataaaaaagactagcagtacagtgcaaaaagggcaaaagattaaagggtcattttacggaagaagaaaaataaatgatcagtaaatatgtgaatagtagtcaatttcactagtaatcagtgaaatgcaaattatagctactttacatccacctgattctacaatgtagaagagtccacatccttgccagcatgaaataatggtatagaggagttcatatccttgccagtgtgaaatagtggcacagatatggactcttctacactgctggagggagcatagattgacaaatatattaatgtcatcattctcttaagagttaattaattgatattttggtcctactatgtaaaaattttatggaaaaagtcatctctttaggtcacatttttctcccacatggacacatgagacagttctattaaaaatagaagcaaatatgtctcaattgataaaatatgtatatggagtttattaagtggtttgtaaaatataaaattcatctttaaaacttgaagggaagtatgagcctcactcaagtctattttgattaaaaagatagtacatatttgagtgaaaaaaattctttaacttattcttaagggcctatttaagacagatttttatcccaacttggaggcgttgacaaaccaaaatggtaactgttaattgatggcaggtttttaggcagtgggttttttgttttttgtttttgtttttgttgcacttaatatggtgccctttgtctcatttctcactgtcccttttatgcttttgtcttaaaatattaaatcagcaaggaaagtgtcagaagattacagtttagttcattgcaaaccacagcttatctttacactgacctgcagaacagtcttagtgatgttattagaaaaacaccagagaggaacagaactgagaagaaaaaaaaaaaaaaaaaaaaagctttgcttttctagaacagtttctaacagtgctaaaaaacatcatgttttgaactatcattttttgactcggtaatcatgatagcgagcaaatgccctctatcccctcagttcagtcctacagaattaagtcctggaaacagcggctgtccagtttgttaaagattgacctaggaaagatctcaatgctaccagcaccttatagggcgcaaaatgtaataatagggtaaattatgttttctttttcacatttgcacgctgagattgttttggagatcttttaacttagctcgttataatcaagttgtacagcctttgttttaataagattctaatcctgaggtctatccttcgcatcaatgactttacactgttaattgctttcttgtcctccattaaattgcggttgcagttgcttcatcttaaaaggcgccttgtgctttgtattctgccccatgctctgcagacacacttagtaacatcatcttcctaaagaacaaaattacctattatccctttaatcttgatgtacttttttatgtgtttggttcctagctagtgtccaaccaggaagctacatattatcttcttttaaaaaaaaatgtttttttaaaagccgcatagtgtggatggccaaaatttatttctcaatagaactcacatagtgcattcatttattttttataggactaattaaaaagacaaagggatctattctccccttgatacaccagagtgacttccattaacattaatggaagggaaatacttgcatggagatgagtggagacctcatattagaaagtgaaaacagcagagtctggagtgaatgtccccacgtttttgatgagagaagctacacaaaaagcaaatagctcaattcacaaatgtgttttccccctatgctttctgtttgtttgtatattgaggaaaatcagcgaatatttggaggcagttccttccttcagaaatcaattggatgtgaatttgtaattttaacacgaatgacacaacttacaggaggaactcagcaatgagaagcaacggggggatctgacaggtctttgctgcagtggagtcctgtgagacctgcttctggaggcagaggtgagagtagaaattggatacctgaagaactctgtacacagaaacttaattttcaaggaagcccagctgtccgtgtcaagctgatcttttgacacatctttccagaaatctatcaaaatctggagactgcttctgacttttcagtgtagcctctgaatctgtgatcctcttggcccccttgtataccttatgaaagttttaaattttaaatgtacataatctgacacacactggggaagtttctcttttatcatgtcattcttaggttaattaccagggaattaattatttaaagtgtgactagctctccatgctgtatattgttttaaaatattgatacattcattttgcatctggtgggtgctaagttcaaactgctttttaccctttgaaaatgtacttcaaaaatacaagcagtcttctgagtaacaaacctctccgtggtatcttgccactgccctccatttccctggcctggactttgctttagctgcttaaatcaggctcaggagcattatattttgcctccagtctctccctccccctgtctggttagcactatctctggaattttgttactattcatactgacctggaaaatgcttctaagatactttcttactttaattgcttcctttcttaactatgacaaactccctgcttcagaaccttacctggaactttctttggagctaaaagagattcaaatcctttagccagagttctttgttcagcttaaagtgtgactttccctgtcttatatttatcacctttaataccttctcctgtcttgggatccaattcagccttcatctgctctcgtcagaatttcctaaagaatcatctatatttttcttctcacagtaaaaccacattttcctccatacttcctatgttgtgaagtggtttgcaaaatgtatccagaggaacttgggctggaggagaaggagaaggcagtggcaaggagatcccataagcatttcattttaactttgcattttaaaaatcctttcattcccctaagattttttagtgcgttagttcaggacctctgagaagctgacaccaagacgaggtgaaatgtgcaagagctttactgggggacatgcctatgaagggtacagggaggaagcatgagtaagtaaggacggcctcagaccaagaggtaagtctggcacctgtgggaggcagtgtggggaaggctaaaggaaggaacaatgattgggtagcatggtgcagttctaagaaagttttgaaaagaccaatggaaagtcctcaagccaatcacctgccagcaaagtttcacatcaggcaggaatggaccctgtaccactactcccaccaggctcagcattggttggctgggaccatcctggaagaatttggcagcaccgcacatggtgctggatccagaggggtggcatttggggttttgagtcaactgtgctcccctccacaggaaatctgactagcacctttttaggccaccactctcagctgtttgttttcctcctgcagtgtggctgttgccctcagaagagatcagcaacctgtcaagacagtcttactcctactggccattctcccagggccaactaatgctgctttggcagtcaccatgggatcactatagacagtgtggatttccccctcacaagctctgagattaatgacacctgtacatccatgaaattagctccaagactatactgtagccaaggctcaaaatctatttcctattccccatttcaaattatatatagtcatgtttctaaaagacagcataacaggttgtagagatcaaacaacctgattaagatatttaatcgactgtcaacataaagatgccctaagtttgaatacaaactccctaccattttcaaattcctggagagaaatttaagtccaaatattcaatcactttacaaattaaagtccaaagaacataaagtctgcaatcagattctcttatcctagtgagctaaattttaaaaatatatatccacagtttattctctccaatttttgatattgctcagtgccaggtactggggttattgatacataagacgagttaggattgcttgaacagcttcagcctggagtttctatcactcggatggatgtagtcccttcagtgcttcataaattacagctgaagtctgaaagagttcaaaataaatccttaaaaatctcaagattattattggcctggcacttacccaaacgagaaagtgagctagtccccagctactaaagtaattagtctagtgcccagggttactaaaactgtagcagagattgagtgctaagtgagtaaaggagagtagttggagaaaatattggttttagtctttttttcctttgaagacagggtcctactctgtcacccaggatagagtacagtggtgcaatcatggctcactgcaacctcaacctgccaggctcaagcgatcctcgtacctcagcctcccgagtagctgggaccatatgcctataccaccacacccagctaattttttttttttttttaagttttgtagaggcagggtcttcctatgttgcccaggttggtcttgaactcctgggctcaagtgatccacccacctcggcctcccaaagtactgggactacaggcgtgagccactgtgcctggctggttttagtcttccaacaattccagtcaggctatatctgatgcccagaatctatgacctgtgaatataaattcaacggaaagaaatctttccataagaggttaactagaccctatacatttgtatttatgggaaaaagtcatccgtgtaaatggtcaactccagtaaatgttcttgaaaatggtctactccagtaaatgttcttaacctggttattcccctttcaaagcactcatctggaggccaagaatcacatctgtcatgagcaccatggaatccctggcatccagccccatgcctaacataaaggagggacttgataaataattgtttttatgaaaagaacttaagagaagttaattcctcctcatgtcattcaagcttctatatcagcttagttgaagaatagcctggtttatagggtgaactgttaaaactcttttaaaatttacaactgtgcaatgcagggttttcttaatactatgtaacaataacaaaaaaataaatcaagctctgagactagcataactgtgactaacttccataagctttgatttccaaattctatgttaatcactatacccacattattctcattgattgactttacaacaagtaaatatttactgttatgactgtgttttaaaaattataattataacttatatttaccctaataaaataatacatttaacatgcatgattttgttttaaagctaggtttctgctaataaagtttgaaaactactggcttggcgaaagtaaaattggctttgagggtgagaatttgatctggattcagatttctctctgccttaacatattttagactcaggtaactattttgtaaaatgggaatgattatatatacctcaaaatttgtttcaggattgagaaagttcagtaagaaaatcttaaaaggccctggcacagagcaggctctgtgtcttgttttcctcctctcttaacaaatgcctttattcaaaacaatcacagtagattatacaggcctacagacaaaataggcatttagtaaatctgctgattaatttcatttttcaatatttgaagatattttcattaaacaattttaactgtaagtgggttaaacagttttcattattagaattgactactttcttcaaagttttcgtattactttattcatacctgggttccagtacatgcctccccctagaatttcagcacctagagtacaggattatatcctagacttcatctttacagtgaaggccatataattgaacttcgtaaattttgaacaaatactttttttaaaaaaaaatcagaaacctatatataaaactacttatgtaccagcgctttgtaaatattaattcacttaatctttataatcccctgaggttggtacaggttatccgaaatgcttcaatgagcatttcctttaaatatgatgtttgagtgtcaactcagtgctgaaagagttttagattttgaagcattttggattttgaattttcagattagggatgctcaacctgtactgttattatccccatttcctagatgaggaatttgaggtctagaaagtccaagtgacctggccacagttacacgtcttctaagtggtagagtccagcttggagctcatcattgctttgctttaatgtccattctcttgatccttgtaccattctgcctcccattaatgacaatgcttatcatcatcaaaaaggaagctgcggtagcaagctgatgagattggtaataatttagctccagaatttttgtattacagtttctatggtaaccttaactcttccctttcggtatgtgctcattcatacagttgagctcagttagttgcaggtgctattttgctatttcgtctcacaggactactttatccatcaagcactatgagcaaaaggccatgggccttatgaacatgtttgagaatgaaaacaaagtttttactccaaaataagaaagctgcaaaattaaaattaagaaatcccttaatttaatagctacaacatgtaatataatgcccacattattgttaaatgtagttttcatacacatttcaatacacttgcagtctgtaggtttaattgctcacttcattagaattcccaagtaagcaggatcattgcagaataatcataaccagtcatacattatataagatacttatagcaaatattttaaaataaaattataaaaaaattttaaaatattttataataaaatgttatatttaatgtgagtaccttttactctgacatgacatgtagaggatctgatgaaggtcttaaaggccttgttaggacttacttcattttaatccttgacaaactaaccagcaagctgcctacctacttctctgtacacactagctatactgaataaggcaaagaagaaagcatacaccgtcttattgatgagttttataagtaatccactttttaaaagtaatagctatttttcctatccattaccatgcaaattcctgaattatttctaattctcatttttctgatttggtcattttgagatctacttcctacaagaaacagcagagaacagaaaatgtagattccgtgaacacataagacctctcagaacccttcggctgcttgcttgattttgaatattccatgactccttctctgcatggagtacaattctgagcttttaggaggccctagcaaattaccacgacctaggcagctttaaacataacacaaatgtattaccttacagttctggaggtcggaagtctaaaatggatctgcaaagcttcatttttttttctgggggctctgggaaagaatctgtttccttgcctttttccagcttttcgaggctgcctgcattccttagttcatgcccaccttcctgcatcttcaaaactagcaggatctggttggtggatttctcaccctgcacccctctgacctcctcttctgcctccctcttcccctttgaagaatgcttatgatgacattggtcccacccaggttgtccaggataatctctccatctgaaggtccttcgtttaatcacttctgtaaagtccctgttgccatgtagaattccaaggcttagtacatgtgcatccttgaggggccattattttgcctgccacagaggcacaaggcaaaatctagaagaacagatttctcagggcacctaagctgctgcccagcacacactgttagttattctcagaggtatattcggttcatctcactctgctcctgctactggttccctaatgcaccttacattctgcttctaaagttgctgctgcctctcttcctactcattacttttttcttaaacctaataacatggaatatatgattcactacctccctttgattctgttggtaataatgccctgtgcagtagacccttggtgggcagagcagtgtatgtaggcacatgtgcacgtcatgcctgcacacccccatcatttttatttcccatctttacctctgggttttcactactgtttattcagaaaatatacatatattctttagagaattgccacatgcaaggaattcattcaagactttgtgtgaaataataatgtacacagctgtagtgaacttgttttctctctccccctaggcgcaatccccctccccttcctcttcatgcccagtcagttaaaggtaccagaagcaacagtggcgtagacttgtcagactcagacctgccacttagcagctgtgatatcctcctccgcatattccttaatctctgtatgcgtcagtttctttatagattaaatgcaaatagtggcagcttttccacttcagactgcgctcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggttagcttcatggttttttttcttttttccactttgataatgttaaaaaaaaaaaaaaaaaaaaaaaagacgaagtgaggtgggaggacaaatgccagccagtgttagagagagattttctagaactcccaaggagaattatcatgccttgagaaaggggaggacatatactgaatatgtttaaatttagattaaatgtatgtttccttttacaacatacagttaatcagagataactttgtagcgatcagtgattcctagccagaaggctaggaatttggcattattaaatcttatcttccctaaataaagtaaatgggatacccacaaataactgagtcctcattttactcaatgggcattagaagtaactaaataaattgaaagttggctgttactgaggatgttgcaacctgatttggggaggagtggaggaggagaagaccatgagaactctcacctctggacagggcttggcactccggaagagttccactttttatgcacctgatcccttagcaccactaggtggtaagaaagcaactgaaaccaacctgagaagggccattgacattacatcctccccaagtcacctccatatggaggaagaatgactagacccacaggagtgaaagccacaaggtcagaggaaaggggctgctgctaccacattctcagctgcactcttggtcttgataccctttacatagacctcttttacttcttaaatgctgtgtcaagggcactcaatttgactattctgagtggatgaatttttaataagtggtgtttgtcaacacctgtctccccatcggggagaagccttctgggacccaggccatgccctgtcaccctgtcacacctcctgaccactatacatgctgctccagtaactgagccaccccccaccctccttacatgctcatcaggcagtccgtgctcagcagcccatctgtgaagcatttcctagccggctgccacacccaacacaagcaaggaaaggccattcattaatattttatgctaacctttaatgcactatacaggatatatatgtgtgtagaacagaattttcctacagacttctcatgaaaacatttcactcactgggctgggctggtcaccatagaaatcaagttaaatgactacagtgcctgcctgttagaggcatttgaatgtacaccatagcagggacaggggcacacaaagaaatgagagtaaccctctgagaaaaatcctaacttctcatcccgcctgccaatatttttttcctataagatagtaaataactacagcaaaacttctactaaaatgcatgactgacatttcgttttttgctttctagtttgcaagttgttttcatgttcgttatctcagtggatcttggcaacaacccagtgtaaaactcgttgtatttttcattatttatttatttatttattttggaaacagagtctcactttgtcgcccaggctggagtgcaatagtgcgatcttagctccctgcaacctccgcctcccaggttctaacgattctcatggctcagcctttgctgggactacaggcaggcaccaccgtgctcagctaattttttgtatttatagtagatagagggctctgccatgttgcccaggctgttctcaaactcctgagctcaggcaatccaactgcctcagcctcccaaagtgctaggattacagacatgagccaccacgcccggcctaaaacctattttatttatttatttatttattttcaagatggagtttcactcttgttgcccaggctggagggcaatggtgcaatcttggctcactgcaacctccacctcctgtgttcaagcgattctcctgcctcagcctcccgagcagctgggattacaggtgcccaccaccatgcccagctaattttttgtatttttagtaaagataggatttcaccatgttggacaggctggtcccgaactcctcaggtggtccacccacctcagcttcccaaagtgctgggattaaagccgtgagccaccgtgcctggctaaaacccattttatagatcatgaaattgaggcccgatttcatcagttgaggcaattgacttatctaaagttacagagccggtgggcgtggcagtcaggagagaagagtgtggtcatccatctattcatcctccaccaagcccttagcaggcagctgccatgggaagagcacaaggaagagcacaagggagatgctgataaatgaactccactttctcccctcaagccgctgctgccttgcttttcccatgcaccatcccgtgtttctccccgttcctccttgtttcatctgcctattatttcagtaactcattctgtgctcaaaggaagcccccgtatggtgtgcttcctttatgtactatgtttctcaccactacaccatgcgctaacacaagactattcaatgattgaatctcaggcttgtgacttaaacagtttcccacacattgggacatcgggaagcatttggggggaagaactacaggagacagggcagcctagttctagaagtcatcatcaataatgaagatacaacaaggccaccaaagcaagggggaaatccagggaaattttacaaacaaatgataaaccattgattgttgattataggaaaagctcacagaaatcaattaaggaaattaacatatccatacaatgaagggacaaaatatacaaaggagcacttgataaacaaactaatgactaataaaaatgactgtagtctaactagtagtcaataaagtagatattaaaacaataatcttcacctgtcaaattagtgaaatacatatatatatatatatttgtgtgtgtgtgtgtgtgtgtgtgcatatgatgaaacaggcacattttaaaaatactgctggtggaagaacagtgtgataggtctttcagtaaaagtaactggagctatgtatcaagagcttcaaaagagttcatattcaggttcagtaatttcatttttaggaatctaccttaaggaaataattagaaatttggtcaaatactcaaaacagaaatgctcaacacaacatgatttataaaagtagaaaattgacagcttagatgaatggtaaaaaaaaaaaattccatgaattatcacaaagctctgtgctgtatcataataatgcaaagaatatttaaggatgtcacaaaatgtcaaccacaattaattctcctgaaatcttggaagaatgtcatcactcttcatatggtagaaatggtgggtgacaaggggcttcctccacacaaggcagggagggagcatggggctgaggaccagacctggctgccaccacttactaaccgtgtggccatggcaaagttgctagactgcccagagctcccaattccccacagtgtcccttacacctaccttagcagacaaattgtgagataatgtgtatgaaaacgttgatgtggtaaagaagctagggcagctgctgctggtagcatagaatgcaggcactggagagaaaaaactattagtgggatggataacaggctgcaaaagtactttatgaactaaattgcagtatgtgtctaaagtaatattttaactgattacaaattttcattctttttcacatacagaacattcatatccccagctgccctcagtatcttaaacattccaattgcctaattattcagatgtcctccaccaacacagtcctgagtcctttgatcatccccatccacaccagcccccaaaggtggctccaaaaatcacccagacccctgcagggtagccctatgtcaaaggactagctctagggccagaagacctgattcaaagcccagttttgtcacatgccagttgcaaaccccaagccaaagtgcttaactactgtaaagccacagtttcctcaactataaaatggggatagcagcttctacctcatagggatggtgagcttttatttggattatttcatttaatcatctgtgcaatacctggcagagaggaaacagtacatggtaggttttattactactactgcctctaactcatagatggctttcagcttccagttacacaatgctgttcctcccagcactgctcacatgttctagttaaggacaatagaagcagcctccagagtgtaggacaatgtcagcctgtgcagaaagcatagatggagtcacaatgcgtggcccacagcctttggggctatccagactgctcatggatgcccccaaactgtgactggggacatctcaacctaccctgatgtaggttttgggaataggtacaaattgaacatgtggttagcatttgtaacacttcatgaagatattgggaggggtgggtgatatgacctagccctgtgtccccacccaaatttcatcttgaattgtaacacaaattctaatccccacgttttgggggagggacctcatgggaggtgattagatcatggggtagttcccccatgctgttctcatgatagtaagtgagttctcaggagatctgatggttttataaggggttttccctgcttcacttggcacttctctctcctgccaccatgtgaagaagaacgtgtttgcttccccttccaccatgattgtaagtttcttgaagcctccccagccatgtagaactgtgagtcaattaaacctcttttctttgtaatttacccaatctcagatatttcttcatagtggtgtgaaaatgacctaatacaggtggtatatcagggaagacaaaagtcactggggaaggataggatagagaggaagaaatctggtgttgtctattacacctgtggaaatgataggattctgaggtcatgttgaccaaagagcagggatttgggggtatggaataggccaccaattgagtcaaggcagatggagactggtttatgccacatgcgtacccagcttgagtggtcctgccctgagcagtgagcaagtgaccagcaaggacttccaggtgcctggtgtatttctgctggtgaggcagtcccagacctttccttcctgtcacttcattgcctttcagcttatctggacacctacttggtacttccccatgctgaaggctacatcatagtcatcactgtttcttacggttgactggtggagacctttccattttatgtttcttttcccgattgttcaactgttaggaagtgagataagggaaatgagtatgggctttgcagtcagaagaggattcacacttctactgtgccccttcctagttctgtgtccttggcaaagttgtttaatttctctaagcctccatttctaaactatttgtaacaaaaatataaaaatatgacatcacactccactgttgtaaaaatttattgagaaagaaaagtatttggaaaaaaactagaatacaatatatggttagtaagtgatactgtttttctctttggacaaaaaacatttaagagaattactgaaatattattcttgtggcattacgaatatctagtcaaatatgtttgtaaatgtcttgatgatcaaaaatatttgacagttatggctgggtgcggtggctcacacctgtaatcccagcactttgggaggccgaggcaggcggatcacgaagtcaggagatgaagatcatcctggcgaacactgtgaaagcccgtctctactaaaaatacaaaaaaattagccaggcgtggtggcgggcgcctgtagtcccagctactcgggaggctgaggcaggagaatggcatgaacctggggggcggagcttgcagtgagcggagatcgcgccactgcactccagcctaggcaacagagcgagactccatctcaaaaaaaaaaaaaattttttttgacagttacaatgaagccaagtgctaaggatataatgattaaataagacaaagttcttgtcagttggaactttgattctagttgggaaagacatcagataattaacatacataggtatatataaatatatgtattggtatatatatagataagatgcataaactaatgtatgtatagaaaaataatatatccatatgtgcttagctgtgcacttttaaatgaacatcttgccttttgattgattatcttagctggtgataaggacatgtgaatgaaatcccagactccaaagtatcaggttctaaagagattagagtgaggaggtagattttgagctaagaaggatcatgcgttaatgtctaagaatatgcatgctataaattgtgacacctctgaaagtgaagtcagctggctttcctaggccagcaaattgctggtgaccctggagaattgtataaggccacaatttaattgcacaggctttaagagatctgcactcctttatcccattaattcaacctgcaactttgttctctggtcccttttgaatattcagttctcattgatttcaatgggagttacagactcagagaaagggaagaattgggccagtgatctgttcaaagcaaagcatcatttaaagtatagttttaaagtatttgcaggcacataggtgagtcagctccttctcacgaatttgtctagaatgctttccagtttaaatggaccatcttaaagggcagtcaccttccctaaaattgcagcatcatactcatgcaccacatattggattgtgactgctgggaggcaatgactccatgttgtggtctcaactttactgcggaattgcttcagatttaagctatagcctaatcgtaattagcagcccaaagtaacattataaattcctacaatgcctattgggctctgtctgctgttccacacatcaagtcaagtcaatatagccttgccctcagagaccttttgtttgaaatagtctcggtctattggtcatgcaccaacacagaggcaaagaagcaaaatggctgtaaatacaacgcttaaagcaagtgaacttgcacagacagggaacatggtgctatgatttcagctctccctcgcctcatggactatataggttatagcacttggctgcacgataaatttctgtaaagcacatcctatttttgtactcatttccattgtgtaatcccacgtgcattagaattcatgaaagtcttatttgaatatttctttaggagagagatcccgacagtgtagactgccagacatccaactccccaactactctgtgtctgtccagacttctcagtgctgatacaagctgcagccttgggagctcagggccttctgtttactgggagctctttctctgaccaagagaaagttatctgtatcccactttgagatacccagaatccgtgcttccaacacctccctgttccttctgtctgggtatttatattgcttaggaggaccaggctcaggactggccccctgtcaggaactgcctctaggcgtggcgcaaaaaattaagttcccagttttcacttttgcaatacaagtgaagagagctgctatatacagccttacaggtcgtacagtccaaatcagaaatgtggcgacactgccaatgctgaaccttgtcagcgctttgagatggcgtctaactctgactgccactttagtggctgtgctaccttgggcactctctggatcctgactttctccctctctaaaacggggccggctgggagcggtggctcgcgcctgtaatcccagcgctttgggaggctgaggtggatcacgaggtcaggagatcgagaccatcctggctaacacagtgaaaccccgtctctgtgttgtaaaaatacaaaaaattagccgggcatggcggcgggcacctgtagttccagctactcgggaggctgaggcaggagaatggcgtgaacccaggaggcagagcttgcagtgagctgagatcgcaccgctgcactccagcctgggcaacagagcaagactctgtctcaaaaaaaaaaaaaaaagaaaaaaaaaacggggccatgatattcaccttttagagtgatcatgtggactacattagacaaagcgagcaaaacgtctgctcactatgtagtggtttttggttttttgtttgtgttgttttcaacgagagaggttatttaaatggataacatccttaccatggagtaaaagctcatatgtgattaatattttgaaggaaaaattcttgtttacttttctcagatattgaagatattcatgctaaccacattttgttcataataatgctccaaggaaaattttctgcagggcttgattcttactacagtatttcaggccggctcagcactccctcacctggtattttccatgtaaacaagtaacaaaataaataggggcaacaaaagtcactgctattgtaattattaacaagtattctttggttgattggcttttcttatgtaaaattctgtttctaataattgttaaaatagtaaataagaggtcccagaaataagatttgtatcatgtttaaactccatttcaaaatgtttattgccttgctgcaaaataaaaaaaaatctcagatttgtgtgatgtgtcctagcttacagcaatctattttttagtgtctttttttttttttttttttttaagaccaagtcttgctctgtagcccaggctggagtgtattacacgatctcagctcaccgcaacctccgcctcccaggttcaagaggttctcttgcctcagccccccgagtaactgggattacaagcgtgcaccactgtagctggctaattgttttgtatttgtagtagagacggggtttcaccatgttggccgggctggtcttgaactcctgaccaaaggtaatccgcccaccttggcctcgcaaagtcctaggattacaggcatgagccaccgcgtccggcctttttagcgtcttttctttgccttctaagtagttgtacagatctagaagtagtgctagctacattacttgtggaatataaggttaagaaattcccaggaaaagtttaaataatttcaaggcaattatttcagtaactttaaagaaataattagaatttttagaattcaccaataagtgtttatatagtagagatgtagtggggttagggatttgggaatggcaaaaggggataaaacacacagccagaacctcttcagtggtaactgctaaaacagcaataaacaacaaaaccaccagtggtcaaattgtgtagtatgggctttaggtgctaaagaagttcagaaggagagaaattttagtgtagtctttgataatcagagaagtttgctggtgaagctgggtcttgatctaggtctgaagggatgaacagaatttggataggcagaggtaataactgttccttagtgtttaataccgctgatctgcagtgggaatctgcaaattctttcacattataaggatgtaaaatatttccaaataactagcaaacctaagaacttgactgtgaatgcctaagatgattcagcaataaaacttctagacataaataaaacccatctcaaagccctgactcagcaataaaacttcgcagacataaccccataggaagaagaaataccaccactgaggtccacagttccagttgggaaccagcattgccctgagtttgtgcatcagatcttcaaaagataaggggtcaacagattgtgattatgcaaaagaggtgttccaattctactgattgtgattatgcaaaagaggtgttccaattctacttgggcacacaagtaagtaagttaacaagagaacctgaaagttagctaaattggaaagctggctgaaatgctaaataaaacatactcagtaagaaacggcgtgttcactcagcccggaggaagtgcagcagaatggagaatgttttctaatacagctctactcattataatctcagctcagagctcctcagtgataggtacagaaggcatattggaaacttcccacatgtctatttcctactaagtctatcatcaaaaactgcaaaatttaaaaatcacagtgaatgttgactggttttcttcagataaaatgatgatgaaggtattaacattctgtgctatagatgccatactgaatgtgtatatataattaatattatgtatacatatatgtatacatatgtacatatgcatacacatatatatatagtcttagtccatgggctgttacaacaaaaacatcattgggtggcttaaacagcaaacatttatttctcacaattctggaggctgaggcttcgaagatcaaggtgctagaagatttggtgactggtgagggccttcttgctgattcatggatactgtcttctcactgtgttctcacgtggtggaaaggagtgagaaagctctctagaatctcttttataagggcacaaatcctattcatgagggctccaccctcacgacctaatcaccgccaaaaggcaccacctactaatatcatcacattgtgggctaagatttcaacacgtggatttgggggagacatattcactcaataaccctgtaaattgaaatttatagttgttttaagagtctgctcacctgcctgtgtaccccagtatcctcttctcattgaagtccagtctcatccttcctaacaactcaaaatctagactcatggacagcattcttgtcacattattccccactactccatgcccatgttatgttagactcgtggttttgtaaacaaacacattttgaactctctttattttcaccttcacggatatccagcaggtcactctaaactctgccttaccagtttattctgatcttatcaggcacgtgaagttgtggtaaaatgtgttctgtcctcacctctgtcatcattgctgctactcatggaactcagaccaggaaagccagagctagtacaaacacctccaaagaagtagcaaatgactggttgtgggcaagagtaacatgaagactgtaattctgagacactcacccattccctgccagggaataatataattgtttacctgtgttatagacacccagaatctaagagaggcacaagaatccatctagccagatctggcatgagactcatttgctaaaggtccccagggggaatttgtataagaagaggagcccaaaagtgcatggaatagatttaagctgtcccttgaaatgaccttgcctggttaaccaaaatctggattcatttttactgtgtcttttacaacaatcaccttcacagcattagacggaaccattaatgaaagcaggagctcttctagtcagtacacataaaaagaagtcgtttaaacccagtattacgtagatattaacactaaaattgcaaaaaacagtttttaagagaaagaagaagttaagaagtatcaaaatatcagcacttatttctataactaatgtatatatagaagacatttaaatggaaattatctgtgaactaaaatgagaagttagaaatagtacaataacagaaatggttattgaaatcatctgaaatttccttcccttctacagtatcaaataatgatatgacagtctaagttgctcacagaataagatagcattaggaagattttagaagacatttttggagtttcacgaaaggaggtccctgaagaatagaagatggtttagataatgctattatttaatcaaaaatgtcaaataccagcaatcacaccacctgcttttgaaagtaaaggaagctagggactaaaaggggtggtttaaaaagagacagaggaagaataaatgacaaaaagagaaaaaaataattatagatagtctaaaggatatggatataggttgtatttaagcagtgtttttttgtctcagaagtttatatgtgaactaaaatgtattaaaggataaaaaagcaatatgtacaactttttgtatgtcagtcatgcctctataaagcagttttcttaaaaagataaagaagaaaactctaggaattagcaccttttttaaaggatgagaaaagagagtccagttacaataactgttaaggttcttaaattcttttacacctcttacccccatatttctggttttcactgtatgatagtttgataatacagcccaaatttaccttttagctgtagctcttcttctttgttagggcttgattcttaaggagattgctcaggtgttgagaacaagtagtagagacacctaagtatacccagtattaatcccagaagaaataccatgttagtcactttcacttcatgcagtagctaatctttttttaaaattgtgttagcgtaaagtgttggtgaacccactcatttttacatgggattatcccaatttacataacctttttgtaacaccacattttcaagtgttggaaaataaaaacagattaacttaatattgtgactaatcgagagttaaccaaaaataattgtatttcaaacctatgactgaaaatgtttcttaaacattagtcagcttccctgccttagggattgttgactcacctccagttgtagggtgaaggatagctcagccattgagactgctgccagcctcgtcacccagggctgtaggtcaaggaggtgccagaccagggcctgaaactactctgaaccctgcccccacgttcactggttttcagcactaagatttgcttgaagtgaagaaattgtctagatgcgtatggacagtttgacattgtctgagtaagggaaaatatttttattttaatacttgtcttttaggaaaactatcatttgtcaacagggatctgtatgttttaataaagcagaggaagggtggtttgcatgtagtcacttagctaaaatttcatgtcatttaaattttctgatcatgagtaacccagaaaaattaaatatacttaagataaaataataaaatcctttcatatatataaataagcaaccaggatagttttcattctatctatctagctagctatttatttattatgttttaatttctttttttacagacaggtttttgctctgtcacccaggatagagtgcagtggtgcagtcataagctcactgcagcctcaaactctgggctcaagtgatcctctcaccttggactcccaaagtgttgggattacaggcatgaatcactgtactcagcctgggaagcgtgggatagttttcgttttcaaaagtcagttaagattatctttagcagaaatactccatcagtgctgacttttccaatctgacatatgtagtagcgtaagaacatgttttaaattttaaaaactaataagaaaataagtaaggcaagttcttcatataacaacaatgtatagaggaaagagcaatatgttaagaggagaagaaataaatttatttctatagaaacaaagacccagtgggatcaaaagaatttagaatttttaacacaaggaaaatacccatgcatggtgaggtagtagatggcttattctcttcctattcctaagatatcagtgttactttagcccaccgtaaaggaatatgaataatttccatgaatcaacgtaatgtatgcatctcaaaaagatttttaatttttaaaagattattctgtagtctcttacagtattttcttgtccaagccttagctgaaggattgcagtgtttctaatgatagtgaagtggctctaatgaggtggtctcctgatttaaattattgtatcaacatcttcatgtaacccagtaacaaaatatatgtacatacacatatatacacaaaacatgtatgtatatatgtatgtagtagatcaaaaattagaattctatttttcttaaattttactttaagttctgggacacaggtatagaatgtacaggtttattacatagatatacctgtgccatggtggtttgctgcacctattgacccatctctaagttccctcccttcgcgcccaacccctcacaacaggccctggtgtgtgttgttccccactttgtgtccatgtgttctcactgttcaactcccacttatgggtgggaacatgtgtcgtttggttttctgttcctgtgttagtttgctgaggatgatggcttccacctccatccatgtccctgcaaaggacatgatctcgtttttatggctgtgtagtattccatggtgtatatgtaccacattttctttatccggtctatcattaataggcatttgggttggttccatgactttgctgttgtaaatagtgccacaataaacatacatgtgcatgtgtctttatagtagaatgatatatattactttgggtatatacccagtaatgggattgttgggtcaaatggcatatctggttctagatccttgaggaatcgcctactgtcttccacaatggttgaactaatgtacattcccaccaacagtgtaaaagcgttcctgtttctccacagcctcaccagcatctattgtttcttgactttttaacaatcaccattctgactggtgtgaggtggtatctcattgtggttttgatttgcatttctttaatgatcagtgatgttgagcttttttcacatatttgttggctgtgcaaatgtcttcttttgagaagtgtttgttcatacactttgccacttttttatggggttgtttttttcttgtaaatttgcttaagttccttgtaaaatctggatattagacctttgtcagatgggtagattgcaaaacatttctcccattctgtaggttgactgttcaccctgatgatagtttcttttgctgtgcagaagctctttagtttaataagatcccatttgtcaattttggcttttgttacaattgcttttgacatttctgtcatgaagttttttcccatgcctatgacctgaatgttattgcctaggttttctagggtttttttaatggattggggttttacatttaactttttaatcattcttgaattaatttttgtataaggtgtaaggaaggggtcctgtttcagttttctgcatatggctaaccagtttttccagcaccatttattgaataggagagcctttccccattgcctgtttttgtcaggtttgtggcagatcagatggttgtagatgtgtggcgttatttctgaggtctctgttctgttctattggtctatatgtctattttggtaccagtaccatgctgttttgattactgtagccttgtaagatagtttgaagtcaggtagtctgatgcctccagcgttgttctttttgcttaggattgtcttggctctacagggtcttctttgattccatgtgaaatctaaagtagttttttctaattctgtgaaaatgtcaatggtagtttgatggaatagcgttggatctataaattactttgggcagtatggccattttcacgatattgattcttcctatccatgaacatggaatgtttttccatttgtttatgtcctctcttatttccttgagcagtggtttgtacttccccttgaagagatccctcacatcccttgttagctgtattcctaggtgtttgattctctttgtagcaattgtgaatgggagtacattcatgatttggccccctgcttgtctgttgttggtgtaaaggaatgcttgtgatttttgcacatttattttgtatgctgagactttgctgaagttgcttatcagtttaagacgttttggggctgagatgatggggctttctaaatataaaatcatgtcctctgcaaacagagacaattttacttcctctcttcctatttgaataccctttatttctttctcttgcctgattgccctggccagaacttccaatactatgttgcataagaatggtgagagagggcaaaatataaagaccaatgacactatgaagaaactgaatcaactagtgtgcaaaataaccagatagcatcaggatgacaggatcaggttcacacataacaatactaaccttaaatgtaaatgggctaaatgccccaattaaaagacacagactggtaaattggataaagagtcaagaaccatcagcgtgctgtattcaggagacccatctcatgtgcaaagacacacataggctcaaaataaagtcatgcaggaaaatttaccaagcacatggaaagaaagaaaaaaaaaagcaggggttgcaatcctagtatctgacgaaacagactttaaaccaacaatgatcaaaaaagacaaagaagggcattacataacggtagagggaacaattcaacaagaagagctaactattctaagtatacacgcacccaatacaggagcagccagattcataaaacaagctctcagaaacctataaagagacttagactcccacacaataatagtaggagattttaacacactttcaatattagacggatcaatgagacagaaaattagcaaggatattcaggacctgaattcagctctggatcatgtggacctaatagacatctacagaactctccaccccaaatcaacagaatatacattcttctcagtgccacatggcacttattctaaaattgaccacataattggaagtaaaacactcttcagaaaatgcaaaagaactaaaatcataacagtctctcagaccatagtgcaatcaaattagaactcaggattaagaaatccactcaaaactgcacaactacatggaaactaaacaacctgctcctgaatgactgctgggtaaataatgaaattaaggcagaaatcaagaagttctttgaaaccaatgagaacaaagagacatcataccagaatctctgagacacagctaaagtggtgttaacagagaaattcatagcactaaatgcccacatcagaaagctagaaagacctcaaatcggacaccctaatatcacaattaaaagagctagagaggcaagagcaaactaatccaaaagctagcaaaagacaagaaataactaagatcagagcagaattgaaggagatagagacacaaaaaaaaccctccaaaaaatcaatgaatctaggtgctggttttttgaaaaaattaacaaaatagatagaccataactaaaccaataaacaagaaaagagagaagaatctaatagacacaataaaaatgataaagggaatatcaccactgacctcacagacatacaaactaccatcagagaatactataaacacctctatgcaaataaactagaaaatctagaagaaatggataaattcctggacacatacaccttcccaagactaaaccaggaagaagttgaatccctgaatagaccaataacaagttctgaaattgaggcagtaattaatagcctaccaaccaaaaaaaagtctaggaccagaaggattcacagccaaattctaccagaggtacaaagagggtttcagaagataccattccttctgaaactattccaaacaatcgaaaaggagggactcttccctaactcattttatgaagccagcatcatcctgataccaaagtcagacagagacacaacaaaaaaagaaaaatttaggccaatatcactgatgaacatcgatgcaaaaatccttaataaaatactggcacaccaaatccagcagcacatcagaaaaggtatccaccacgatcaagtcagcttcatccctgggatgcaagctggttcaacatacacaaatcaataaatataatccatcacataaacagaactaaagacaaaaaccacatgattatctcaatagatgcagaaaaggcctttgataaaattcaacatcccttcatgttaaaagctctcaggtattgatggaacatatctcaaaatcatgagagctatttatgacaaatccacagccaatatcatattgaatgggcaaaacctggaagcattccctttgaaaactggtagaattctatttcattcaaaaatgattaataatgtttgaacatttgctaagaatactgtgattactgttgctttcagtaacttcctttgaattttcttcataataccaaaagattaaattttaaaaaaccattagaagagaacatgggagaatcttgctatgatctaagagtagggaagtcctttccaaacaccatataaacattaagatgatctttagcttcaactatatataaaagcaaaagtttgaagcttaataaataagcatgaaatgacaactagcaaataagagaaatatttgcaatacagtatattactgttaaatgcttctttatccaaaccttttcacagagatacaaacttgtaaatgtgtttgacaatattttattgacttgtcaagagaatcagtgcacagtgtaggtgttgggaatcgttttagtgctgttttcatgctatttgttaaaaaacctaaattttcatgttatgatttagcataatctctgagctcaaactgtgctctcaaaaccttagggacaggaagtagtatggttcaggaagaaccaaagtaatttcaaagccaaactagtcagtacttgaaaaagtctaatttttgtggtggtttccaatggagaaaatgaaaataatccctcttcagaatttggctctatggactgtttgggagactgaattgctcttttcccatttgttaaaccaggaaatttctaaggctccttccagctctccaattctctagtgctatgaatatcctcattattatcattacatctcattttgcttaaagaatgctaaatcagtagtctcgtatcttacatctatctttgtgagaaagagtaaagaaaactgagtttggtttctttatgattaatgcatttgtcaaatttgttccaagtagcaaattaatttattgtgttttttcatgaatgcaaattaaagctgtgcaaactattgtggtaaaacttagcagtccttttttataaattaaagctaactgatttaatgttaatgaaaggaactatattcaaacacagattttaataacttgggtggaaagaaaatcttagacttcataagcttttccttacataaaattcatgtaatttgaacagaaagtcattaaaatgtaattgtctatagtgaagcttgtattaattaccttgtatgaaaatctgaaaagttcctgaataaatgtctgtttctatgcattccctgaagagaagaattgtctattgattagttaattatctcaaaccaagggtcccaggttcagtttttggtgatcactttcttatctttttcctgtttgaatattctgatcaaaaccagaagtaaaacagattttttttaaatagagaagtattttgcttctgttcatattgataatacaaagagtaccagtatacatatgataaaatatttttcaacttcttggttcataggacttaatcagtgtttcatgtatctgtgtttgtgggtgtgaaaagcacctttattactgggaataagattttaagaatgattttagaaacatgtcctttaaatttgattctctcatacttttaagattatttaaattcacttcaatgtgattgtccaaaacaaagttattttcaaactcactgaatccttatgttcttctttagtgttcactattcacaaagcccattttgaatactgatcctgaaaaacatgagagaatcaaaatctgtgttttcttttgatttttgcatcataattgcatttttactcatttcaacaaggggaaatttcaactttttatattgactaaataaacaaagtgtaggggctaatttatgtttttaaaaaggaaaaatttatagatgctatgtttgattacacttatttcttaactggtatttaggaatttgtgtaataataaacacttctcatttttaacatcaaaatttgcaaggttcatcaaattctgaaggtaatgcctgattggagttaatgttcacttaattctgggtctaatcatttcagctgaaaaagagaaaactaaagcataaatcctttgactcatcctatcttatatttatgtcatattaaaagtcataaaaatggacaaaacaataaaatttaaactgaaacatatccaaaatgtttttggcttatctacctacaaaccagagacatgccaggtatgaaggaacccaaggctggagtaggtcagagggtccaatgagtttatccatcctccagacatggtcactttcagattgtactttaagaaaaaataacttcacggaggaccattataatttttgtgatgaacatgtgtaatatttttgcacccactttttagtttttatcttggctgccttaacatcttctttcaaaatgtcagcagtgattaggctacattatgggataattagtatgaacttttatctcaaagctaattttgactaatactagaacaaaacatatgtcaatatgttaaagatgggaagttgaacagattgctttcctatataaacatgtttttttctaagttcaccttactttttaaatactaatccaatctaaatgtttgaggaaggttaagcaacctgtgaaagaagcaccatttgaaatttgatggtgcagttcctaaaatctttccaaagaatgtggtatagatgcttacatattaaaatattgaccttctaggaagtttaggaaatatttcctctgaacttgaactctggggctgtagctatggttgataagctacacccaattcacactttaatgccggtgctttgtattttaacattatcttaatgtgacattgtatgccttgtttatttcttctaagcaggccttttcccaaattacttaaaattaccaaacaatgtgtttttaaccacagtcattctagagatttatttggtttttttccttccccagaagttgcttctgtcatgtttgattgcacatctgaatacagaccatgctcagagttgtagtgtaaacctcttcaggtcggatcataagcctcagaacgtgtcatacatcccataaacttcagaactagccatacacaagcttcagaactagtcatacatcccatgaagggcatcataactgatactgatctgaacagttcagtccaacagccaggcaattcagccacctacaattcaactattggttttatttgaatgaaaatcaaatttggggtataattggcttagctaaaatattcaactgggtcaattttggtcacatgagtgattctgcacaaagatatagccacattttatctcaggcatctcactcaacatttttaaagataacattttttaaaatctcgtacaaagactgcagtaaatatacaactaagagtcatactggtggatggtaaacatctgggcatgagcattatgagttaatgtgtttttgtacactgactttccatctttgcagattattctaactctctagaaataatgggtagccctttggcactgaggctcactggctcagggtcagtatttttacttctccatcttctctcagttagcacttgaacaaacaaagaaaaacaactggtctgctatttccaactcctgaaagtgaaatagggaaatagggacaaaatataattaattaaaatatgcagttattcatacaggatttgcttttgttctgataattaggatcccaatttgtcaaatgctttaaaaacatagtcttacagccttttactaagggagcgggaaggggtgaatatccaggttgattataagccatatatttgtcttttcaagatttgcttttacattgctttagggaaaatgataaatatatttgcaaataaaaattgtaatctgtatttctccaattttagtaatcccaaattactaaactaagtaatttaatttaggatttcggattaagagactacgaaactaaatctgattaaattatactttttgaaacctgatagtaccgtacttctgctgcactgcactttcttagatttaatgcctctaaagtataatgatattataagtttcttttctttatttaaaaataaaatgattactctaattatgggaactcatgtaccattgggctgaaagtcagagacagctggatggtgaactggccccttgcccagacctcagaggaagattaatttgaaaactctttacagaacacagcccagagcctactgctcagaagatcttgctttaatcagccattgatcatcagagattccctttattgacctgaaagcaagtttttttcatcttcatgccagctaaggcacttactgaaagtaagtagacagcatccaaagtgaatatgcctaacgaagaaaacaaagttttccatctctccccgcaaatgacattctgtaatgacatgtgctaatagtttctatctccatccatcccttaacccatcacgttgccatcctgtgaggaacctgtggttaacaaggggccccttctgcagatacacacgtcaaatgatctaggaaacatgtcggcagggattgtggaaccggtctatgagaattctctttgtatctgaaaaataccatggagtggatgcagggcagtgtttacccccctggatataacatcagaaaattccagatcactctgaagtctgttctctctctgatttacctgcctgtggagtttgaaaggtccccactagtgctgactctttctgacacttctcaatctatagtagcttggaggccactttgattgctcccaaaggcaaaatggggcaccatgatacttttttcactcaaaagggccagcatttatgggatatactcagtcagattctcaaaattgcttcagagaatcctctgttagattaaaggaggtcatttaatcaaacgactttccaaaagtccctgttttgaattactggagagaatgtgtactatcagggtcctggatcacttagcaaacatcagaggaaaggtttcaagtctgttttgagaaatgtactgtccaactctactgctttttccttcagcaaaggagatttatcaaggataaatttggttacagacatacctgttttcgttaaaatgcctttggccattacattatctgtaataactttcagtaaggtctaagcaatttagaataatattaatagaaaaaaatcatgattctctacaccattttcccttccattttatctaaatggctagaagtgagtgtttgcataattttttctagtgtttttctcccattttgccatgatctagttttatatggaagtcataaatttgttctaccaatggagtttgttaaaacaatattttgactttgcagagatcattgtatattttctatttattttaatgccaaacttttaaaaatattgactgctaggaacttaagagagcagaaatatcactttgaaaaatacaaaaattcatttttttctagttgatagcttgtcttttaatattcattgtggtatatctgtgctatgtaatattataagccttgtatctgtctcctatactttcctataccctcacataaatactatggaaaattattatgtgcatcactacccaacactttagccttgacttaaaacggtaagataatttcttgtaaacaggtatctgagctttaaaaaacaaacaaaaacacattcctgttagctctaactttgctcagatcccttgagagagatcagaactcatatgaaaggtgaacagattcttccctttggcaagcaattccttcaggaactgagttatgcttatggtgggacttccaattagaaaagtaaattttaaaacaaacaaacaaccaggctgttcagagattgctagacacaagatcaagtcccagccaggtgtttgacattgcccagtctctttactcttgtaatgtgaaacttagagtcagcttcttcactagtgtttttggcatcatagaaaccacacacctaaccataaatacaaaccatagctggtactaccagtgcagttctcactcttgtagaagcatgtccagtccttctcaagtcatcaactaacaagaccaaatgcacatttctagcaagggagtccttgagcccatccagtcccctgacttcacagcgatgctgtggcagcccactctgctgccgcccacaagcacacatggaggggaagccagcagggatgtccaggtctttgcccatggcctgatgaagaaaggcagctgcagtcatgaattcatagaaccagaagtgacattagcagccacctactccaactgctttccaagagaaatttctcaagagacatgctgaatttcaagtcaagaacaacttggaagccacaaactcagctggcttacagttgccatggaattttgggacttttgctgcaaacagaaacaggatccacaggttataactagctactgaccagtgttacagagcctgtggacaatctcattcctggtttctcctacctctcttcattttcctgtgttccccaccatcagccctcctctgggtcttctccctttcttactctgttctttttaccagggaagcctcatccactctaatggcagagtgctagttttccaccgaagatttgcacacacaccccagccccagctgagtagtggagaggtgttgcccggcagctgtacttgctaatggcatgggaacaaagtgttttagagtggaggtaccttttccacctgctcatcttctgcctaccatctagatgccaatgctcaaggcaatggtggatgccctggattgaagatgacagaagtgtcatcggtctgaggccctaaataatgccatagaccagagctaagctgtgttcctctccatccccttccagacagcctgccaccaatcaggaacactttacatagtgagaaacaaacttcgattttgttaaacccttgagatttcaggctttaactattgcaacagctaacattccccacctatataattataaaatcttcagattccatctatgctaattactcccaattctgcatctctggcatagactttattcctgagtttcacaactgcatatccaagtagacaggtccactataatgacctgcaggtcaccaaattcactatgtctgaagccagacaaatgatccactgctttcccacacaccctggccattcctgttccatcatatgcttgtgaataccaattgtatgcacccaggtactcaagagtgccctattttatctcccatactactctctcctaaatatctatcctgtccatcccgtttatctctccttattgccacattcttatctggtttcaataatagtagcctcaccccctactccagtctgtcctccatgctacactagaggtgtctctttgaaataaaaatctgattatgcctctctactccttaaaatccttccatggctctttctgccttgcagattaaaaatcaaagtcctagtgtaacacctaaggccactttatggaccctttgctgctgacctcctgtattctctcttaccattctcccattgttccatttacaatgtatgtcctgaagtttctcaaatatcccttccctccatgctgctgattttgtagtttccagtatccagaacacaccacacccctcctgccagtgtacttcttcctcttcatcattcaaatctcagttcagagatcatctctcttgggaatcttcaacctccacattccccttagagatcacgcctctatctttcttttcctcatggcttctgcctgcttcatagagttggcatctgcacaattgttagcaaatctaggagctcttgaatctttgccctagtttgatgttctttgagaacagccagctacaacactgcctgcaacatgccctcaatacatgtttctcaatttaacctgtattgtcatccactcctaactgcatatcctgataaaatgatgcatatgtagagctgagggtaatgcctggcttattgtaagcattcagttgatgttaacagaatcaatcatagtttttttgtattattatcattattgcttttattactatcagcaattactcaatatttttgaccatagctgatttcacatctctactaagttttgtttttctttttcttctggttcacaatcatatgggagacatttgcaccaaagtagcggcttccttcttatggctgcaaatgagcggagtgaaggtcaagggatctggagtcgtgggttcaggtgccaccactgtcaccagctgtgtgggcataaactagtcatttaaccgctccgtgcctcattttggccatctgtgacatcaggacaaaaatagcttcctgacccacttcaacagaatagttttgagaaacaacctagataatgaatgtaaaagcattttgtaactctgaaaatgataaaagtcaattattagtagtatttccaatgacataggcaatattagtataaacaatgctttctctgttgaatattgtcattcctctattttgccattatcactttcggttatttttgcatttcctagtgagtggacaacacatgtaagtcatgtgtttcctcatgggcaaattctcaatttcatcatcccaggcatcacataaattctgctttgaggactgcacacagaatcccctcactgatgatgttgctctaaattgacattgtctgtttgtctttgaatctatctttctaataattgtttccttacacggcatttcaacccatggtagacatactgatttttgcatgaatgaatgcttttgcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgttgcgtgaggtgtctgtggtgctggagtaggataacattttctataacttgagcagtgtgtctctaaatgaaattgtaaaatattatgatatgttaaaggccaggcaaaattttataaccagaatacaatgatcatttgcactgaaacattggcatctgtagttgtcactggtttttagtaggtgaggggaaatatctcttcaaatgatcagacaagtatgactagtgcatttgtcattccagtgtcttcggcacttgaagtttttccatttttgttcaacaatgtaacctttggagttttgcctaataatgacttcacttgtgctggccttccaacagataaattaaaatggaaatgcatattttctaattatgcatcgagccttagttgcatattggcgagggtggccacaccgaatgttaaattaagtctgcacaatagttagagtctatgtaacatcaaagtttcccaaagtcactttcttaatcatgtgaaggatagccaagactttgatcagtagtatgtagctatatacgatcagaggaaaaacatttaaacatcccagcatggtatttccatttaaatctgattacagtgaaataaaactgtagccattaaaggtttaaaagaactacaaatacagcagtaaaagaagacagatagtaaatgaggtagtaaaacatttcggcagggcaaacagtttacagcactcattcagtcgtcctgaagcagactgtgcaattcactacagacctggcaccgttccctgaactccacttaaacctacaattaacctttcacacctaatgaagctgttttcctggaaaattaaaatatataatggtgcctgcttttacacagacttcagaggagagcatttcaaagtgaatgacttttctgaggcttttgttcaaatgtaaaatggaagtgctatgtttgtatataaagcgggaatgttctttccaaggcaatttcatttgatgtgcagtattttattactgtacttattaattgttctgcataattgtaaaaaacacacatcagtaattttatgattagattgttactgctgaagtctgctattaccatttcacttccattagggaaaactagagttttgctaacaataactaaattcctgatgtttctccttggtggttttcattgcaaatttagtggtttaaaaagacatgtttaccatttaattatttagctgttatttacattgctgtctcttcaggtcatgttttcacatgtttcaagagaaataaaattcttaaatttcaggaggcatatattgtttttttctaaggttgcaggtgaaggtctgattttggtgtatgttctacttatttacaaaatagctgtggggtactcccacattcatttcagcattattcacaatagtcaagatatagaagcagctatgtgtccatcaacggataaagggaaaaatcaataaagagaatgtggtctttataaacaatggaatattatacagccttaaaaagaaggaaattcagtcatttgcaacacatgaatggaactggagcatattatgttaagtgaaataagccaggcacagaaagacaaatactgtatgacttcacttatatgtagaatctaaaaaaggtgatctcagaaattgagagttgaaagctgattaccagaggctaggggaagggggagggatggggaaagggaaggttttgatctaagggtacaaagtttcagttagactggaggaataagttttaatgatctattgcactacatggtgaccacagttaataataatgtattatatatttcaaaacaactaaaagaatagatttttaacattctcaccacaaaaaaagatggtaagttggagaggtgatggatatgttaattagcttgattgactctttccacaatgtatacataggtcaaaacaccacattgtatctcataaatatccacagttatttgtcaattaaaaataagctttaaaaatagctgtggtaactcttggcctccagcccagggaccactgagtcgtgcccattttctgagggaatttcctatggtctcaaaggagcctgtttcctttagggcttgtcctgccctaggtgaaccagagcagccactgggcctgctctctgttagcaaggaccagtttgaaaacaccaagagaccatggaaaattgaacaggaaacagaggatggtatgttccttcctatgcggtttatacttcctatttaaataatctaaatgtcatagtgtctggtgtttaagaactaaaagtacaaaaaggtaaagcttataataactattgaaaccccagcatttttgttgaatctactggtatatttttatgtaaatcctgctagcctgcagcatctgtgcatcatctttacgtggtaaatgaaattcctttggaccatcagtctaaaataatgaattgttcccccagttaattgtattgctttgataacaaggaactatgctaggcctagagaacacaataagtgaatttcatcagatgatttgtgtgacgtcttgaaaaatgatcttctggagtgacctgattttaatggaactctagcggcgtgcagcatgggcccagcatccaactaggaggaagcacttcctcctatggcacaagaagtgcgggatcatccccagaagacctctcaccaggaaaaattctcaggaaagtcatgagaaagtgtgtgccaaaaatggcaacacaaagaacctatttctaggttgcttttcttttattgatacataccttttttaaaacccagaaaagatcgcaaacgacctttatgtctttgttgccagcgtgaaaataaaccaagaccaagcaaatgaaaataagcaaaagctatgtattctgagcttgctatagcaagggagtcagccactttcacttgtgttttggcggagactcaaggacaggcaggaatgggaaatctttatagtgaaaaaagggaagcttcaggtgtgccctgatgagaggccgttagcttgtgggagctgtagacagactaactagaagtggggcatcctatgtggttaggggtacatatttggtttcctctggctggaagtgaggacataaattagggaagctgtttattaatcaagtcctggccatttggggccagtcgtgacagggattacagtttaacttcatgggttattagtagagatagcagtctgacttcttacaagtctgacatagcaggctggcttcctgggctggttattgcagattatagctcggtttcctgagcacgttgccacaagttgtgggtcagaattctatttatacatggtctgggcattatctacatgttcagtatcttaccagaatataactgctacatttaggggacgggggaggtaatacagtctttttaaaaaagctattgacttggcttctcttttcatcagttaagaaaattagattccttacaataacaaagtgtgctgaaaggcaatgacagagattactctctctctctctctctctctctcttctctctctctctcttttagtgagtcttccatacacactatcgaattcaataagataggggctttgtctctttttttcattcttgtatctaggttctcttgtaggttgaaagagaacgtagcaacttctgatgtttttaaggttcaccttatatttaacatgaagaaatgcaaaagtagtaataacttgatatttaaggcacacacacatataaatgcagttattatgattattatcctgttcataattaaactacaaggtttataaagaagaataactcatgatgggccacaagccgtggggtccagtaaaggacctaagccaaatgaaacattgtttggcccatcaaatgggcagataagactttgggcaaatggccctgagtgttctctgtgagtgcaccacggcgaacacttaaatatctctgcctagagaagtgcaagcctttctacatacacattgccatttatgcagatctgaaaatgcagttgattgttacattttaataagaaatgacaaaaagctgtcaaattaaaaataagcatgatttgcaattttatttgtaaattaagaactgaaatatttatgattttcaactgaatgtgtttccaagtttcagaatcattagtaaacccaggacatgttgtcagagacattgcttcagttaggttctggacttcatgaaatacagcgatacagtggcagttttggattagcgtagaatttcctgttttggcaactcaagctgcttactcctctcccgatgctatatcttctgtaatgaaaacatttgcattcacatgtaaatggaaagtattattttttcagagcttctttggactacatcatgcagtagtttaatgaataacatgatttcatatttggatgttgtgatcattgaaattagtgtaagtggtctctgtccacattaaaggagacatgtattatttgtcatatttggctgtctctggattagttggtgccaggaataaaatagcaggaagttgtaaataatgacagaagtatgccagaagatcagtggaaacttacagtcagcttgaacttttagttagcaccaccaaaatctgcaattttaaaaataataacaaggtccttcagctccattaattaaacaaataatgaaataattatttactactgcagaataagtgtttaaaacatctatgttggactcttcagaagttcccacgtgctcttcaaaggtcaagaaaacagcttttatgtaaactttgaacttgtaataactctaaaacattcaggatgatatttaatatcctgaaagagcaaattacttaagagcaacccttaaaaggtaaatctgtaaatttatcagcttagccagagcttattataattttgtaatttctttccttgctaacaccataaatttctccttctccacaaatctcttctgttttcaaatgtatccaaggctcccttttcctttaaataatgcacttacataattccatgcatccacataaattccatctgaccctgctaattctgttatgtagataagcttccttatctcttcccattgctaaacatcttaaacatggaacttatgtctgctggccgtacttcctgtcactccattcgttgtttaactttcaggcttccatcctcagttagataccgaaatgactcaaagatcatcagaatcttcttggaggaagtctaatggcctttgccacaggccttaccctgctggcccatttgccactttttacagactccttgggcttggccctcccttgactcccgcaacactgcactaggctagtttgctttcctcttacagtgctcacatccctttactgtcatttctttctgtccataaatctctgaattcagttcctgccaggaaatatgtgaagcttacccagaattaactgacccacaggaataaaataatgatattctacgtaggataagatctgaaaatgatcttcctctaagagcaacatgtggagaagaggtcagctcaattcaaagtcaagtcttcaagaccttgtagaaaggaaaatgagccaaaagtccttttgtggccttttcttaagcaaggccaatctggcctcatggtttagtatggtgatttgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaaaagaaaaaaagagatggaggtacgttaaatacatatttctaagtgaaaggagaccgtctgaaaggctacgtactgtgtgattccaaccatacaacattctggaaaaggctgaactacagagacattaaagaaagatcagtggttgccagagacttggggaaagggggatagattggtgaagtgcgggggtattttagggcagtgaaactattttgtatgatactgtaatggtggataccctgcattatgcatttgtcaaaaccaatggaactatgcaacagaaaaagtaaaccctaatgtaaattatggacttcagttggtaattttatctcaatattggttcaatttttctgtaaatctaaaactgcttgaaatgtttttaaaaatcttaacatgactagttttgttcctaaaaaaaaaaaaaaaaaatagtaacatttaaaatttctagtacctccacagcaaactcgtgttcagacatggagaggaaggtttagggtcatatgcacaactaaatgtgatcatttgtcaaacactgatttgattgttccaagtcagagtcagttaactttcttagatctttcttcttcttccttggtgaagttcacatgcccaagtcaagaaacattttaggtaaagggcaaactacttgaaaacttccattaacagccaaacgtgtgatgactaaatgaaaagcaataaaaagcagggcccttcaccaccactgttgccatcccagaaatgtctaagcaagcatttaaatgcttttctctttccttccaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttcc

SEQ ID NO: 37936 - DNA, 26033 bp, Homo sapiens; identical to SEQ ID NO: 35695

SEQ ID NO: 37937 - DNA, 73803 bp, Homo sapiens
ccacacaggataaaggagggaagggaaggagcagatcttttcggtaggaagacagattttgttgtcaggttcctgggagtgcaagagcaagtcaaaggagagagagaggagagaggaaaagccagagggagagagggggagaggggatctgttgcaggcaggggaaggcgtgacctgaatggagaatgccagccaattccagagacacacagggacctcagaacaaagataaggcatcacggacaccacaccgggcacgagctcacaggcaagtcaagctgggaggaccaaggccgggcagccgggagcacccaaggcaggaaaatgaggtacgtgccaggggaggagagggcacggttcccttttggggaccagtgtcaaatagcagggaaggtctgaccttgtcactgacagactcacctgcgtgtcctgcatgtggtagtgaggggctttctcatcaattcttagggctctgagaagggagctgtgggtgggctgggtgccttccccaggactccaggagacataaaacttgaaacgggagacttcgtgcaaatcctgctccggacgctgctgaagctcagatttctcccactgcctgcacagggtgctgcctgctggcgaatgtgactctcctcctgttcacccacaaggctgatttttccgtgttcctcctctggaaagagcattgctttctctcttccagcactttgtgagttagatatgtgtttgtgtgttcattccttctgaccagaaaagaaaccagcttcccatagcttggctctgtggtttcttcaacctttacaagtttgccagttaaacctcaatttagaaaactaaaaatctgtccccattttacagttccctataaattttctgcatttctcattgaaatcagaggcagctggtggcatgaatcaggctatgaagtacaccaaatggctcttaaagagatatcatacttaaaaaaaaaaaaaggattttagagttctgaaatcaagaacttcaaattctaattggttttaaactctttaacctttcttattcctcattatacttgacactccttaccagacctttcatacaagttctatcctgcaagtctgaaaacccaaccaccctagttatttttattagttaagtgttaatgctgttacacacacacacacacacacacacacacacaatgctctgcagatgtgtaagtccctaaacacatcttttactattaattttcttttcacttgggaaagtgtttttatttgtttctcttctgcaaagtaacctagcaacttttctggacctgagaccaatgagaggcttcagactatgttaactctttgaactccgattacctgtggttcagagagataaccaggtccttaaaaagtgagtgcaataattctgttcttcttaaagccatagtaattttaaacctgccattaaacatcatttttctttctccaaaaaaaagtgatttatgtcaatctacattgaatgataatctcatttatctgtcaatgatctggtctgaatcccaccctaccattcagtgccccagcccatatcaaactacttggctgagtaacaattctgtatctttgcatatgctcatccctcaacctggagcaaccttcttctttattttccacctagaagacctgattgttcaagctggcacaaatatctctttctctctcctgaccaccatattccagagtgagcatcccctcctttgtcctttgttctgtttctgtcccttgaagctgcatctcttattgtccttgtagtatccccttgtttaaatgtccacctccccttacaagtctcagcactccttaagttacatgatctatgtcttcatctttgtatggccagcacctagcataatgtctatttcctaccagccattcaatacctatttgttgaattgaattcaatttttgaatagccaagcaactacgagaaaggtgctctgctagaaaagtctccagcaggtcttgtctcacatggatacagtatttcagtgtttgcagagcactttcaagagcactgtctcatgggggtttcagattctggatgaagtaaggatttatggataagtagtgggtataaaagcagttaagcaacttgcccaaaccacactgatgatcatgaaaaggtccagattcaaatttgggtcttcgggctccaagttcaggattttttctactatattccactagactttcagccaagtgtattattctaaactgacggctcataattctgactgtacgtcggaatgatctgtgctgccttgaaacatgccagtgctcaggcctcaccccagagcaattaaaccagaacctcctgaggagggactttggcattaatatttttaaattttttacgtaaagccatgggtttttcaattatttttcacaggattaattgctttggccagatgcctgggcatgatatgggcatggacccagcttcttctgtgagctctttttattcccttcttctgttgaagttaattcaccatatggtattgagcatgatgtgacatctcttggggtatccttttcatcgtctgtcaaattagggtgctctgtaaaggatccatgcagtcccttccaactcttcaattcaaaaatggagtcttggtgtggagtgggttgaaacaaggggcgtgtacggacagtgtatggaaaagatagcaagtgccgttcatgccgcaatcatagatatatgcaggcatttttacagagtcctgctagcctgttcctacggggggcctctgaaatctcagctctatatattacttttgacatttctgcaatgtagctaaactttttgattagccggaggatagatagcaggtgttgggaactatacagccggtgcctcgtatacaagaagccaaaaacattcagagagtgtgacgaggaatgaaagctgccacttatattcttcaatttacagcccctaacgcaagcaggcaagcatatgctcaagcccattacatgaagggagatatttgtttcatatgtttgaaaccgttttgagatgcaaacaaagtagaagggaaagcttcctgggccttcctcccacgctgaccagttgcctaccacacatggcaccgggcttctgggctacacagggctgtctgctgccagtccttgacagaaccggcctcaggaggctcagtgtctcctcgatgtggtctggaaaaagcagtcatggaggaagttgacctttcggccttgcataatttgggtgtcgctattatagggaagtccggtttaggagccaaagctcattcctgactcttgctttttgggaactggcaggatggaataattataactaatgtttggctagggctggacagttaacaaaatacttccccatcctcctttacgctgatagcagtgctgtgggaagtcgttattattactacttaatggatgaggaaacaagacctcccatgacctcctaaaatggaaaggataaataaagtcaaagctggagctgaatctagctcttttgacccagggccagtgccctcccctcctcagcagggctgaacctgaactcccagccctgttaacactggttcatttcctcacttgaaaatgggatgcctgggccctgccacctggttttttgactcagctttccaactaattcacaggttaacttggacatatgccttcccttccttctgcctctgaggccctccttccacagattggtttaagaaaatattgacattggctatgggattaagacattttgttttcttaatagaatctcacatattgctattgtagggaccttgaaaaaaattaaataaatgtattttctttttattgaaaaaatagtacatggtccttcttgacaaatgtaaacattttatatgcacaaaaatggaaatacttatattcccatttcagagataactactgtcaataccttggtgtatatcctttcagacattttgtacttacctatttacactttatgtaaatattaacatgacatagctacataatctatgtatgtagttaacttgctctgtttacatacccaaaaactcaaatgtatgcattacacagatatatgcatctgaatacatgggcagactgggtattggagagaaacaacgtcctgattagcaaatatatcattgttaatctgaagatgctggtatggtttcccagcattgactttttaggctatctaagactcaggccccactttcatggattcattcatttataatctgttatatatcagactctgtactgggacctttatatacatcacctttagtgctcataggagccttatgaattagatattataatctccattttacttctgaggaaactggggctcagggagactagttgcccaagttttcacagtcagtaagtgaaagaattgggacttaaatccaagtacatttcactccaaagggtgtgtctaacgtagtgcaatgtgatacccacaataatagagaaatgtgcagggagcagtggcttgtggaggagtgaaaggatactccatagctgggaagctctgagctggatggtggaggataagcaagacagtggaggataagtaggtgaggagtgagcagggcacatgcaatgaggctggaatggaagggcatggtgtgctcccagaataacagggggctcacagggctggctactgagatgaggtgggaaggacagatcagccagatcaaaagggcctcaacagccatcccaggagcagacgctttaccctgcagacacagtagaacagtgtggtcctatctgtgtttgagaaaatcagctttggcagaagactgctggtgggtgggttggggatatcagttaggatgctatagcaataagccatataggagaatgtaaactatgtaattaactggagaggaggagagatggatttccaaaacacaggaagcagaataagtaggatgtggtgactcttgactctggggtaaatgaaaagatgaatggttaaagttcaggccagggaactggttgatggtagtaccatgaacagaaatcagaaatgagagcaggaaaagattaggagaggagtgatgaggcaagtttgggcccattaagttcaaggttactggacctcacaggggaatcggtctgttagacagaagcctggtgtggtgagtacagactgaccagaagggctttgaccagccttagtcattctgcctcgttattgcgtcagccatggtgacgtgctctgtaagttttattgaattttccttgtctcttttgcaactctttattagtctattatttctgattcctacaggaataagttgtaggtttttgatccttttaccaagaggaagaaaacttgctttgcttattctttctttattaaagattttgcatactttgactgagtttgtggtgaaataccattttcaacgttaaatctgtttaaggtactacagattccatcaatgcatttaagcctcacccagtatgataacatttactttttcaaaaagagaatcaagagttaaatgaagctgagctaaagaaatatcaacttttacttaattatgaaaattacattttcaacagtaaaatggaaatgtcagactcccaaatgtgatactttctaggagtttaagttaacactattatcagagctttgaatgagcaaaaccagaagaaatcttagaaattatctagttactatattcccataatacagactgaggaggcaaggtcagaaggggaaagctaattacggcaggccagagacagagacatgctgagatcttgttctcctggctgtgattgagatgaatggcaggggcctgtgtttataaatgtaagtagacctacattcatgtctttcaggtggctgcttctctattatgctctgtgcttctccctgtcaaaggcttcagcccacaccgtggagctaaacaatatgtttggccagatccagtcgcctggttatccagactcctatcccagtgattcagaggtgacttggaatatcactgtcccagatgggtttcggatcaagctttacttcatgcacttcaacttggaatcctcctacctttgtgaatatgactatgtgaaggtgagactcctgatgtcccctaactgggccaggctctcttctgggatttagacaaggcaatatgaaattagacccttccagggtggcatatagtaagagagacacacaacatcacaatggtatgaattcaggtcaaggtggaaagctaagtgcaagctgatgggtagaactagaaaggtccatgaaggaaactgaagctgattgatagagtatgactcagcccaacacaacatcccttctttcttcctgttctcaaagcctttagtgtttctaccagcctctgttccaagatcacctttaattcaacaagcagaaaagggcagagacctcagagtaagcagtaatcatggaaagagaaccataattatgtccaaagttgaggcattagaaagcattgtccaatttcccaaataaagatcaagtatttgggaagtgcaggatatacagtagtaaagagtcagagatgaagtaggaaggtgagtggaggcgagattcttaagggccttgaatgtcatgccaagtagtttgcattttatcagcaaaaagtgtgggtaggaaggggacggtcaccatcagaagtagatgtaaaaagtaaatatgggggaagagcaggaccacatcaaaacaatataccctggaatttagagaaccccccacaaaaaaaaaaattccatgggtgggaagctgttcttcttttaaagtgaggctgaaaaaggtcagaatatttctaagggatcaagtttattgcagttatatctagttaaaaaagacgtggagacctaagaacctaccttctaagctctctccagcttcctgaaagaggttctcatcaaacaactctagagcatttagatatttttagtattattgtagactcattattccatagccagtaattcaacatgaattaaccttgtattaaccagaatatttggtcaacagcagagaagtgagtttacaaggtgcttttacaattataatctcaatcaaactttaaaacaattttgagacaggagccatgaccccatttcacaggtaaagaagtaacccaggaaggttaagcaactcacccaaggttgtacatctggtaagtgatggattaaggtctcaaacccatgccttgtgtttttgaatcacatgctcttttgtctacaccaaacaactcccaagctattctccactgagcctaagatacagcagaggcatacaaaggcactgtgcttccgcttattttatatgtagagtattgtcattgtatatgttgggtctgcctgcaatgtcccatttacaataggtctctgcgtctaaaaattttccaaaattggtgttccatggtagggatttttaacctcagcactactgatattttgaaccagatcatttgctgagaaaagctgtcttgagcattgtgggatttttagcaacatccctagcttctaccctaactaggtgccagtagcagccccggccccaccagttatggcaatcataaatgtgtccagatgttgttcaatgtcccagaaccactgctatatgggatgatgccctcttagaatgccctgtgctagggacggtggaaattttaggacacaaaagatctggtcccttaaaaagaaagatgagtcttgaaaatagccattgcacaagatagaaaacagtgatggcaataaagactaactgataaagaatgagaaaatgtggaactggttgctctaagagacaacgcggattggtaatctagatgcgatttctacaaattcattaaaaatagaacaaatttctcagggtcacaaggatcaaccaggggggtcttcactgaggccatgagtatgtatcatcctaaactgaactttctgacaaaaaggccagttacgcttttcaggataaaagggttatccagagttaaactccaggataagatggattgtaggtatgggtcctcaggctaagtggaatctcccggcccattcccccaaataatgttggtcacaaaatcatggcattctttagtattttggttggagagttgtcttaaccggaagaaaaattaccaaacactggtttaatatgacaataagttccatggatttagacaaggctagatatgaactttctaaccacatttttctctactttcaaacatgctaaccatctagaaattttgtcagtgccaatagcttttattggtacctgaggctcaagatcacagaaattatagaatttttttgctcagttgtagggatgacttcttctcataatttgccccctctcctccttaagatttgactcttaacttcatagtcattgagaaactctttctcttaagtttgattctttttcagacagaagacaaatttaaccttgttaggtctccttcatcaagatgataaacacacaagagaggatttagctcatttctttgctccaaataagtggagtatccaaggaaggcagatgaagcagctgacataaagcagcattttgttaatgggaaaaaatgatgatacttttcaagagcaataatataatctgaagacctcttctaacactgaattaaagacactggaatagatttctatccaaagcttgactttcttggctagagaatattttggaaattggttgatggtttctatctagagtggtgagactccttcctgaaaccacaagtagatggacatgggccctctggaaggggcagcatggtcctgggcccttacatggaattcaggaaatgccttttctggtctcagatctgtcactaactccccaaatgacatggagtggagaagaatattattttacagcaccctctctgctccaaaattagacagatgacctctgggcataacagagaagtagtctacttgaggcaacttagggactgagctgcctacctgaagtgccctacagtccttgcatctgtgagttgggacaattttccagttcctttcaaagaagagattaacatggtggcggcgggaggtgagatagacttctccacttgtgcttgcacagctgactctcttccagaaggccaccctaatgtcagcattagccttctgcagaggttccaacagccgtggggcaccagcaggcctcccctctgcaggatgctgcatgctagttggctgactactggtgctcatgtggaaaccaccctgtgcccctgcctacacacacccagtgagttgccctcctagagctgagaactcacagaatgtcaggctgcaggggccctctggggacgcatctcatcttaagttgtggttttcaaatatattctccccagtacacgttttcttcttcttctttttttttttttttttgaaacggaatcttgctctgttgccaggctggagtgcagtggcgggatctcggctcagtgcaaactccacctcccgggttcaagtgattcccctgcctcagcctcctgagcagctgggacgacaggcacatgccaccatgcctgactaattttttgtattttagcagagacggggtttcaccatgttggccaggatggtcttgacctcctgacctcgtgatcctcccacctcggcctcccaaagtgggttacagacgtgagccactgcacccggcccacattttcttcttgaaaatcttcagttaggcccaacgtagagaagagacagaagtgagctgctctagctgaaggtggttttgcttgctcatccttcttggttaccctgaagcaccttgagggattatggcttgaatcttgctgctctggccacattcctattggacagaagaggaggtcagagttcagagagtgggtgagcagtctgcctctgaaatcccaaacccagaagtcttacacactgagttgaaacccactgactttttctaatcgcctggccaatgctagcccctagcatatatgctttttctggctataaatggaagagaagcttttccctttccatctgaataaaagcgcaaatatgccatgtggcccccaggtaaatccacatccctctccaaaattctgttttttcctctgttcagtgagaggatggaacaagatgatccccatggtcctttcaattctggaattgtaatcccaatcctcctcaccagaacttccaagatgaccccaccaaacactccttatcatagtcaggataacaccagaaaacagaaatcgtatgtttacagcagctgcttctcaatgttgcataactgcaagcactccagtaggagcctgcagcctgctggggatgccttggtggtatgtcatcacagaacttgtaaacatatcatgccaacactgttctttaccaagaaacttaaaatatcactgacttgcctttgacaggataaaattccctgttttgaggcatttttcctctatgactaaattctcctcacaggcctacataggagtaggtttaagaaaccttccaactcacaggaacattttccagcccagcccaaccccgcaagctgcccttcccacccaggcccataggggcgatgatgatggaactgctcatactgctcatcagtagcctgaagaagagcaggactcccaagtctgtggtccggatgctcacatttatgaaaattcctctcctgcctgatttcccacagttcttggtcttcaagactcatgcacatctgcacagcagcatctgcttccttggcatgtggctgcaatgtttagattcctgtagtgtacggatgaggcatacgaatcaaggctggttaatgctgcaggcaagaggcaaagcacagatactagtcagggagtcaggcagcctgggtcctgggtgtcattctatactcattaaccttgggcagatgactgcacctaaaatggactctgtttcctcctctttcaaatacaaacggttaaaccagatggtctctaaggtctactttgccttgatgttctgtgcatctaagaccttagaaatcatgatccaaccccatgatcaacatgtccaaagtccagggaagggcagttgattggccaacatcatgcttgtattagaatttacatcttaagattctcagtcttttcttctatttatttaacagaattatttaacagattaaaaaacagcaaagtcccatcttgtgaatgactagtttttatgttgtaacataagacaaatattgtctctagtcaaacttaccattaaaaaatcccttaaatattgcaaagcattatcttttagatgcccagaaaagaatttttttccaaaaatgcaagaaattaaagttcctttggttgagcaccagatgaagtggtccatttatacttacaaagaaactatgaagctatagttatggagagagtctagatagttagaaaccagaaccaacaagagaacagcagattacacgttccaatttcaagttcatttcatggcatctattcactgtaaaaggaagcataaatcatctgcatttggattgcactctctttctttctttctctttatgtcaccatgtgtaatattttaatagcatctgtgacatgtttatgtaatgcaatgccactgttctccttttaaccctatatccttgatgtattcgacatttcttccatcctctccactgctaattccttagttccaattcttattcctctcaactagtctattgtaatagccttctatatgtctaccagatgtcagcctctccccatctagcctaccttctatgagtatccagaaggatcttcttggaacatagctttgattatgctactctaaaaatctttcaatgcctccccattgtctatggaatgaagcacagtaatcctattgaaaatctaccataagctggacactatgccaaagactgggtctgcaaagatcagtaaaaagaattcttcgaagtaaaatgaactataaagtcctcaaggaattcacggttccatagaatataatgaaataagtgcataataaagccagacaaagtaacacaagggttatcagtcagtatataagtttgggagtggtcatttttagatggccagggagggctttggaaatagttgatgtttgagattagtctttagaggtaaataataatttggcagtgcagttctctaagtaggatttcttagcagagctaccatcaaagcagggaggttgaagaggatgggaatgatgcaaaactgagaataatcagagttggcatgttttggggagacgtaaagcccagaaaggttatctgagggtcaactgagaaatgtttggtaaatttgggtttaagcatgtgctccccaaatcacatacgtgtggtcaaaggttgaattaatttcacagatggattttgttggccagcctaatattaacttatactatgatttgggggtgtaaaaaaaagaaagaattatgacaacataaaatttccgatctcacacaacaatctgcatttccaagttctcttagaatattagaaaatctggcaactcttgcagcttcctgccttcaacaatcagccaacaccaggaagaggtggccttgtgggtagggtccccaccattctctatagctcccccatgctaatgctttctggcctcttaatggcaccattgctgattttacagtaaagaaagtgaatcatttttccccagtgtctctatcaaaagtagaaaagttgaaagttcttgagaaagacacgtatttcaggaaaaatttctttgcagagtgaagaatatccctctgtatttaacacgcaaagtgtatatttctgtctaaagaattcatagcagcttgtttcactcatttatgttttctgcctggcatcttttagcattttagtctaggacgtccaattagaagctgtgatgtggcggaggggtggggcagtggggttcggggatgtgacacagtcgagggtatgcttgaggaaggttaatctggagctacatgagggatgtcaaggactagtaaagtcaaaataaactggagctgctgaatgaggccatttaggtggctgtgctaaatagattggatatgactatgtggagcgtagtatacttcaagaaagcccacaggcctcctggacagctatggaagagcaggtaggatgtgcagaggtaaactccacaggaactggctgcgtatgggagaggaaaaaggaggaatcagaggctttaagccccagttatgacaacttattggctacttacccagaaattgagatcaggaacgtgaagatgtgtagatttagaaagatatagagtgcactgaagtgcattgagttttgaatacagctggaaatgctggtctaaattttgagacagagcttaaagagtcgtaagagtgggtgtagaaagagcacagagacagtgatggagagaggattaacacagtgaggattaaattctgtctctgccaccatctgagtgaggaaccttggtgaagctccttgatctccctcagcaatggttttgtcatcagttgaaaggaagagttcctaatgaatacaacgtcttcctcacaggttgtgggaggatttgaatgacatgagggtctaagtggaatcagtactgcaaaacgcagttgtgctcagtggttgggagctcaaactttggagtcattcagacccagcgtcaagtcttgcctccacttcttactggagcagttgcttaaccttgctaagattttcttctccatctgtaaaatggagataataatgatgcttatttcatagacttactgtgaatgccaaatgaagtaaatgctttaatgtcatatgtccaacacatctctaattagctcaaaagtactattatagtggtaatgaaggcaatggtatgagtaataaagtgtctgcctggtatcaccagatgttcaatgaatgtcagttttcttatcaactctgaccctaccactgactgcctatgtatgaccttgctaatgttactgagttttttctagcaatttatggaaaagtgcttccaaagcactattcgaaagcaggaggttatttatttctcctttgtatttaccttgtagaaacacacattttacagcagtttctaatctattaactcatttgattcccatggaataggaagagcacggattattgcacctaatttacaaaaaaggaaacaggtacaagtgaatttgttcaagtctctgcaggaaagccaggcttgaatccctgctcttctaactccccaagtcatggttctgtgtctccatgcagccttcctcagaacaggctttactgtggaaggggtcctgttgtgtttcctggccatgcattattcctgaaacaatactctatttgtcaagatgatttcataaaatttagtaaaacagaaggtccttgagggtccctatattgtctagattattttaaataacgttctcttttatcctttgagagaaaaaaatgttttttaaaaataatagaaaatggagtctgaactacagtgaatctgcaagtgcttgtatcatctgcttgtagtacatcctttctgatgagctcaagctcattcccactagattgccagccccatgagttcagggcctatgtctgtgttttctccagtagaaagcacagtcctgggcagaacaggaaaaggcacatgtctcctggcagtggaaagggctctggcctagaaaacagctgctgactcctgctgagagcttgggcaagtcacgtcttcattcaaggcctcagtttccccatctgcctgatgagggaactggaccagctggcctctccaaacccttccagttctgatggtctgtgactcccagtccaatgccccttccctcaggccacattgggtcagtctgcatcctgctgtgtaattgagaggtaagtcgctcccaagtgggactcttctgacccctaagctcctaatttctgtgcaatgctctgtgtttacttagaacatgccctcgaccttccggctgaactcatttcacctactgcataactctgctcattctctgggagtggacaggaggccttggccccagaaggaaatgagaaatgggtaaacatttctcatgaatttcaattgtagtctccggtggaattctcccactccagagacaccaggacccaaacaccaattctagcttattcagaagaattagaaaatgaaaatgagcttgcttcaggaaagtgtaatgaaagctcattttatgccaaaagtgcaaacagcacaggcttcagggtgatggaaaacaaaaggaagctcgcagtgctgaggaagagcatgtgggtgagtgtgagctgggaaggtcccaggtgtgggtgcacatggggtgcatatctctgtgcttgagtatattacaggttgctgttgaaaacaccttggtgaagagcagtgcctgactttacttcgatgtgcttataaagggaaaagttaagggacgaagaggtattcatttattcaacaaatattcatccagtgcctacaatttattagagcttagggtacagcagtaattagaacagatagaaatctctgaagtgaggcttacattgcactgggataaacagacaataaacactaaacataatacataactaaattatgtactaagtaataagtttatggacaaaaataaaatagagcagggctctgcatgagttgagatgggggctctgatttaaatatggtgctcattgagagagtgacatttgagcaaacacttgaagcaggtaaggttagccatgtggctttcttgttgggggggctaccctggggggcactttaaccagagggaacattcagtgccctcaggtggaaagtgcctggtgtgtttgaagaatagcaaggatggcagtgtggctggagggcaggaacatgaatgaagactgagaggtacagatggggggcgggatgggagactggaaaacagggttcctgttaaatgctgccagccaatggcaggctttacaagctgctttcatgccccgaatctcatttgacctgatgctcagagtattaatgtccactttttacgtttgtgaaaactgtgccctggagacaggggcatgggtgctaacaaccagattggggggtgggggcagggaatgggggcaaagagatgcgcagtggcttatcattcgacattcagatagcacagacacagagagcccgcagagcatagagcatagaacaatcacataattaggaagtaatgagttttcacagaactggttttcatagaactggtttctaatagaatgtacttaattttaagtttatgaaacttgatgatggctggatttaacaacagggtagcaaaatctctgaaaagctgacagttggctcttataaactggtgtgagctgccggctccagcacacctaccgcctggggaggtttaagtgacccctgaggtatgagtggcagagctatgacagttggtccttattccagcactcttgtaggatttctgtgcaaagatttgaggatataagtttagcctgagtcagggcaaggtcctgggcagtgtcacaggaacacagcagctcacaatccttgaaactctgctggaagacactggcccaaggcggccccttctgtccactcagcacaagcctcatcactgccttcacccacgtcctggctatgacacacctggagccacgcagcttctgccgcagaagaacacagcaaccctttgtgtttcccatcctcaggctattttcccgtcctgaactgtttggggcccagcctccaagttgctgaagggatttgcatatgaatgagctcagctctggagtcccagaaggggtgaggtgggggagtctgagccattctcaggccaaacagtgccaatcctccctggctctccctcccagacacaattccagactcttccctcccaccccaccccccaagcccagctccctctgagacggtgggcactgctggtttcccacctgcgggatgcccgcttcccaggctcttggcaggacccctcccctgccagctctttcttctccctctgctcatgctgcccttttctgtccagagccctcccgagaatgggcaatccttcctggcagcagtgggattcttggactcttaggacctgccagctgtttctctggcccccaccagctgtttctcaggcccccacattctttatggcgccaagcatttgcatgtacacaatacctgcttaggggctcactcagctctgttaggaggttttcaccctaattaacaaataagaacaccatcctggaaagagcagtgcacctaggccccagtactggctctgccattgactgactttgaacaagtctgttcctccgccaggtatagacttgaggtcttttcatgttcttttcagctctgacctttgctctggcaggtggcttatcagctgtgtgattccaattattgagccaaacctggatgtcagaacatcctgatgttgtctcaggtctgctacttgtaggctatgtggacttgggggagtcatgtcacctccatggactcagaactgtctccctgaagtgcactcactacatgactgccattaggagcaaataaaatagagaaggtaaacgtgccctgtcaactggaaagttccacatagaacaaggaattattatcatcatcattatttttattactttttttttttttatggagtctcgctctgtcacccaggctggagtgcaatggcacaatctctgctcactggaacctctacctcccgggttcaagcgattcttgagcctcagcctcctgagtagctgggattacaggtgcccgccaggacgcccggctaatttttgtgtttttagtggagacaaggtttcacaatgttggccaggctggtcttgaactcctgacttcatgatttacccacctcggcctcccaaaatgcagggattacaggcatgggccaaggtgcctggctgattattattactctttttttatggccgaaagacttgagccaggactggagcatcaacctccagaacctctcatttgaagtcaacttgagcttagatctgccagctgtgttatttttactttacatggctttcaagagtttctgaagtgcagcacacacatgcaaacacataccagatgcctccttcgtttctagacccaagtttctatctggtatcaggtgcctttaacttgcttctactcagatcactgactgaaattaaagctacctggtgaagtagcaggactgggccattaaccactggcccagcagctgggagtgatggactttccgtgaaggtgagctcaggagtaccgagctcgcacaatgagcaggagtcagcccggggctgtcggtgaatcattggcctacggctcacgcatctaggaaaatcttttgaagcacagcaaagtaaagagagaaattcctagacttaatgccatcttcttgtggacagaagcctttagagatccctcactttgctctgatcgtctttcataacttaagagtacccttttgatgtctctcagccccaggactgttagaaggctttgtaaagtgcaaagagccaaacagctaatatgccacctgccagaggaggaggctgggctgggaggtctctctaggtgcccttccagctctatcagcctgggttgtgaatcctcacaaaaggggaaaccactgctgatggcttcagcgagattaggaaaggagtgaaatggagaaatagtatccagggacaatctcagcttcttaatgttctccaaatgcatgaagtgacccttgccccactagctgggagccagaacgtgtcatctcagttggtggatggatctcagcagtcctgtttttctcattgatgtactgagtgctcaacgtatcccgggcacttttctgagtgttttatgtatatcacctcccatcctatttacaacagttctgtaatataaataggattattttcactattttacatatgagaaaaactatatacagagaatattagtttcctaggacttctgtaataaatgtccacaaactaggtggctgtttaagttgttaaatttcttaacaacagaaatttgttctcacgcagttctggaggtgaaaagtctgaaatcaaggtgtctgcaggaccatgctccttctgagggctccagagggggatccttccttgcctattctagctttctagaataggcagttgtaggcgggccgtctttggcactccttggctagtggcagcataactctaatctctgcctctgtcttcacatggctgtcatccctctgtgtgtgtctctgtgtccaaacttccctcttcttataaggatatcagtcattgggttagggtccactctaaccctttgtagtgtcatcttaacttgattacatctgcaaagacctgtttccatataaggtcacatgcagagaaacaggggttaggacttgaacatgtattctagggggacacaattcaccctacagtacagagagtttaagtaatttttccaacatctaatcattggagaagatcatataaaaatgagatgccccaataagtaaggcgttgcatcctaaagaaacagaaaacctaacaaattgaaaacaattcacaatttgactcactcttgagaagtcaacaaagggcacagatgttcttattgcaacctttcttgaacatctaagatctgtctttcttctctttttctgtctctctccctttcctgtcctttaggtcttcatgaactctggactaagaaactcttctctctccccttagccatccacttacacccacctactcactccttggacttcacagtcacaaaaactgtcccctgacatgagaccctccctgccatacgctgccatctgtgagttttaggtattctgagtttcttgatattttctcagaattttacttttcaccttattgtttatgaagcaaagatctctttttcaactctgttgcgacccaagggctagagaaatgagaggaggtgacagagtgctgaggagttcccacgccatgttctgtgatgaagggaagacaaggggggaggagggtgatagcagatgaatgaccctgcacttccaggctagttaagttgcccttcctgtgtgctccccttgtttgttgactggaattaaccaattttataccatggggtggaagctagagggaagcagctttgagctcaagtttctttttaaatgtaaaaagagaagaaaaagaaaaattacctatagttccactaaccattgctaacagttactctaattccttctactttttattttcaatgcgtactttcaacataggtataattataccatatatactattttttctgctttttcacttaatattgcctcctaagaatatttccatattgctataaaccctcgattaatgtgataattaatggctgccttgtatttagaagttaatgctaacttatttctctagaaaaggatatttacagttatttctaatattctaatatcatatgactgctataaatatctttgtttataaaagtttttttccacatttggaatatttttccctaggttatattcccagatatggaaccaacagataactttcaaagtcaaggataatccaaaacagcctgatctatcttggaagatactgagtttctcatccctgcagctgatagtgaaaaggtggtatgatatttgctaagggtgtggtaaaaagataataagttagactaggtgacttttgaggccccagaaacccatgagattgtggttctccaaatttcaatttacaaacgtgagcctattctttgtcccaaatcactttcttacttgctataaaagttatctattgctgtgtgataaaccactccaacacttagcagctaaaacaatatccattttgtttgcttatgattctgtggtcaggcgtttgagctgggcccaatgagatggtccttttgctggattagcctgaggtccttcatgcagctacagttgttcagaggcatgtctgaaggtcatctttggccttagtttctcatctggtagctgatagtgaatgccagtgaattggtctagacattttaatcagatggttcatctctgccctatgtggccgctgagccctatggcctcacagggcttcttcacacagttgcctcagggcagtattccacatgtgaaagtgttaaagaaaaaattattcaatgacacttgttaaagtgtggtaaggcagactttattcaggacagggatgaaaaggatagggaccacggcatgggatttttgcagtgagggagagagattgggctctattttgagtatagcatgggcaagtggggatttatagccagggagcatggtggtggtcagtggatgttaaattactaatgggaaacatcaggggtaagaggggttctagctaaaatgacctaacaggattcttgctggtgacaggccaagatgatcagacagcacccgtggggatggtggaggatgaagatcccaattggaactctagggtgaaaagatttcagggatggggcgttcttgctgcactgattcagcaaagattttgctaaaactgagttttacaaggaagtgcacagatgagttgaggagacgtttcagaagcctgactaaaatttggctaagcaaagaatctttgttaatagctgcaaggtcccttgaggcctaaatttggaaatagtatactgcttttaacgcatcgtatacttgttgtcagaccaagttaggccaatcaatgagcagtgaagttacattgcagaattatctgtgtgcagaaatggaagaaagtattgtgaataatttttgcaaacaatgtattattatctatcttagggacaaaataattcttgtcctttgcatatgtgaaatgtgcttttgccccttctctcaaagttttatcccattagccgttcaggcttgaactccaggacctcatgatctaaatcatgtctagaattagatgacacacaaaggtatagctcttgaagtatatctcttcttgatctagagatctctgaacccaaaagaaaagttatttgctctccacatgctcaatatctccttgtcttggtgagagaagaataagataaccacaatagaatttccattgaaaaatggaaaaaatgagaggcatatagcaattactgctccatagtaattctgaaatttagccaggcacatgttgccaactccagataccaagaatgttccttgattagagcccagttctgcttccttggaggggtgagagtggatccccagtccattgctctctgggagtggtgagagtggctcttgcctctgatcttgactctgcctctggcttcttagctttgtcttctgagacattctttcctttctgtaagaaatggcccatgtttgtagctgagtagtctattcagttcgctttctgtacatagaaacctgaggctcaggagcctcttttcattttgaattgccacagtcatttctagtccaagcggatatagctcccttaaaatctttttgggtctccaatgtagcagaatatagttcactccactagatgaaaaacatatccacaattcttttcaaaataggtcttcctactttgaagggcatgtcagggtgctacagaataatgctcttaagattcttaggtgccttgtggtctggctgatagggagtactgggtactgccttaaatcttctaggtcttaacaaatgattcttacagtcacaccattgatttgacatttaccctgaagccatttttggttttaaaatctttttttttttttttttgagacagtgtcttgctctgttgcccaggctggaatgcaatggcatgatctcagctcactgcaacctccgcctcccaggttcaagcaattcctctgcctcagcctcctgagtagctgggactacaggcacacaccaccacgcccagctaatttttgtatttttggtagagatggggcttcactatgttggccagcctggtctcgaactcctgaccttgttatccacccaccttggcctcccaaagtactgggattacaggcgtaagccaccacacccggccttaaaatcttttactagtggataaactgttttccaacccagctagttctgggccctctatatttcctctaagttctgctcacatattgaagacttacttcttcctgaagtacattgccatacacaaccagaagtacacactgacactttcaacattctgtctagagatctccttagccagatatgcaagttcactacatacagtccttcctttcttttcttttcttttcttttctattttcttttcttttcttttctttctttcttcctctctttctttctttctttttcatagacagagtctcgctctgtcctctgttgcccaggctggagtgtagtggcatgatcgtggctcactgcagcttcaacctcccaagctcaagtgatcctcccaccccagcctccagggtagctgggactacaggcacatgccgcaccaccacacctggctaatttttgtattttttgtagagacagggtcttgctatgatgcccaggctggtgttgaactcctgggctcaagtgatcctctcaccttggcctcccaaatttctgagattacaggtatgaggcatcacaccttgcccattacatacatttttctaccttctaagttgccgcagacaagttttgccaattgattcaccattgcattattcaagtggtctgttttagactcctatagcagtctcttcactgtttttctagaatttacttgctagccaatcctaaaactgaagccacatattctagttttttgttactgcagcattctacttctggtatcaataactatttcagtcagacttcaatcaggaaagcaaagtctttatgagtaatgtgagataatgaatatttatgggtattagaactcgtaattatagaaggagctgggcaagtaaaagttggaaatggggatttaaaggattagagaaaaggtcaccaagcagttctcttaaagccctggcatgggtggaaatattggcatctgcaagggaatctgataagtcaattctacctaaggggccaaagtgcaacaatgaaggggaggctcatggaaaagggtctctgagaagctgttggctgtaagcagctaccacctctgtggtttcacctgaaagtatctgatgataggcatgggccactgttggtcatcagagccagtagttataaagagccgggtgcagagtagaggaacgtgagagcaagtgaggatgtgttggacacatctacacatttctttctctgtatgtgattacaaaacagccttcagtgagtaatgactattgcctttcaaacttgcacaaattcctcttttggccaactctaatctagaactatacagggaaagaaagtctggggaacgtagctcccagattaactaaactggcaacagggtaatccagcatactccctaaatgtctgcctaaattaagtctgcaatgctcctcaagggccctgagcagatttcagaaaggctccaggagatagctcgggaacattgacaaacaaagtcatgaggcatttgggttataagacagcctttgtttatttgcctaatgtcttgaggagcactggctagggaatcaggatgctgcaattgtggacctggatccaccactcactagattcatttatcatgagattcattcaccactcactagattcaccagtcaccttgcccaatttgttcaaattatctgggcttcaatttcctcatctataaaaggagagcaatcccccctgggctgctttctctatacattgctttgaggagccagttggtagctgtcaatgcatttgtttagctgatgtaatgaatttatggacatgcagagagcagccatacatagcgagagtagctgtccttccctagagtagctgttcttccatagagtagctgtcttcccatagagtagctgttcttccatagagtagctgtccttccacagaaatttggccaatcccagctgccctgccatagttttgcctagcaggtttgtgctgtttctgctgaggtagaaaactcatagaaaccaaagcctcttggcttctccttatcagatgtgccttcccagctctctgtccttaacagagcccctttctgacgccaggtaatgggtagtggggaggagcagctgagatttgaataccccaggccttcactatttcctctccctacatactctacccaccccctaccctccatctatgatttctacctgcctacattctattcacgtttcagtctccagctcaaagattattctcttcttcctaaatgttttctgatttccctcagctggattcaatcttttccattccttaaacccccagggcagcccatctttgattgcatttacgataccctgagaataccccaacacatatacctttgagtacttatcttattcttctaccaagtgtcacattcctagaggcagggaacttgcttattgagctcgtataacaaataaataatttttggcacccttcacattaaagtgtagacagaacttagtacacacatatttggtgaattgagttgaaagaaaacaaattgaggacatacagccacatgttggtgtcctaaataacaatagtctctaaggacatagtcgcccacaagaagaaatagaaaaatgaagagtttattattcgcagccacatgggtctccattattatgaatgttttgtcttcacttgataaggtccctccatcatgttgatatgatgacctctgagaggggacagtccaaatagaagctaggtctcaatctgcctatactcagaggtaaatgatctttatagaactccatattccacagcacaggatgcaaatattaaccgggaccagtgacccctctgtttaggttatgactggagctgtcactgagccacatcctctctaagagacagtccatgcacccaagataaggtttcaagaggcctttgagccaggaaaattgtttggccaagtgtctgtgtctttagtcatgtactctctgggttggtgggttcttttctctcatctcagaatagttcccaaagcaaaactgatatcagaaaatgttcatgttatctctccagccttgagcaagtcacttcccctctcttgacctctgtttcctatagaaggaggcagatagaaatagctcttaaaggtcccgcccagctctgatattccaggactctattctgagctgcaggctgaattcccagggccccaggctactggccttctcttctctgcttctaaaaggatgtatggctcaaattttcccatgggcctcagctggggcatgcttcctgttctctggaatactgtggctctgcaggtgataaccatttatctgatttatctgccattatgaaaaggtccttcagcccagacgttacaaggagggaggtcatttatcacagaccctcagtagtatctccctaatccaaatgaccagtgtgttcacttgaaaatgttcatgtcccagtcactgcagaacccaagaggcactggggataccaagttccagaaagaagcctgtgtagctggaactattaatgcccaaggcatgactattcattattaacaaattcaagttcatccgcaagcagtaatcctgcatatgttaaaactcctgcttaccatcttctggttggtttatataatatatgactatgatgatttgttagaactgtgttagactatgatgactgctatgtctggaattggaaaggaatctagagctcagctagtccaaacccctgtttttacaagtggataactgagagctagaaaggagatggcccaaaatgcagaatacggcagtgtcaggaacaggacccaggacctccaactgccaggttcctgtatatcgtattactccaaagcagaggtcaccaagatggtgtactctagttcatgcagttactcacagaagaatccctttcccaggccctcattctaaatctatttagcttttttttattaagttctagcaaaagcagttaactggtttctaattcacaacatattaaaaataagcagacagaaaagtacagtgaataggctgataaaaagacaggaaataaaacatgacataaagaagacttcagaagttcaaggctttatagtccggcaatgtttaacgccaggtcaagcgacattacacaactcaatatccccaagattatcactttaatatagtatcacaatggttgacattcataacaatgtccctggatcaccaagaaagggttagcatgtttcacttgagaaagtgggtacttctttaaagtacttttttttttttaagtgttacaccaaaaagaaaatttttagttatagttaggtaaagctttggctatctggaaaactgagtcagataaaataaaacagcagctgggaggttcaaggaagtgacatttcagctgtgtgcagataggcacattctatagtaacaagactggtgtgagttcggctggtatctgcagagaagaggaataaatagcaaagccatgatctcatcttctgtttacacttcaattcccaaagttagtgattaattgtacttgcgttttgttgccagggcaaattgtttttctttgaaactcccacttattttaaataaataaaccattagtttcaaaacaggagtgtcaaatgtcaagatatttctgacatgctaagctaacgaacaaaacaatgaattcattagaagctactagagatagccgcctttgagaacttttctctaatgactttgaaaggcagcaggaatcattcttggtaagagatttttttcatgcatcttggctaaaatttggtccagaggttgcaaacacaaatacaacttaaaagaattggattaggtataagataatcgaatagatacgtcaagaatttatactcaaataaatataccaactagctatcatacgaagcttcccaaactcctgtctcacataaaatcagctttaagccaccagtttaggatctctgcttggatctctgaattcgcacagggcctctggctcttccaaagaagggaattcttttagcaaacaggcatgttttttgcatctaagtcttaacacaaacatgtacacacagagatacacactcaaactatttttgggtgattccaataaatagtttctgtattaagactgcctattaaacattagttttcattacatgactttcctgcttaaaagttttcagtgtcttccacttactcacagaattaatggcattcaaggtcaaccataattttctttccatgtatccttccaagtacatctcctcctacaatccccacagactccctggctactcactgttcacagaatggggcttgtactttcagttcttgtaaacaaatgtttattggataactattatgtgccaggtcctgttccatgcactgaagacacatctataaagaaaataaagtccttctctcctgtagcttatattctaatgtggattgtttgcctgctttgagtgcatatgcagtgcttctgcttgtgtgaaagcatttgtcacactgtgtaatacctgcctgtgtctgtgttcctcaatctcaacactgctattgtgtgcacagcactgtgtctatctctcatcacctccatctcatgctttgctcggcagtaggcacacactggatactcaatgaatgacttatattgtgtatacagtttccattctttggaaatgtggtaagttcctgttgtgcagagaatctgtctgcgaggttatctaactttttaaaactttcatattgagttatttttaataaataagctgcttggttattgacagcaacaacaaatatcaagctacttctaatggaactaaataagacgaatgaaactgatcagatgtccacattgaattaacttgtaatgcgtcttttctcaagaatccttaacctcctttctttgggtttctcaggctgactagcctactcttgggtggccccttcctttttctttctaaagataaggaaagaagcctagctgggaaactgctcatcttgttccctttctctttgacctcaaaggtagaaactgaggaccaggtgctggcaaccttctgtggcagggagaccacagacacagagcagactcccggccaggaggtggtcctctcccctggctccttcatgtccatcactttccggtcagatttctccaatgaggagcgtttcacaggctttgatgcccactacatggctgtgggtaagttggagaagtgactcatcctcaggtctctctctctctctccgaagatgaaaactgccttgtgacctctcctttacgatggaaatctgtgtgtgcaccacatagattttaccattaatgtcttaatgcatttgctctatcacgtatctatccatctatctaccctctatccatccagcaattcatcttttacaaagtgttttaacgtaaattgcagacatcagtatacttcttcctaaataattcagcatgcatattattttgctagagtttcatatttgttcacagcattttttctttttgtgtaaaattgacataaaatggaatatacatatctcatgtatacatttgttgaattttgaaaaatctgtatttgtgtgtaacccaaacctctaacaagacactgaactttaccaccagcccagggggttcctttgtgtccctgccagtcaatctctgctcccacttcccttagaggaaacaactgttttgattttttttctgctgtagattagttcttgcctcttctaaaacttcatttaaatgaaaacatacagaatacattttgggggtgaggattcttttactcagcataatgtttttgaagttaattcatgtgtcgcatgcatcagtaatttgctccttttcctggcagagtaattttccattgtatgaatatactaaagtatgtttactcattctcttattgacggctacttggaatctccccattttttagctctcactaacaaagtttttatgaaccttcttgtgcaagtcttcttgcaaacatatgttttcaattctattgagtaaatatgtaagagaagaattgctgagtcataggataggtatacgtttagctttatgagacattgccagaccttttccaaagcaaatgtaacattttttatctgtccaccaatgtatgagagttctggctgctccacatctaaaccaacattagatgttgtcaatttttaaaaattttaatcactctggtgagtatgtagtggtacctcattgtggtttaaactgcattcccttaatgactagcaatgttgaacatcttttcatgtgcttgttggccattggtttatcccttttggggaaatgtacattcaaatgcctaggacagggcttgacccacattaggggcagaaagaaagaaagaggtagcatgaggtagaagttaagagcacaagctctgtacccagcttgtctgtatttaaatcctgggtctgccacttattatctgtgtgattctaagtttgttaatgcctctatgtcgccatttcatcctccatagaatgtgactagtaacagaatgcatagtaacaaatgtgtaattcttcctgaggttgttgtcccacacacagttattattataactgttagaggatagtggtcccaccagaagtcaagttacctgggtttgaacttggctttttgtgaccttgggtaagttgcctaacctctctgagttccagtttcctagtctgtaaagtgaagataatggctacctctgggctgtatgagaggattaaatgagagaacgcatgaatctcctaacatagtgagtggcccatatcaagtgctctataaatgttggctgtagtcttcatcatcatgcatgtattgatggagaggctttacctgccctacagatgtggacgagtgcaaggagagggaggacgaggagctgtcctgtgaccactactgccacaactacattggcggctactactgctcctgccgcttcggctacatcctccacacagacaacaggacctgccgaggtagagcctaccaatgattgtatgcattgcccttataggccacatcctcaataacattagatgaggctcagagaaagacagatatgcaataggaacaagtaaaaatgaagtcaatgatgcacctcagacaccacatggatgaagatgcagaaatgcccacccagcctggaaacctgatcttgggttcccaaaggagagaagctctagactatttggccatctttctttctggggcagcatttttcactatacaggttgctgtctcctatcctattgtaggcaattggtctggtcaagttaggggaaaacttgggtttcccagttccttctctttgagccacgaattatgctttacccagcaactccttttctcttcttttccatggcccctaagttcctctacaatagagagacctcagtccaaagcaaagaagtgagagaggaaagaggcaaacagaaacagccagaaaacttcccattccttctatctatctttgttttcatctatcatcaacgtacctactatgctatagtctcgtgcttagggagggatggagaaatggaagggtttagccactttctaggaggagctcttgggctagtggggtaatgggcatgtaagcaaatggtgaagtgtcttatggtctccattttaacattaatgtttccattacatttatgtaatggaagtatggacatagcacaatcagacctgtgcaggcaaacacttcccagagttgtgacccttgacagagatgaaagaataaagagaagaagggccttccaggcagagagaagagcttctgcaaacagtcagaagtgtggtagaacttggaatgtttcagggaacagtcaatagattagtgtggtccaggataagcatctgtgcttgaaatctcacttggaagctgagtgagggatcactgggggagcacaagtctggagacaaaagtttttttcttcctccttcaaaacctgctatttgcttctgaataaaaccctatataacacatcagtataaagcaatccaaaaccaaaagaacaggcacgtgcaggatttttcttaaagagtgtatattttctatttttttattcggttaagttcttcttgagtatctactatgtgttcagtacagtcagggccaagaatgcttagggcagagcaaggtttctcactcattttcttcattttcacccttcaccaggagcttttttaaatataattttcctaaggcccccaccatgaaattttaatatcacagatagactatatatctgtttatgtactgtatgtccatctgtgtattgtgcatttaaaaagcaagaccttccccaccaagaaggaattttagctttcttgagggcaagatcgcccccatgagaatgcttggggtaaaaaatgaaaacagtcaggaactcaggagacttccatcttcaccttgtcctgcagctcatagctgtgaaactttaagatagtcaagacccctttttcagaactacagttttctcatttgcaaataagcagaatgaacaagggcgtagaaacattgacatcccagatctaggatgaactggcccaagggtaaagacttagtgacacataaatgttccttagcagggctaaagtcacgtctgggttcccaggacagtggattctcgcgtgcagtaaatgcagtggggaacgaagcagaattcctgcactcacagaacttacagtctactgggagcaagaaaatcaatatagggagctgttaaaagaaaaacttcagacaaattaaatttaacagagtttaactgagcaaagaacaatttgagaatcctcccctgcacccaccctaccaccaccagaatatgttcagagcaactccagggttgctcatgctggataatatttatgggaagtagaaggaaagtgatggacagaaaatggaagtcaggtacagaaacagccaaattacttacagcttggtatttgccttgtttgaaggcagtttgaacagatggccacccgtgactggccaaaactctgtgattggtactgttaacttaaaaatcaagattacaaatctgtaagtttagaaaaagagaggagattttattccttatgaagggttacagcaggtggccgtcctcatagtctgggaagcaccacctccagccaagaccagagacaggcacttaaaaggaggaggggttgagataggagctttatgctgaacaggttggctaaacatacatattcaacaggttataggaggagctgtgaatattcataagagtggtcctgacacatgcatattaaacaaatatgtatgcaacacatgacccatgttcactttgggatggagacttcacattaaatgtattacagttagggtctaaacgtcctttcaggatgggagacattcaggtgtgcagcctctgtaaactggcgagaaccaggccatggtcagaagtctcttatcaaaagaaagtgactgaaatcaatgtcttgtccattcaaagctacagttatggctggtggaacagggtggggatcagacagtcagcatctggtagagctgaaaattgttttcatatcacttaccacaaggccagtacttgttcagctgctggagaaaaagaaaaactttgtagcatcgttagaacatagtttatgctttcagtgtagggatgcgtgacttaacccttgcctggcatggccttagttccttcatcatttataatttggtattttatttccacaaggagtctgttttctcactctcatgatctctatttaacattaatgttggtcagttgttgtgtccaaactgcagagaaaaggggatatagaaggagtgtctaacctaccactccatcatggccaggaattccgttttaaggtttttctggagatcctttgccacagggggcccattaggtcagtggagggcttaggattttatttttagtttacagtaagacagtagattacagtctacttaaaaatccagttaggttgcagttcaccatgtacgcagaacccttcaggctgaatttaaaatatgtaaggaggccgggcgaggtggctcacacctgtaatctcagcactttgggaggccaaggcaggaagatggcttgagtctaggaatttgagatcagcctaggcaacatagcaagaccccatctctacaaaaacttcaaaaatcagccaggtgttatagcacgtgcctgtcgtcccagctattcaggaggctgaggtgggaggatcactgggagaaggtggaggtggaggtggaggcgaaggttgcagtgggctgagatggcaccactgcactccaacctaggtgacatagtaaagttctgtctcaataaaataaaataaaataaaataagtaagaaggaagcttaaggctacatttagttgaacagagtgaatagcactataaagaaaaacaaaacaaagacaggggttagacagtgaggagtgagggtgtgtgtcaagggcctgtaggagatgagggatctcctgaagttctgggtacagggaggacatgatcacagaggtccaggcatccccctgaccactccatctcaaaacccttccctctcagatccctctccctgacccccataccagaggatctgatgagaaggatcttcacacagggtaaacagccctggacagacaattagaaaatctgtgcttgaatctcagctcggtaaattactagacatgcgaccttgagcttcatttttcccatctgtaaaatggagatgccgataccttccctgtctactgcttgggaccattgggaaaatcatatagtaacagataagccaggcttgctatggctgtggttgcgatgcgccattttctctattatgtttccaacagtggagtgcagtgacaacctcttcactcaaaggactggggtgatcaccagccctgacttcccaaacccttaccccaagagctctgaatgcctgtataccatcgagctggaggagggtttcatggtcaacctgcagtttgaggacatatttgacattgaggaccatcctgaggtgccctgcccctatgactacatcaaggtgagcctgcaatgaacacttgtcctggagatgctggaaaatcttggctgagttgggaaaattgatattgcggaaccttcaccttcttctcccaggatagagagcctagcagctagttcctcaaaaaggcattatttaaaataatatctaccatcttagttagatctattccaggaatctctgatccgaaatgaccccactggccactagggtggcttgaggaggagagtcgtgaatctgcattttagaaaggtctctggcgggcacgcccagcctcatgagcacgcctcccatgccgtcacacagggccctgtgcacagaagggcctcatgcttggtttaataaacatatgaaactatttttcttctgtttatttttttaacctactaccaaggcaaagaagaatgtatgaaaattttaatttgttttaaataagggtccccgtattttcattttgccccagacctcacaaattatgctgctgggcccacttgcgggaagaggctatgtcaaaggcaaataaagacggaacaaataccacaggcaaataactactcaacttgtggttatttcaatattataattaagaaggaatggcagcctgaatttgagccatggctgggataatgggggagatattttcgagatatgtggaaagtaaaaccagcaattcttatagagtgatcagccaagacatccaagtagagctgaatattagggtctagctcagaagagaccctgagctggggataaagatgggtgccatgaaatgtttaaagaggtgctgatttaaactgtggaaatggcgggatgtcctagaaaaaaaaaaaggaagctagaacataatagattatgagacctagatggaggaagaggaacccacagaagaggtcagaaagagccagaaaatgagactgcccaggagaaagctgtcaacagtgagagaggcagaaaagcctgagaggacacagaagaaaactctagaacttagagcctgggctgtcccctacttgtgtacagaggctaagaggcagcttgactggagggggttagcaggaagcataggccaccggttttctattttgctgtgttagcaaactaccacaaacataacagcttaaaacaatgccaatttcttatcccagcattgtgtcagtcagaaatcccagtgagcacaatggggttctttgttcagggtctcatgaaactgaaatcaaggtgtcagctgatggagctcttatctagaggctctggagaagaatcaacttccaagatcatttaagttgttggcagaattcagttccttgcagatgtaagactaaaatccccttcttcttcctggctgtcagccagtggtggctctcagctctagaagttgcgctcagatacttttacattggcccctgccatcagagacagtcccttccatcaaattcctattacacttcaaatctccctgacttctgctgctgctaccagcaggaggaaactgtgttgaatgggctcgtgtgattgggttaggcccacccagataatctccctcactttaggtcaactaatgaataactttaatacatctgcaaaatcccttttgccatttaacataacatcatcacaaagtaacactaggggtgaaggtcaggaggaccaccctagaattctgcctgccatggtgtcccagaagctacacatgggagcctcacccaagcacacaacctcttggggcttcatttgtttcccctctcctcaataaggacaggacaaagatatcacttgggattgcagaagtcaccaaatgatagataaggagtcatggccctcaaagatggggaaaaaacaggttaaagacatggaaaagaaccaggactgagaggtggggaatccggatcagataatagagcctattgccttctctcccccactgcccccaacctcctgcaaactcatcacctccctcctgctcagctgcaaaacttcccaactgttttttgttttgttttgtttttttgcttccactcttgccctacacaatctattctcccatagcattgagggtgatctttataaaagctagattcgatcgagtttgcacttgaaattaaacctaaatctctcaacacaaagtggcgtttgtctgttttccaacctcatgccacagcactcccactgcccagccagcctggattcctgcctgttcctaacactaggcaagctctttcccacccttggctttgacctttacatatgcagttttctctccctataaagtgttcttcccttctcttcaaataggctcatactcatcctacatatctcagatccccaatgctacctcagagaaaggccttccttgattacctaaagttattatctattatattaccattataggaatgattacttctataggttacatagattttacatcaattataaacatacagcatatatttcttttgtatatgcatatcatcttgattatttttataacccttatgacagcctacaattattttgtttattatttcttattagtccccccaactagactgcaggttctttgacagcagagatcatctctgctttatgcaccagacagcactctgcccttctctgagccacaatacgttcatctttaagcagaggatttttttttaattttactttaagtactgggatacatgtgcagaacatgcaggtttgttacataggtatacatgtgccacggtggtttgctgcacccatcaacccgtcacctaggttttaagccccacatgcattaggtacttgtcctaatgcactccctccccttgccccgccaccccctgacaggccctggtgtgtgatcttcccctccctgtgtccatgtgttctcatttttcaactcccacttatgagtgagaacatgcagtgtttggttttctgctcctgtgttagtttgctgagaatgatgacttccgtcttcatccatgtccctgcaaaggacatgaactcatccttttgtatggatgcatagtattccacagtgtatatgtgccacatcaatgccagtctatcattgatgggcatttgagttggttctacaccttcgctattgtaaatagttaagtagaggattattaacctgccttgtccacgtcaagagccattgtaaattataaaagagagaatgaagatgaaaccatttggtgaatggtaaggctcactaaaaacctaagtgaataccaagggttcatatggaagcttccagaaaacccagagtgcagtggagaggtgttacctgcagtggccattttggctgctcagatggaacactctatttctctctctctctctcatattttgcagatcaaagttggtccaaaagttttggggcctttctgtggagagaaagccccagaacccatcagcacccagagccacagtgtcctgatcctgttccatagtgacaactcgggagagaaccggggctggaggctctcatacagggctgcaggtaacctcttccctcccaggtcacaccgagctgctgtgcttagcccttgcagaggcagtggctgagggaggaggtgtgcaggcttggatctcctctggagacctgatgggactcccagttgagcagctggggaccaaggcacgtgctttctcctgactcagttttccatctataaaatgggggcaagggcaacaataatgttgggtggactagactgatggttttcaaaacatgtacttcagtatcgcatagagagattaaagaaaaagaaatcttgtttcctgaactctacccctcacacagtgattcagtagacttgaggagggccttttcagctccagccttctccaagtctagggctagaatttggatgtgggtttctagcccagaatgtttcattatggtgctttgcctccttgtgggccccccatcagcaaagcccatgggtctcatgcccccatcccccaagtcagccagtcctggcccaaaccttgatcgagccattcaacctgcagtaactggtctgtaggaacccaaggaaggagagggtgaacatcagtgacaaaagatcgcagctgggcatgactaatctagttcataaactaaaactctggccctgcctgcattatcacatacactgctcagatgcgggagagtagagaagatcttaacaaaggagagtttgtctcagaaaaagtgtcagggataggcccaggcctgaagagcctgtcagatttagcctttcaaggagaggactcagaggcatatgatcacagtctttctaatgctttgaagaagggcctcgggaagaaagagcaatttgggtcatccttggtggcccaagaggacaaatgagtgaaaattacaggggcgcaaatttcagttaagtaggaatgcagtgttcatgtaatcagcagagtccgtgcctgaaaggttagggaggcattgagctccctgtcactgtgtccctgagctgccatgcttagccctcccaggggtggtggctgagggaggaaagatgcaggtagtggctgagggaggagggatgcaggtttggacctggtggggctcctagctgagcagtctgtttggcatctactgcggaggatattttaagagaagcatcagacaaggattggatttaatgacatttaacattcctcccaaccctgtgttttaatgaaatcatctggtcaaccatttcattctacaagtaaggacatggtggtccaagttggaaactgccctattcacggttccagaattagtctcttgcagggcttggaagatccatgcctccaatacccagttccatgttttattcaccttcatcaggccttgctttctagggactggccctttaaggtcagaattctcttttctcacctgctgttctttcatttgctcctcaccaggaaatgagtgcccagagctacagcctcctgtccatgggaaaatcgagccctcccaagccaagtatttcttcaaagaccaagtgctcgtcagctgtgacacaggctacaaagtgctgaaggtgcagagccttgcctgggaaaggggagtgaccaggccacagaaactctcgaaacctgcccctccccagggcagatgggctgccagaacttgtcatagttccagcacagaatttcctagctgcccatcaacttctcaaatgctccagaaattccaaagcatgcgtcccaggcggtctcacactctgaaagtggcacaaaagtttgttttttttttttttttaatcagagcatgagctggtttgaatttttaaaatatggatccatacagctctataatcaaggctgagaactgtaacaaagttcatcgggcttatagaggggagtggagtgggataccaggaaaggaagtaaacagtttaaaagtagcaaatggggctgagcatggtggctcatgcctgtaatcccagcactttgggaggcccaggcgggtggatcacctgatctcaggagtttgagaccagcctggcaaatatggcaaaaccctatctctactaaataatacaaaaaatagccaggtgtggtggcgggcgcctgtaatcccagctacttgggaggctgaggcaggagaatcacttgaatccaggaggcagaggttgcagtgagctgagatcacgcctttgcactccagcctgggtgacaagagcaaaactccatctcaaaaaataaaaaaaggaacagatgggttcccctcactctcccacccccagaagcagtagttctaggaatcacatggttcgctttaaaaaaatcacctcccagctctcacttgagatcagttaaagcagactttttggggctgggaccagtgattggtgcagccaagctagaggaccatcgctttcaaggaatggttctcaaagaggggtgttcagtttcagcatcaccgggaacttgttagaaatgcaaatgcttgggtaggccagcctcactgaatcagaaactctgggggagaagcccagcagcctatgttttaacaagctctctaggagatgctgaccgcttgccctggtttgagaagcactgctctgaaaaaggagtcaatgcttaccgttttcccttcagagatagttgcccaaaccccttcttgcacacagcccttgcccctctccagagtatgaaaaggaggtatgaattcagcatgtatctttcccctaccttcaagctcacccttggaagcccatgggtggaaaatctcagtcgagatcaagacacgtgtggagcttgagttggttttgctaggaaaaaacccctgacaccacccccacctccttcttcccactcccttcttcctgtctcttcccaggataatgtggagatggacacattccagattgagtgtctgaaggatgggacgtggagtaacaagattcccacctgtaaaagtaagaaagcctaatgggttgttataaagatactgagctccccagcactggcgggatccgagcagagcatgcaagggtgaaagcttggcaggagcactctaagggggatgggagcaggaatttaacagacacacaagggttgggaaaaaaaagagtatcagtgccccttttggcaataagatgtttgaatcccaaaagaaacttcttgtgggcccagtactttgttaaataccaattttacttcagcccacggatgggttgccagacttactaaaggaatagcacgtgtccaggttcaaaaccagctttggcaattgctaattcaggaaactagtttggtgctggtgcccagagctgagtgaccttgctagtcttcacatggccatcagccatatccccttcatcttctgagacagctcatgatttagggctgtgcaggaagggctgtgggatcagcacagtgggcctgcatgaagcagaggatacagctcttcactggctcctgggacccagagttcttgccttggctctgcccctaaccaactctgtgactgtgaataagacccttcgcctcaactataaaataaggagtttggactagctttatattttagaatatgtgccagtggttttaaaatgatatagtctatataaatcatctactgagctttgtaaaaatacaggcttccaaccccttcacctcaccaccaccccctgcaaccacccctcaacacccaggtgatttcaatgaaagacttataaggaccacagttttagaaacttattatggccaacattgatgagaggaggcacagtgacagaaatagtcagggaaggaagggagagagaagggagaatttgctttacaatggcttggtgaggtcaagaattagagcctggcatggtggctcacgctggtaatgccagcactttgggaggcagaagcaggtggatcacttgagttccggagtccgagaccagcctggccaacatggtgaaactcagtctctactaaaaatacaaaaattagccaggcatggtggcgcacgcctgtaatcccagctactcgggaggctgaggcgggagaattgctggaacccaggaggcggagattgcagtgagccgagatcgtgccactgcactccagcctgggtgacagagcaagactccatctcaaaaaagaaaaaacaaacaaacaaacaaaaacgaattagagttggtcccacccatcttcctttcatgaattttcatgcaaactggagcgctatcctcttccctttctcctacatggccttgattcagcaggcagacaaatctcctgccattgtcccaagggggacattcccttaacgcaaatcccaggaagaactttgaagtaaaatacgattgttcttttccttttcatatgatgaaatttttccttttcatatgatgtagctggagtcagagcctagcatggggaaggagggggcattttatgactttaacaaaatgtttcaaaaaatgttgactggatgcctgcacagagttccatagggaagtcggacggaaaagacaaggtccgggcatggcggaactcaagtggtggtggccacagccaccacctcctccaatctgaggctcgaggtgcagtgctgtgactgggttctaagcaaagcactctgcagaacaaagcaagggccatgttgaaggagaaggtaaaggaggatatggggtgtcctggatagaatcaggctttggaattaggaagttctagatacaaatgcagactctacaagctgacagtccctctcagctgtaatcagtgtattcagactctttggcctcagtttcctgccctcaagattgctgtggggattaactgggttaatatacataccatacccatggagggccagaaacatgcaaaagataaacggactcctcctgccccaacccaatcccctcactaggaagtggtttcatttctctcattcacatttttggaaagtaggaaacattaataatttttccctgacttacattagcatacaacagaacaccctgtcattttgtagtaaagagaaactgtttccctgatatgaccctattctcccaaaataggctggattaagactattagaattcccattcagtcatacccagcatctttgctcactctgtaggtatttattgagcatctctctgtacgaggcactgtgctaggtcctaggggagaggcaaggacaggactgaggagtcgagagtccccaggcttctggggcttacaagttctatgtttcttaaaattcgctgattaaaaattttaaaaagatagatatcacacctgaaagcagtggccccagctctgtgccatgggatatcacaggtcctaaacagtgatagagaaagggctggggagtggcagctggaatctctgcttccagacaagaggggtgcactctgtggtaaagaaacgtgcactagaaaagaagctgggaattatgggtcattgttctggccctgcctccaccttgctgtggtgaccccgggacaagccctgttctactctaaatgctgtcaagtgagggtttggaccagatgcaggcaaagctccctccaggggcagaattttataatcctcatgagccaggatgtatgactctgcaaattctcagaacgatacaaattccacaatcccaaactgttcttcacactggctgtacctaaactatgcattcttaatcaattctggtggagtaatttctgtatttcctgcataaactgtttctgctttgcttgctaatctctctctctttctcttcctctctctgcttccttcctctgtatctcttgatccctctttgatcttcaccatggtggcagaaaatgaaatcgatctggagagcgaactcaagtcagagcaagtgacagagtgaatgacgggaccccacacaatgcagacatccagaaatggatcactcccaagacccctggggcccagagctgcaccacccctccccacccacaacacccccgtgcccctttccatgtggattagaatgggtgctgaacaacatgatctcagcagttgaagctgctacgtgtgtgaaagcaaattctccacttgagggtttgcccatcattcaaacactattccagaaaataatgaaaaaaaaatgtgggatttattttagcacctctgagtggactgtacttttctcaacggaaaaaaaaaatgcccttggtccttgagacaaaagatttaatatacaaccatgtggcctcaggctgaccagatcaaagtggtttctaatccattctacatgtcaagtttaaatgaaccagactgcctgtgactttatgaatctgaaggtattacctgttgctgctttcttaaccaccatgagtaggtaaagcaaataataactcacagagtgtggatttttgagaatctgaatgttttctcattcacaaaagtatcccttctacccctatctggcgcagggctgaaatgtcatcattagaggttctgtcttctggggcttacaagttctatgtttcttaaaattcgctgattaaaaattttaaaaagataggatcacacctgaaagcagtggtcccagctctgtgctgtgggacatcacaggtcctaaacagtgatagagaaagggctggggagtggcagctggaatctctgcttccgtctgaacatctggacacacatgtcagagaatctttgcattaaatggactgcccgatctatttggtgattaaatggctgtgcggtgaggggagaaccctgggcagtctggagactgaggtgccattctcggctagagacaccacccaaagaagagatgggctggctactaaagacaagtgtcagttgaataaatgtctttaaacctacaacgtattaacagcattcatactcagtgacatacagggcatcagaatttaagaggaagatttgatatgtacccaaataattgtaatagctttgatgcagacaacattagatatattccatcaaagaaacatgagtgaagagttccagaacaaggaagcagccctgcccagttagaattagaaaggctttcaagaagaaggagtgtttcatcaggacttcagggtggccagagcatggacacagggtgccccgtgcagcagggatggcaccagagaggcctgggagcaggaggcagcaggggagcacactgaaggagctggtgttcggagggtgggtgcaccaaggggaggaaagaagatgaggccagggagggggctagagcccaaacccccaggcctgagtgccagggttagctgattgcacatcgttctctagaaagccccccagtacagcaaagcacacttggaactgtaggtcaagaaatgtgtgtctggagaaaaataagtggcaacaagaaattaccatggagatagggtgttgggcggtacctccaaggcaaggggaaagagaagggtgttttgattccagagtgcggaactggccagacaggactttagagaaaaggataaaacccttcctaaagcaaagagcataagtcaacggaggaagcagggtctagtgtgtgctgattgtgccagacagagctgctcaaggcctcttgtgaggggttaagtcacttccatgtcccagagaaacatggctttttccctgccactgtggacttgggaagaaagtacgcccctccacactgccaagaccctctaccttccactatttatcaccccctctacctagttgtagggccagctgtatcagtgggcaaagttacttctctgaagtgatgtgaaagtaggtcctccacccagaaaatatctatccgccagcatcagccacataacaggctcccaggggcccgtccatctagccacactaaagccaaccctggaattcctgaactgggcggtcaggtggaccaaagttaagggagatgagtgataccaatacctaggcaccaagtcaatggcattttctgaaaaaggaggaaaaatcggctttaacagaaaataaatttaaaactgttcatagtatttaaataataaatattattgcctcattatcctagtgttgagctgcacacatttacctcacaaagtagaagagcatctgtacttttggatcatcaaaacaaatggagatgatttgtccagggtgattggactagaggccaggacaaaaccagttgtcttgattggccttcttagtggataagaagtacctatatttactcccctccttcatcttttcctccaacccggagggacttgaaattatttgcattttgagtggactctctagctaatcaaaaagatgaatttggagtcctaaagttaaaatcacaatgtctaaatggcactcagggataaattatatctcactgtttcccaaaatgaccaggtaaaattcaggaggacatggaactttggaaattttaccagggctctggaaattctgacagttgatgtccaccattggccagctagtacctagaataggccatttaactggaaaacagatccttaagaaccactagttccatttactaaaacagccctgggtttgaggtcaaatcttgctctcattctgatagtaacttgctgtatgtccttagacgagtcaagtctcctctctgggctcatagataaaataaagaggacattctagattgcctacttcaggtttctttccagctgtgacattctatgattcatctatgattcttcgactctggcataggctgttatacctaagattaggatttccttaagaatgaaaagattgacaaatttgggtccagagcctctgatatggccatgaaaagatgccctgactctcagctgactcacactgggctccatcagtgctgacaactcccctaagactgagctggactggaaagctccccaaagaccacctctgaggagcaggcatctttattcatgtcctgtactgggaattatggctcaaacatgcggccatcaacaattatagaaaatgaacaggggaagactgaaagctgatccacctccaaccctgcctcctggcttctatggccaagcaagctgcctgtagagaggcagcagggtggggctgtgtactcatacaggagctgggtttttttattttttgtgccaaactccaatgtgagcacattagctgctgttactcagcctaggattgggactagaagaacaaaagattatttagtttatgtcagctagagttttctcactaagccaagggcttcattcttgggcagaagaggcagagaggattgcacaataaaactagaagtaaaagaaagaggccctggtgggtaaaagactggagtctgcttaaacctcagtagaccttcccctacccaaaattgacactgggcaggtgagttgaccacacagtagtaccataatgaatggaagagacctcaaaagcaggaccatgggtagcttcacaggctgtacactgcacaccccaggggtgcccttcagaggcattataacattgctttctggaattgtgtgcagtgcacaacctgtacatctgcatgagatagatccatcagatagccaaaggaggatgagcaaaaggcagttgaggggtctcacttcttctctctcagttgtagactgtagagccccaggagagctggaacacgggctgatcaccttctctacaaggaacaacctcaccacatacaagtctgagatcaaatactcctgtcaggagccctattacaagatgctcaacaataacacaggtaagccatccatgctaagccatcccactcccgtttcacactctcggggcctcagggttggactgggggccgagacagctgtgaaaggaagaactgctcataagtgtgtagagcctgataatgcaaaacgtgtcactcacacatctcaggttctcacttttcatgagcttgtgttactgtgtccatgtggagatgcagaaacagtctcaaaaccaaaaagcaggcttttttgtttttaactttaaagctagcactgatttactaatgagttgttggtgggagcgtgaaggagtcacacactgacacaactaagagaagaaacgagaccctaaaggaagcctggaatcccccaagttaaactccttcatgtggtctgaggctgagttggggtttccaaaaaaaggccagtattactgcttcacccagactctgccttggcttctgggtgagggcaacatctcaccaggccagacccattcagcaggtaagggaccttccttcaaagacctcttcccctggtacggacaggggtccaggcagggttggggagcgaggagtggatcctctgtctccccaggtagcccagcatatcccctgaccacagctcaagcacagccacagcagtccctgtccaggccccatccatgccacctggcagagacccctggctgccccaggggctgggcagcagcacactggccagagggtgaaggaccagcaataacctgaccattggccacactgggggtttgggaggaactgggaggagaaatgcttagagacataacccgcctctccctgccttgtggcagcccaacacccgctcacatgcactcatagtccctagcagaaaaggaactctcagggagaaaggagggcccatcggctctgcctctctggcatgcaagcactgagaacattctcctgactcatctaagcctccaactcctctttgtttttgtttttgtttttgagacagggtctcactctgtcacccaggctggagtgcagtggtgtgatgtcggctcactgcaacctccacgtcctgggttcaagcaattctctcgcctcagcctcccaagcagctgtgattacagaagcttgccaccatgcccagctaatttttgtatttttagtagagacccgcttttgccatgttggtcaggctggtctcaaactcctgacctcaagtgatccgcccgcctcggcctcccaaagtgctgggattacaagcgtgagccactgcacctggccccaagtcctcatttttaaaagagggaagagttacaaagctcttagagctatttcaaaatgccagtgagatggtggccacaaatgtatgcttattaaagagtctgtcaaatggagaagaaaggaaagggcatctgtgcaacagggagccatgtgagcccaggtctttgtgacaagtgaggcggaggtgccttccaggacctgggcagcgtggggtggggaggggagcagccctcagccaggcaggagtgggattccccagagctttggacagacaccatgctgaagagtgtggtgtttatttttgggggtgacagcaagccattcgtgattctgagctgagaaaggacatggtcacattcccattttagaaagatccttcatgttgcaaagggagtttgatagaaggactaggatggtagccctgtgggtatttgaagatatttggaggttaattggtccctttggaggattgtatcccagagagtacctgccacattcttcctcattcttcttagtacatctaggctcagagacaatcgtatctgagcctagatgaccatttggaggactttgtaataactcactttagagaaattaaatacccagatctattttccatgtgttacaaatcaaccattttctccctcctctcctaacctctttcactaatccaggtatatatacctgttctgcccaaggagtctggatgaataaagtattggggagaagcctacccacctgccttccaggtacctcaccctccaaatcctttgcctcacagttttccatccaaggccctaggaccccaggttttctggctgttaacagggtgatgggggacaggggaggtgatgctttggttgctttttaagagatgtcttcaaaaggttaaaggtcagagaagacttgcttcacaccttctcaaaccagcctgtattttctgcctgctccatcactctgagagccctcctgtcccgtctctgtgcccttgccacaagatttttcatataacacagtttgcatgtgcatctgctgttgtgccggggaaatttaaaaagtgggcaccctgtcctcaagcactcaccatgctatcaaggagatgataacacaaacaacatcatgataagacagagtgacaaattctttcttccaaacagcaacgtagtcaagcctttccgattcccatggtttacttactgactccactttaaaatggaaagaaaattttgtggtaacaggaagtgttactgtgcatacagattttgaggatatttgctttagcattaaaagtataggccaagcgtggtggctcatgcctgtaatctcaacactttgggaggccaaggcgggtggatcatctgaagtcaggagttcaagaccagcctggtcaacacagtggaaccccatctatactaaaaatagaaaaaaaaattagccagtcgtggtggtgtgcatctgtaatcccagctactcaggaggctgagagaggagaattgcttgaacccagggggcagaggctacagtgagctgagattgcaccattgcactccagcctgggtgccagagctagactctgtcttgaaaaataaataaataaatagtatgggtgatttgcattgcaatcacatgtatagctattcaagtcaacttagaaaagtgtagccccaaaatgcacactctacggttaaacaaataatccacaaaaagttaaatttaatattcacaacatagtaatttacattttttttaaaaaaaagcaagaatggcagtagtttaatgatacaatcactcaagacagcattgaggaatactgaaaattaaatgccttgtctaattccatctgcatgtttgcacaaacagcaggaaatttgcaatatggttaagcattgggtgatatttgtattttgctgaatgagagtgttgggtaaactgacatagtgtattatattaatggtacatttcagtaaccctacagtatacagtataaagaaggtatactagtacacggttggtatattagtctgttctcacactgctgataaagacataacccaagactgggtaatttacacagaaaaagaggttataggattcacagttccacatggctggaggggcctcacaatcatggcggaaggtgaaaggcacatcttacacggtggcaggcaagagagaaatgagacatagccagtttgggacatagccaaaccatatcaggaggtttctagatatcagattagacactaaaatggaaaggctatggagttgtctaccattcatccttaagaagcgaagaacatgttagcatttgggagtcaggttttgaccatcacaggtgctatgggatcccagagaagaaggaagtaacaatgcctggttgtctatgaatgaaggggtaagaactgactaggaagggttcacataagaggtctttatttctgagaaaaacttatgaggatgtggaataagggaatgttcatcccacccattccgctgattccatttacctcaattaggcttgcccagaagtacaaccaaggactccaggcagtgaagcctcagagaagagaggaatggcggagctgtagaggaatggtggggctgtagcaaaccagaggatctaatccccatttggctaaaagaccatgtgagcaaaaaaaagctagggatagattccatgctagaaagccatgtggccacctctggaaggggaagaagccctgggcaaggagtcaaggccctaggtactaatactgatgctgccatttcctaactgtgatctttggtaagtattttcatatctctgggtctgggatcccatacctcagaagtaaagcatcagaaccaagagacctatgatattctgaccttttttttgagacagagtttcgctcttgttgcccaggctgcgtgcaatggtgcgatctcagctcactgcaatctctgcctcctgggttcaagcaattctcttgcctcagcctctcgagtagttgggattataggcatgcaccaccatgcctgactttttttttttttttttttaatttttagtagagacggggtttctctatgttggtcaggctggtctcgaactccccacctcaggtgatccgcccacctcagcttcccaaagtgctgggattacaggcatgagccatgcacccagctattctatgacttttaatggtcatcatcctctatgtttgtacaaagcatcttggatacaatgagtcatgacattcttttaacacccagtgttgggcagaaccatggtgtatcattggactaggccagaaatttgtaaattctctcttcgcaaaacactgtgattgaaccaggatgcaggccaggatggagaaggccatctcatctattgtcaaaaggcccaccatttcaggggtcctgctaagcaaatattacttgcccttttattttataaatgagaaaactatcagaatagtgtagtgatttgcacaaggctacttgtagaaagtcaggggcagaactgaaaggtgaactcaatacttttgatggcaacataagcaatgccgagccatttttttaccatgatcatgttttatgccatcctcaggaaccttgaatcctagagtatcacatttttttaaagaccctccctcagtaaccactgtcctctagaacccaaatctggcttcagcatagccaaagctataacatttcaagaagatccctttctcccaggaaagactgggtggggaatggcagcagccaataagaatgaccccatttcaatgagctctcccaagagcttgttgaatcattcagcctcttaaaaggacaagaacacatcaaggagaaaaacagatttcagtggagatatgaagctagactcaggataaataggttcgagttctggctttcccattaacaaccttgagtaagtcacttgccttctctgaacttccatgtttccatctgtaaattagctgttctccaaggtctctccagatctgatctgtgacctgcagtgtgccactggcaccttggttggagaaaggtagcgtttaatgctggctttgttgtgaccatggaccaagccatagacgtgtcccttaccagattagggccttgaagcactaaatatatgtaggaccagtcacagagctgcattgagatgttgccttgcagcttgctacttgtaattggaaggctgaccctcaactttgaaaggccaggccacagagagttacaaagaccagttcacatctggcctggggtgaatggcagggtgccccaggatcaagcaagaagcatctggcctcaggaagaagagcatctgaaaagcattaggttgctaaaagcctgctctcccaaagttgccaagaaaactcaaatgttccatgatgtctaaaggattgtcaaaagcacccaggccaaggagtgtagcctggccatttggaaccaggaggaggcccacactcatagtaggtctacctccaagacccaagcaccctgcctgggaagggccatgcaagcatgttcttagccagcgggggcctggtgccgaagaccttctgctcattggccagaggcatttggctacaggaggctggtggtgcatgtgcatgctcagggtgcaactcagtggaacgaagtttgctcagatctttctccttcccctaaaggtactacacagctcctgggtgcaatgatgggtggcccagagtagggtccatgcatcattgcttatagattatgccacctttccccaaccctggatgccctggggcttaatccatgggcatcaatttatagcaagattctgttaggacagagaagaaaaggtttgagggcctatgcccatggtcttaatatctgttaagtccgtgtgggatacaagacttagaatctagttaagcttctgctatctgacttaagagtcatatccttttgggctagtcacttaaactcaggaggtttactcacctagaaaatggtgatggccaaggcaaataaaatgaaaattaaaggatctctggaatttgaaggatccctggagatcattgtgaccaaatgcctcatttggcagatcaaaaattgaaatccagagagggatatttgctgactcagagttacatgggaaatggaagagaaaagccaggccaaggcttccagcatctttgttcccagtctagcgtttgctgtgacctgctagatggttttttaggttccttccatctctctgtccccatggacagaaaactttcagaagtattctaggttcccatagcatggaccacttctgaaataagacctgcctttctagagaaggaaggggagaagtgaccactactggaaatagatggctgtaaatggtctgggtcacaagtggtcttagccagaggtggttcagggtagagaaagcccaagcacagagtggtccagtccagagacagtcccagctacagaaaagccagactagagatgggccagcctagagagacttagacccaaaatgaccctgagtagagctctcccaggctagcatgacccaggcaggttagggtcccatggtggcataatctatagtgggtgaaatgtgaatttatctttgtggctcctgtcacatggctgacctgaccagtctctgtctcttgtccctgctccctctttctccttacagagtgtggtcagccctcccgctccctgccaagcctggtcaagaggatcattgggggccgaaatgctgagcctggcctcttcccgtggcaggccctgatagtggtggaggacacttcgagagtgccaaatgacaagtggtttgggagtggggccctgctctctgcgtcctggatcctcacagcagctcatgtgctgcgctcccagcgtagagacaccacggtgataccagtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagagcattcaggttttgggagatggctcatagccaagcccctctctcttagtgtgatcccttggagcaccttcatgcctggggtttctctcccaaaagcttcttgcagtctaagccttatcccttatgttccccattaaaggaatttcaaaagacatggagaaagttgggaaggtttgtgctgactgctgggagcagaatagccgtgggaggcccaccaagcccttaaattcccattgtcaactcagaacacatttgggcccatatgccaccctggaacaccagctgacaccatgggcgtccacacctgctgctccagacaagcacaaagcaatctttcagccttgaaatgtattatctgaaaggctacctgaagcccaggcccgaatatggggacttagtcgattacctggaaaaagaaaagacccacactgtgtcctgctgtgcttttgggcaggaaaatggaagaaagagtggggtgggcacattagaagtcacccaaatcctgccaggctgcctggcatccctggggcatgagctgggcggagaatccaccccgcaggatgttcagagggacccactccttcatttttcagagtcaaaggaatcagaggctcacccatggcaggcagtgaaaagagccaggagtcctgggttctagtccctgctctgcccccaactggctgtataacctttgaaaaatcattttctttgtctgagtctctggttctccgtcagcaacaggctggcataaggtcccctgcaggttccttctagctggagcactcagagcttccctgactgctagcagcctctctggccctcacagggctgattgttctccttctccctggagctctctctcctgaaaatctccatcagagcaaggcagccagagaagcccctgagagggaatgattgggaagtgtccactttctcaaccggctcatcaaacacactcctttgtctatgaatggcacatgtaaatgatgttatattttgtatcttttatatcatatgcttcaccattctgtaaagggcctctgcattgttgctcccatcaggggtctcaagtggaaataaaccctcgtggataaccaacagccttggcttatgggttttgttattgttggggaagtgtgttcatttgttttaacttttttgaaaagaaattggtctcctcattaaaccaaaatctcccttgttgcagaaaaagtacaacttttggtatctggacattatccaagaggtaatgaggaaaggatttggttattgatctgtctccttctcagaggctacttgttccttcatttaagtgcctgccatttaagtccttgtcttcaaaggacttgagcctgaaggcccaaccccccacacgctgggcctggtgactggctagggcatctctagtcccaatgtgacattggacgagatcatcagcagtggcacatggaccttgtcagatgccctgcagtatgtcaagttacccgtggtgccacacgctgagagcaaaaccagctatgaatcctgctaaggcaactacagcatcatggagaacatgttctgtgccagctagtttctagtaccagtttcaaagtgttgaaactggcatgcaagacaagcttatgtgcatgtaggtcttatataggcaaaaggagttaaatgtaaaaggaacagagatttaagtactataggaacttaaagaaggggctatatcatacagctggaggggcttggaatagctttgcagaggcttcaaaggatgtgtgggagataggagggaaggggcagagtggaaaaaagcatgaaagctggccatggttaaagtgagagcagtgggcattgagtgggaagagttttaaagggcatgctctatttgaactgtcctgaaacgagtgattctctaagtttggggtatatgagaatcacttggggtgctggtgaaaaatgcagatggctgggtctcacccactggaaaatttgaattcagtatgtctgagggtgggcagcatggtgtggaaagtggacaggaaggggctgagctaggaaagcagttatgcaacttctgcaactgtcctgatgagggatggtgcagacccaccacccatagggctgtgacagtgcagacaggaggaggggcagtttaaatcgatttaagtggtacatacagcagggcttggcctataggcatctcttgataagttcaagcatgagtggcacgtgatagtgaagtctcaccatgggacgcactcatggttcgcctttgtttttggtttgtaccataatgaaaatgccatcctttttacactattgagaatgaaaataagagcttatttacgctttgcactttatggtttgaaggactatcgtgtctcatgttctattacatttccaatttttgtttttcttttgatacttggactttatgttgtgacatattgaggtactgaggtattgaggtactgaggtactgaggttgtgacatattgaggtacatagagagcactttgtgacatggagtcggggagacacatcactctccttctcctagggatttaccagcagctcagcgactgattgaacatggggttgaagaaaagggaggcaacaaggatgtgattgattcagacattagcagacatctggaaaaacaaaggggagaaggttagtgaagggtggatacttgggcttggattcactgagctggaagagtttatgagcaatccagctggaaatgtaagtaggcagtaaagaatggtgagttttagaggacagggcagatttaaagacactgatttgaagttcatcagcacatgggtagtatgatggcatagaggtagagggcatcatctacgggaaatttacagataagaaaaggataccaaggcctgaaacaccagcatcatggaaggcatgaagaaaagagaggccccaaggaaaaaaaaaggggggggggggaagggatcagaaacacagggagaaaagtgcttcagaagccaagaggaggagttgtaaagagggatgaagtagtcaacagcacccaatgctgctaagagtcccaataaaggactccaggatggaagttccctaagagaggaatcaagtctctatcatcatccctgaggggtatgcaggcaggaggctccatgtgtgagtttcaagtctctaggacttctctcttcctttgtcctctctctctcggtcctctctctgtactccctccttcctctctctccagccttctcagtctcccaggatgggcttttagctcttttctcagaggtaggaaactgcccatgcatcttccctaagccttatggtaaaaattacatgttcagttctccatgttttggttccttgaaacctacaaattttttattcttactatgaagcctgactcttcaaaatgaaagtccgtcttaccagactttggtttctgctttgctctttcaagtcaaagctttatccagcctttgcttaaaaccgtggatgctccagcttcaatggcttgggagccacagtgcacagcgaattcctagggatgcaaaatgtatctgataagattcaaaaaatagtatcctactctgtatgtagatatcatggttggagttccatttatggtctcagagacattttatttccatctatttgtagacctgttaaatattcaaatggctgcctatttccaagtttgtgcagtacatggcactttcttcttctgaatccggctccaaagggggaggaagaatgtgggaaaggagtgtcaactcgtcttttcagaagctttactatagaagggaggagaaggagagactgtggaatgaatggcaaacggggaaatggaagctgatttttaggatgaaaagtcttgactgtgttttggaggcatagaataaggagagatgaaaaatacaagagaggggtgacagtctccaaggccaggtctccaagagttcaaaagttaagagatccagagtgaaaaattagttctgaagacaataaagtttataggaagaagagatggtgaggaggatggttcccattcagtggggttcccactcagggagttcccactcattgggctctgagcgtctgttgggaatggaggcagggcattagcttggggaagctggctgtgggcatgtggaatgatgctgggagatgctgaggctgcatcaaggttgtggatgcagagcatttatctgtgatattctccagcctggtgacagctacaaaggtagcaggtgactgcctggatccaggggcttgggttatgagtgttctgggaagccacataattaaaagtttatggggctggccagagtaagaaaagcccagaattgggagtcaggagacctagaactatagtcttgctactaactcatggaataccttttggaagtcaatttccttctccaggccttggtttctttagctgaatgatgaaaagtatagaccagatggtctccgagggctattcagttgtaaagtgtgtatgtgggagcgtgtctgtcaatccaagccagtggaaaatgggatggagcaggcagacactgtggtggaggggatcttcaactccacaaggccctgaggaagggcttctctgaggagacaagattcatgtggctggagcataatgattctttattagctgtgactctttcatttgtaagtgacataaaccaaacataagcagcttaaggggaaaaaagggaatttataggcacacataactgaaaaggctgtaccaaaaggcttcacatataattagatcaaagggctcaactattagggtgcaatctctctgtctctttgtccctcaactttcagctccacttttcttcatcattctcagcagactcttaatgaagtgattgttggcagatctgggcttatggctaatagcttggcaattccagtagggaatgactttctcttctgtaatatgtttagcgaaattctcaagtaatgctttcattggtccagccaaggtcacattcccatctctgagcaattgctgtgaccagaaagtgcatggctttgatcagtcacattcctatccctgaaaccagaggtgaggtcaatccaactctagctgcatagactaagaataaggaaagtgcagcctccaaagaaagactgggatgctattatcaggaaggtcaattaatggtggaggagcaaaaataatagatgttcctaacagggtgaggagctgggagctctggcagtgggcaagatggagcccagagtctgatctgtctctccctccctcccttggatgcagtgtgtgggctccccaagttctcccggaagctgatggccaggatcttcaatggacgcccagcccagaaaggcaccactccctggattgccatgctgtcacacctgaatgggcagcccttctgcggaggctcccttctaggtagggagaaggtggaaggggtggaagctaaggaactgaaccccctccttggagactgaccaaggtttcttcattgagaatcattgtgcacactagcatcagggcacagaagcacagtgcggtagaaagagttctcggctagactggatcctggtctgtctctggcaccgggaaggacaaagtcagggagtctctcaaccatgaatttaacagtacatggaggtcaaagacagggcatgccagggctgtgagttcagggagagccaggaaactcacccttgggaatcagggaaggtcgatttacaaagaccttgaatgctatgcttaggaatttttatcttgtcttgaacgctgctttaggttgataagtatgctctggaaagttctctccagaggcagcaatgataaaaaggagggtgaaactggaggccaggagatcagtgagacatccattgcagtggtggggagagaaggcatagcctcagagtaagaacagggtatgatggatggaaataaggaggcagattcgataacactgggaaataggactgtcacctttgtaatggaatgtgggtgggagtgggagcaagaatgagaacagccgatggctctccctgacacagtttggtccaggcaatctaagatctattccagttctgatgtcaaaagaaaactgaatagcaatctaggctatctagaccacttctgcatcggatcccacccccaaggaagaaggcccggcttggcccatctctgcatgagcaactcccaggctgatgggcatgcctctcactctgccccaccctcctccagatccaaccaggggtggacagctctggggcagggatccctttggcaaggcatcaggtctgggctagagctgcagccaaagcaccagggctacataaatccctactctgcaaggaatttatccttacattctctcagacccaaagatgaatggtctcactcaaagaagtcccccagagaggtaaagagagtgagggaaggtattatagggccagacagggctgagggcagttcagtgggagcagagtcggggagaggaccaagggagagaagggaagggagacagaggaccagaattagaaagacaacaatggagaggacagagagagacagagaacactgagagatacctggaaaataagatagaggattgaagagagtaaagagaaaaatgaaagggaacaatacaacaagaggaggaggtactggcgggcacaagatacccaggagagaagaagccagggaaggagggacctgaagggaagttggagagaagcagagtggtgtggaggaagagctgccagcgagggcagagggagggaagactctgcttcaccagacagctccgattttgttagagggcaagtaagagagatggattgtgtgcacctaattttaagaatgaattcattttcttaaaccttgattttttttttttttttttgagacggagtctcattctgtcaccaggatggagtacagtggtgcaatctcggctcactgcaacctccgcctctcgggttcaagccattctcctgcctcagcctcccgagtagctaggacaaaccttgaatttttgagtccactaatgtccaccatgtattgtgattcattgtatgtttattccctatgacttatgtttgaaaaatgtttgacgttcacttctctaccctcggccaagctggaatgccctcatacttcgcactccctgcagcaaccctgatctatcatttctgtctccctcctgtcattcagtcttaaagagcaggggaaggataggagagggcagaagaaacaggaaagcagccaagggacagaggaaggggaaagcacctcattaatgcccacactgacacctgggtagagggatctgcagagctgggaggccaagccatgtctctgaactggccagtgtacacccctgggttcatctaaacagcccagagccccagaccaaggcaggctgtcctaacctgggtacctcagcccacctgatccacctggaaaatctggtcctggacatgggcagggatcaaaaaatgccccagggcagagaagagtggcctaagtagagccctggccaggacccaggagcacatagctgcttctcagagggccaagtggagcctggaacctgctctgagactaagcacttctgccctcgaccctgaactttgacctgatactcagcctcccccacccctgtgttctagagcttttctttctgcttggctcatcttggatatgtctctgggctcagccacttatgggcttgtcatctgctccacataagaggtgaatggaagcctgaccctgcattaaacgaagggcagatgcctgtccatccagagaaagatgacagctgagacacaggaaatgcattaagctgactatcaggagccctggggtctggccctggccctgaccctgaaaccaacctgctgggtgaccctggacatctctgctttctccacgcctcagggttcctgcctatataatgaaaggtctagatcagagcagtgattctccaccctggcagcagtagaattaactaaggaaatgtttaaaacattatctgtgcttgggctccacccccatgacataaatggtctagatataggtccagacactgatttactcttttttcattcaccaggtaattctaacgtgcagccagtgtaggtagcttcggattcatcaattttaaactttaatatgcatacaaattactggagagtcttgttaaaatgaaaattctgattcagtggatcagaggtggggccggcctaagagtcttcatttctaagaagcctccaagtgatgctaatgttgctggtccaggcaccacactttgagaagcaaggcctgagaaggcagccagttgaccacaggctttctgtgcacccaccttgggctctctggctctcaccaatgccatgggcttaaaggatccctgaaatcctgtttacaatgttcagtcctggccttggttggaataggcaggtaaaaatcacagatttaaatcctcatcttcagattaggatcatatgagcatttgagttgggggccataaaatacaatggagagaagcatggccattttcaaggtcttgaggggtcctctggagtagcctgaagatcctcagctcaagacagagggaggcaagacccagtagtgcaggacgatgagacgtgtgttctgttccccaggctccagctggatcgtgaccgccgcacactgcctccaccagtcactcgatccggaagatccgaccctacgtgattcagacttgctcagcccttctgacttcaaaatcatcctgggtgagtgagtgaggggcaagctgactcccaaagccagctgtggttctgggaatgacctactggccctttccaaggcgtgtctgctcactcactcgctcactcatttgtcagggcaggacacctgggatggaggtccaggaacctgagtccaagtgcaagatatgattctccagacacgtgaccatgagaaggcattgaagtctatgcttcagtttcacaacgataaaatgaggaggcctctagataatttccaaagacctgttagatttccatgaacctgtggtttcaaatagatcatacatatacgatccagatttcccctcttgtttataaaatcagatgaccagctgattcaattcaggtccacacatatttacctactgacattatgccaggatctaaggacacagtatgattaagacctagtttctgcccacagggagcttacagtctaataaaggaataagatgtgagcacagagacctctaacggaaagtagccagcagtaagttttgtagaagaagaacagataaaatgccatgggagttcagaggggaaagacttctaacccaagagtctgagaggctacctggaggaggtcatgtttgacacaggcactgaaggtgatgatagggattgaacatgtggcagcaggcatcagaacaagcattacaaggcaacagcatcagttcctgaagaaagacagaggtggggacccatgagattatgtagagaatgaccaatagggtgggatgtctgggaaaggtggatgaaggcagtgaaagggctaaggctggaagcaagggctggatggggctggggcgggggctgacagggaacaaggtgtgaccttatcctccattgcacccatgcctcacatgtcttcttcttgcccaggcaagcattggaggctccggtcagatgaaaatgaacagcatctcggcgtcaaacacaccactctccacccccagtatgatcccaacacattcgagaatgacgtggctctggtggagctgttggagagcccagtgctgaatgccttcgtgatgcccatctgtctgcctgagggaccccagcaggaaggtactttcccctacctccacctctgcagggcagctggtgcctccacaaggagtccgtcttcacgttggtgaagctctggtgccaattaagtcagctgacagtgtctgcttgactcaccaactgcttcccctcaaacagccaagtcagaactgggtccaaggcagcaaaagttgtgggaagcacatagtaaacagtcagacctaagggtccagatagaaaaacaaaaactagactagttatcgtaacagagagaatttaatatagggcactggaggattggagaagtaagagggaagagctgagatcatagagatggtacctgcaggaagaaaccaccaaccctagggctggggaaacaaaggtaagaacctggagttagaaattagaagcttggaaaaggggccctatggggccagaacctgaaccgctgcagaagagtctaacgtgctaaggaaaacagctggaaacaatggccactactggggtgaaaaaccactgccagggatgatgccaacagccaaagcaagtcttcctgcctttctgaaagtgccccctgttttcaggaaaccagctagcaaagtagaactgcccacttcagagtctcatccctagtaccacaaagcagaatgtagaagggtaagtctcaagctgggggacaatggcttaatactcagcacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaatactcagcacaggctcaaacaccactgtgaccatttcccagctgggtgatcttcaggaagttatttaacctcagtaagcctcaatccccttacctctaaactggagatgctatcccatgtggtggctgtggcatttccgtgtttgagataatacttaaacataggtgacccatgtcagctggcttccttttcattctaatttcagtggtgccacatcaagttcacttcctttagctcaaaagaaaaatggctgagatgtaatctgaggagtatttaggggaactgagccaacaggaaaggcacaggtgtagctggctttgactcattgggtgccatgtgcccaccaggtgctttatgttcattaacttatttacgaaccatgcaagccttgcaaggtggcactgtagcctcatttacaaacgagaaaactaaggatcagcagggtgaggtgactcacccgagatgcagcttgtatgaagcagatctagggatatagtacaggttttctgactttaagcccaacactgttttcagtatccaggctctttttcaaatgagaaaataattgctctgtcagtgctcaacccacttccacattgccccacagatttaccaacttcatagacttctagaatgtcaactctgaaaggggttttagagaataccaagtccagcctcctcattttatggataggaaaacagaggcttagaaggggagcagagaggagggctggctaaaggcaccatagcacatagtggactaggctgggctttttatttattcgctgttcttgattgagcacctactatgtgacagcattgctataggcactgtgatatagcagtgaccaagaatgagattctgctctcatggaccctaggtttcagactagttgagggtgggacagaatagaaaactaaacaagtaagccagtaacacatcatagaaaccagtgcccctagctctgctgcaggtaatctgtagcccagctgcctttcacgtcttcctccccaccacaccacctttctctgagaagaacaatccagtctttcctccacagaagaggatgatggagctgcaagctgcacccctccaaacaccccacagatagcttctctgttctcacagtatcttctctcctccaggagccatggtcatcgtcagcggctgggggaagcagttcttgcaaaggttcccagagaccctgatggaggtgaagttcactttataacctacagacagtgacacctcagctctgcactgggccttcctgctccgtattgttcccttagggattttgaggcttgggtgggggttggtgagtgggaaactaggagcccagacccacctccaaagttcaatgggactttgaaccccagaaagcttgatttgtttgttctacatgtcatggactctagcctctaaacacggttaagtttttctggtagcttattaaaggcttagcttatgaaaattctcccagaaaacagcaagtttagacacccccatggtgacaatccagctgtgcaccatgagaactgtacaccaaattggccagaatgagccaggctcttgagaaccacagtccttgcagtaatgaacttggcagttacacttagaagttcatattcctatcagttcaaggaaaaaaaaaaaaaacacttaactaaaagtaaggagccatagtttcaagtcttggctcccactaacttgctgggtcatctgaagcaagttattttgcctctctagaccataagatactatttccaactgcagagttatggggcaacacgagctgccatcaaagagttgcttggctctgatatcaccggggcctatgactgacacagctagtttctaaattcttccacatatattattttgacatattttaaaatttgggatttgcaacaaccattcatcccttcattcactaactcccgggggtctatttggtgtttccttggtaccagacactgtactagctactagctgtgctggggtaaaaggatagatctggtccctggcccccttgggctcatggtcaagtggaatggacagaaagtagttatggatgtgataaaggtggagagagagaaatgcaggatgctccagaacatatgaaagagaatctgatcttgtctcaggggttcaggaggcattcccaaaggaagtgatgctgaaatgatacctgaacgatgaatcaggtgctcagcagttgctgaggatctgtcctcaggaccaccctgccctggcttcctctccccttatccagggaaggccatgacccaagagggatctgaatggcctctggtttcctcccagcaagggcaacaggagttgtccatttagagaatatggcccattcagttcttgatttgactgaaagagaatcatatgtttcctctttttattccagacatctactccaacagttacccccacactggatcaagggcaataatagtcacaatgccttatttttatgtatcgattttgctgcattgcaaaaaatatatatattttctgggtatctactaagctccaagcaatgtaagatagaaatgcataaaatacagatccagcatcgagacagatgctcatactgtagagagggaggacaacataacaaagtgcttgctgcaaagccagcagtgataactccacagtagctaatatttatacagtgtgtgtagtttacaaagcacttgttcctgcctctcctctttgtacaatgattagtatatcaaatactgcaacctccatttttcagatgaggaaaaagggtctcagagtctgaaaaacaatgagtaagccacatgttctaggtcctacagtaggggtgagacaaaagaaaaccaaacttcatttttgtatacattgtcctattgactaatacatctcctaggcaagtattattacctctatcttactgaagagagatctgaggcccagagagggcatgtgacttgcccaagttcacacagccaaggtcttcacagccaagactgccctagaacacgggcctcctgattctccattcaactgttccttcacctgtagcatggggcagtctcttagatcaagtctaaggtagacacaggtccgtccaggtatggagtggagaggagccgtcttcaggggtgtcagaatagcagaggcttctcagccggggatgaggaccaataacagctttgtgttctagattgaaatcccgattgttgaccacagcacctgccagaaggcttatgccccgctgaagaagaaagtgaccagggacatgatctgtgctggggagaaggaaggtgggttaagaggctggcatacaacaggggcgctgccagccagggagtggtgcagagccagcaagggagcacagaggcctcccaacctggtgggctggcagtgtgggggcgcgggggactggaggaaggccgtgggaggagggattccacaggagaagatgcatcggagaaaagatatttacaggatgctcatcattcccttcccaagttcagtgtttcccttaagaaagaggccttggccgggcacggtggttcatgcctgtaatcccagcactttgggaggccgaggcgggtggatcacctgaggtcgggagttcgagaccagtcttgctaacatggcgaaatcccatctttactaaaaatacaaaaattagccgggcatggtggcaggtgcctgtagtcccagctactcgggaggctgaggagggagaatcacttgaacccaggaggtagaggttgctgtgagccgagatcgtgccactgcactctagcctgggtgtgacagagcgagactccatctcaaaaaaaaaaaaaaaaagaaagaaaaaagaaaaagaaaagaaaagaaagaaagaggtctgaatcagggctttttagaatcatttgagctctgatgcggcctgacctagaactgcccagagctgaggtttgggtccaacggtctgctatgccctctagtgcccaattctctgaactacaacccatacatgggagaaggagacttgggctgggaaggggcattttatcttcatctatgtctctttttcacctagggggaaaggacgcctgtgcgggtgactctggaggccccatggtgaccctgaatagagaaagaggccagtggtacctggtgggcactgtgtcctggggtgatgactgtgggaagaaggaccgctacggagtatactcttacatccaccacaacaaggactggatccagagggtcaccggagtgaggaactgaatttggctcctcagccccagcaccaccagctgtgggcagtcagtagcagaggacgatcctccgatgaaagcagccatttctcctttccttcctcccatcccccctccttcggcctatccattactgggcaatagagcaggtatcttcacccccttttcactctctttaaagagatggagcaagagagtggtcagaacacaggccgaatccaggctctatcacttactagtttgcagtgctgggcaggtgacttcatctcttcgaacttcagtttcttcataagatggaaatgctataccttacctacctcgtaaaagtctgatgaggaaaagattaactaatagatgcatagcacttaacagagtgcatagcatacactgttttcaataaatgcaccttagcagaaggtcgatgtgtctaccaggcagacgaagctctcttacaaacccctgcctgggtcttagcattgatcagtgacacacctctcccctcaaccttgaccatctccatctgcccttaaatgctgtatgcttttttgccaccgtgcaacttgcccaacatcaatcttcaccctcatccctaaaaaagtaaaacagacaaggttctgagtcctgtggtatgtcccctagcaaatgtaactaggaacatgcactagatgacagattgcgggagggcctgagagaagcagggacaggagggagcctggggattgtggtttgggaaggcagacacctggttctagaactagctctgcccttagccccctgtatgaccctatgcaagtcctcctccctcatctcaaagggtcctcaaagctctgacgatctaagatacaatgaagccattttccccctgataagatgaggtaaagccaatgtaaccaaaaggcaaaaattacaatcggttcaaaggaactttgatgcagacaaaatgctgctgctgctgctcctgaaatacccacccctttccactacgggtgggttcccaaggacatgggacaggcaaagtgtgagccaaaggatccttccttattcctaagcagagcatctgctctgggccctggcctccttcccttcttgggaaactgggctgcatgaggtgggccctggtagtttgtaccccaggcccctatactcttccttcctatgtccacagctgaccccaagcagccgttccccgactcctcacccctgagcctcaccctgaactccctcatcttgcaaggccataagtgttttccaagcaaaatgcctctcccatcctctctcaggaagcttctagagactttatgccctccagagctccaagatataagccctccaagggatcagaagctccaagttcctgtcttctgttttatagaaattgatcttccctgggggactttaactcttgacctgtatgcagctgttggagtaattccaggtctcttgaaaaaaaagaggaagataatggagaatgagaacatatatatatatatattaagccccaggctgaatactcagggacagcaattcacagcctgcctctggttctataaacaagtcattctacctctttgtgccctgctgtttattctgtaaggggaaggtggcaatgggacccagctccatcagacacttgtcaagctagcagaaactccattttcaatgccaaagaagaactgtaatgctgttttggaatcatcccaaggcatcccaagacaccatatcttcccatttcaagcactgcctgggcacaccccaacatcccaggctgtggtggctcctgtgggaactacctagatgaagagagtatcatttataccttctaggagctcctattgggagacatgaaacatatgtaattgactaccatgtaatagaacaaaccctgccaagtgctgctttggaaagtcatggaggtaaaagaaagacc

SEQ ID NO: 37938 - DNA, 7321 bp, Homo sapiens
ggtccttcagcctcgttcccgggcagtataaagtttgctgtctcctttgttcgccctcgttgcgcagtagtgctagcggcttcgcggttcggtcctcgcacccggcagccgccactggtgctgagctgctaggaagcccctatcgccgagctcgttggagcttgaacccattgtcacccctccggtacgtgtctcctttcctcagtccgtttttcgtgacactctccccgtgttaggactggggattatatctccctggagatgggggtggcgggcgccattttaagaacccaaaggttccgacctatttaaataaagctgagggggtcgagggaaaacaaatgagggggcccgtttggttgtatgcttctcgagaaagtttggctgccatctgcgggagttggtagcggaggtcggggctttgtaggctggagcggggcgaggagcgaccgcaccacggcgatacctgcattggtatggcgctggcgctaatgatgggcatgtggacttccatgcgggctgcgggcttcgtattcattggcggccccggagaagaagccctctgaatgttcccagccaatgttggtggtaaaagttagtcccctgaccagtgtcggtggttctgggttgaatccaagtgtcgccattttgtcttttacacgcggtttttaatgacgagttttaattaggttccgctgcagtcacggagtgtcgagtgttagtgtgtgcgtccgcgttccgttacttaatagcaaacgatgttgacgatttgtttttatctttttggccggatagtagaattttcggtagggcgggggccggtgaagaagaggggcggcataacttggcttaaacttcacatttctccttggatttagtagggaatcctaatgaggaaaagaggagtcgttggaagagggcttggtgttaaggtcctgtgtctagcctgtgaccttgggagtcttttaaaaccatcgttaggaagggtgtgatgagtaattgaatctttcaaaggcaagaggactggaactaaaagttgctttttcaaatgttaagcagctgttgcttaagaacagctaagggtgatcaagggtagtggtaaaagttaagttggcccttttaaccagttttatgtaaattgcagtgttactaaactacttagttcaaattgcttcctactgtggctgaggcttagctcgttatcgttttctttagttattaaggaacaatggttttagtggaaaatatgagaaatgtgcgaaagtaaaagtgtccaataaacttgaggaactttttgcagtgaggtaatactattccttttcaacagactcaccggcccaaaaaaaaaaaaacatggttgaagcagatcgcccaggaaagctcttcattggtgggcttaatacggaaacaaatgagaaagctcttgaagcagtatttggcaaatatggacgaatagtggaaggtgagttgtctggcagtacaggctgggctattataattaaaatataagctatgatgaatttgattgcattgatcgtctgacatgataatgtatttttgtcctctaagaagttctgagctttctgtttacacatttactttggttatttcatttgacctagggtaacactttatttttctgaaaactactttttagtactcttgatgaaagaccgtgaaaccaacaaatcaagaggatttgcttttgtcacctttgaaagcccagcagacgctaaggatgcagccagagacatgaatggaaaggtgagattgtctacacgatggatgataacctgttactagtgcataaaataacatgtagttgtccaagtctggtctaggacagcttttgagttttcgttgtttttcagtatatacctgtctgggatccactcatcctgtttgtgatcctgttccaaagagtattctgtaattgcagaaccaaatctagtagtgagttatatcttatgctcgtaacattctctcagttcagaataattatggcattacatggtacttttttttttttttttttgatagtctccctccgttgcctagcctggagtgcaatggtgcagtgcccactgcagcctgtctcccgagttctaagcgatttttctgcctcagcccccccccccccccccagtagctgggattacaggcatgcgcgaccacgcccggctaactttgtatttttagtagagacagggtttcaccatgttggccaggctggtctcaaactcctgacttcaggtgatccagctgcctccgcctcccaaagtactgggattacaggtgtgagacactgcgagccactgcgcccagccaacatgatacattttatcttgagatccataagccatattttgataacttggcttttggttttggctactagttttgataacaagctgatacctacttggccttgttttaaattttaccatacaataatgcagtgggttcaccttatgtttcaatccagatcatcagtatcggttttaagtattaagaattttaagcggaaaagccccatttatgtaaactgactatatttgcagtgttttttcttagactaatgagcaacacttacccataactgcattttgaaggaccagttagtgtcttagtgcatagtagatgtgcaaattatttttaaatcttgatttaatttaatcgtatctttttttttagtcattagatggaaaagccatcaaggtggaacaagccaccaaaccatcatttgaaagtggtagacgtggaccgcctccacctccaagaagtagaggccctccaagaggtcttagaggtggaagaggaggaagtggaggaaccaggggacctccctcacggggaggacacatgggtaataacttgcgtggacctcgggtttggtgtataagttagggactgcaagctcacaccaagtggatgctttggttaagtccttgaggaaaggtgccaacttttgaaattgacaacacttgttcatctaccaaagtgattgccaattgaaagcatgggaagcatgttttagattatggtgttaaaccgtggacagtgttacttcttgtccaagtagttcactctgtaggaaaggcatttaaaaattgataggccagggtgttggacatgaaaatgaaatcatttttattttttaaagttagctgggcgtggtggcaggtgcctgtaatcccagctactacggaggctgaggcagaagaatcacttgaacttgggaggcagaggttgcagtgagttgagatcgtgccactgtactccagcctgggggaacagcgagactccctctcaaaaaaaaaaaaaaaaagttttttaagactaccttcagttcttatttccccagtttctatgactgcagtgcatgctccatcaagtacaagtgaaactagactacccaaatcaataatggtttttttttgggggggggggggtagagtttagcacttgttgcccaggctgaagtgcagtggcacgatcttggctcaccacaacctctgccttccaggttcaggcgattgtcctgcctcagcctcccaagtagctgggattacgggcatgcaccaccacacctggatttttgtatttttagtagagacaggattttaccgtgttagactggtcttgaactcctgacctcaggtgatccgcccgccttggcctcccaaagtgctgggattacaggcgtgagccattgtgcccggcccaataatggtcatattcttgatgaagcaaagaaaacttttatagtggccgagcctggtggctcacacctgcaatcccagcactttgggaggctgaggcaggcggatcacaaggtcaggagttcgagaccagcctggccagcatggtgaaatcctgtctctacttaaaaaaaaccaccaaaaattagctgggtgtggtggcgcacacctgtaatcccagctactcgggaggctgaggcaggagaattgcttgaacccaggaggcagaggttgcagtgagccgagatgaagccactgcactccagcctgggcgacagtgagactctcaaaaaaaaaaaaaaacttttatatctttcttgattcttgtgagtagtaatatttttcttttctatttttgatgcagatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagaggtaaatgttccatgtatgatgatttatgctactaccgtaacacaaagaattgagaggtgaatgatgcttaaaattttaattggccaggcgtggtggctcacgcccgtaatcctagcactttgggaggccgcggcagacggatcacggtgtcaagagatcaagaccatcctggccaatgtggtgaaaccccgtctctactaaaaaatacaaaaattagctgagtgtagggcgggttcctgtaatccccgctacttgggaggccgaggcaggagaattgtttgaacctgggaggcagaggttgcagggaaccgagatcatgccactgtcctccagcgtggcaacagagtgagattctgtctccaaaaaaaaaaaaaaaacaaaaaaaaaaaactttattcatggagtctgggtgcggtggctcacgcctgtaatcttgacactttgggaggctgaggtgggcagatcatgaggcccggagttcgaggccagtctggccaacgtggtgaaaccctgtctctactaaagatacaaaagttagctgggcgtggtggtgggcacctgtaatcccagctactcgggaggctgaggcaggagaatcacttgaacccagaaggcagaggttgcagtgagccaagattgcgcgactgcactccagcctgggtgacagagcgagactcccatctcaaaaaaaaaaaacaaaacttttagtcatgtgttctaggtgattagataaatggaattagcactgaaaaaaatttaaaatatgaatgggaaattgtagaaaataaaattaggtgatctagcctccgtaatgtcatctttgaagtcagtctcattatttttcatagcctgaatgtaagttcacgttttaacttttttctctggctatgtttaaaaaaatgatatttttccttaagctcctgtatcacgtggaagagatagttatggaggtccacctcgaagggaaccgctgccctctcgtagagatgtttatttgtccccaagagatgatgggtattctactaaagacaggtaatagaaaagtgcagctttttaaattaataattaaggttgaaggaaagcttatcaaaagcataaaccaaaacttttgctttgtagctattcaagcagagattacccaagttctcgtgatactagagattatgcaccaccaccacgagattatacttaccgtgattatggtcattccagttcacgtgatgactatccatcaagaggatataggtaagtgactttgcttctgtggcttacatgtaagaaaagttgcaatgaaagttgattctctgggacttaaaggtttctctttaatttagcgatagagatggatatggtcgtgatcgtgactattcagatcatccaagtggaggttcctacagagattcatatgagagttatggtaagatactggttaagggtctttagtatcaccagcttgagtttttaggttcgtgagccagtttattaggctgtgtggtgcttgcttttaaagggatgtttgcttgcttttaaaggggtaactttatcagctgggcttttcctagttttgtgaggggctttttttgtttttctaagtttcttttgaggctgtttgcttgctttggaggggattttgcttgcttaaattggcagccttatgtgttttcccccaacagtgaaaatacaatttaaaaattttattaacaagatcaaatatttaccattgcaatatgaaggcaagttctacagttcaaaattgcaacttatcactggaaagtggctgagtgtctactataaaataacaagctctctggaatatcctcttgaaatacacaccgtcttcagtcttttcaaacaaacattaaaatgaatccaattccatatctcagcagatgagcaaatccctgttatggccagcaatggcagagtttaaaacctcccacccagttgagaaagtaaacttttaatacaagaattctgtaaattcagatttaaaatgttgtatatatacaatttatagtgttgccatattacctgaccattgaccctgcaggtaactcacgtagtgctccacctacacgagggcccccgccatcttatggtggaagcagtcgctatgatgattacagcagctcacgtgacggatatggtggaagtcgagacagttactcaagcagccgaagtgatctctactcaagtggtcgtgatcgggttggcagacaagaaagagggcttcccccttctatggaaagggggtaccctcctccacgtgattcctacagcagttcaagccgcggagcaccaagaggtggtggccgtggaggaagccgatctgatagagggggaggcagaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccacaaaacatctagccatctaaaatggagagatgaatcattctacctatacaaacaagctagctattagagggtggttggggtatgctactcataagatttcagggtgtcttccaactgaaatctcaatgttctcagtacgaaaaacctgaaatcacatgcctatgtaaggaaagtgctattcacccagtaaacccaaaaaagcaaatggataatgctggccattttgcctttctgacatttccttgggaatctgcaagaacctcccctttcccttcccccaataagaccatttaagtgtgtgttaaacaactacagaatactaaataaaaagtttggccaaaaccaac

SEQ ID NO: 37939 - DNA, 6870 bp, Homo sapiens
gcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccatgttggccgggctggtcttgaactcctgagctcaagtggtccactcgtcttggcctcccaaagtgctgggattacaggcgtgagccaccgcgcccggccttcttttttagaggcagagtctcagactggagggcagtgatgtggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccacggtgcctggcctttagtcatggtcttaaaacagaatgtaggccgggcgcagtggctcacgcctgtaatcccagcactttgggaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaaaaccccatctctactaaaaatacaaaaattagccaggcgcggtggctcaagcctgtaatcccagcactttgggaggccgaggcaggcagatcacgaggtcgggagttgaagaccagccaggccaagatgatgaaaccccatctctactaaaaatacaaaaattagccgggtgtggtggcacacgcctgtaatcccagctactagggaggctgaggcaggagaattgcttgaacctgggaggcggaggttgcagtgagccaagaccatgccattgcactccagcctgggcaacagagtgagactttgtctcaaaaaaaaaattattatgtattgttattattattctttttgttttttgcccttctctaaaactggtagataacttatttttgagacaaggtcttgctctgttgcccaggctggagtgcagtggtatgatgattgctcactgcaacctccaactcctgggttcaagcgatcgtcttgcctcagcctccccagtagctgggactatactataggtgcacacctttatgcctggctaatattttcacttttttgtagagacaaggtcttgctatgttgctcaggctgttctttaactcctgggctcaagcaatccttccacctcagcctcccaaaattctgggatgacaggtgcgcaccaccgtgcccagccttatttaacttttttgttgcatgtatattcacgtgggtcaaaaaaccatttaaagagatttgcagtgaaaatctgctttctatccactaagtttccccaaacgctgttaggcactgttgatagttgtttatgtttcttttcagtttatttacacacgtaagtctcaatttgctcaattgtaaaaggaggataatagtaataaccaactatatgtaagatacttagaacagtgtttggcaaacagtggttgccatgtaactgttcactattattatcattatttgcacttttccctttttacacaaatggtaatatgctatatatacttctaatcttttctctttttctttctttccttacaagaaaaccaaagaagccattttcttttttgagacggggtctcgctctgtcacccaggctagagtgcagtggcatgattatagctcactgcaaccttgaactcctgggcaatcaagcaatcctcctgcctcagcctccctagtagctgggattataggcatgtgccaccccaccaagttattttttttttaacaacttttttttttaagagatggcgtcttgctttgttgcccaggctgttctccaactcctggcttcaagtgatctgcccacctcagcctcccaaagtgctaggattacaagcatgagccaccgcacccagctgctttttttaatgaggtcactcctcatgatttcataaagagctttcaaagcatggacattgtacagttgcttgacttgtgtagtattgatgggcattttccctcaatcttctgccattataaacaaggccgggcagagtggctcatgcctgtaatcccagcactttgtgaggcgaaggcgggcagatcacctgaggtcaggagtttgagaccagtctggccaacatagtgaaaccccgtctctactaaaagtctaaaaattagctgggcgtggtggcaggtgcctgtaatcccagctactcaggaggctgaggcaggagaatctctgggacctgggaggcggaggttgtggtgagctgagattgcgccactgcacactccagcctgagcgataagagcaaggctccgtctcaaaaaaaaaaaaaaaaaaaaaaaacattacaggcatgagccattgtgcccggctggtcagatgtttcttaaattttagtcattccagtagatgtgagtgatatctcattatggttttaatttgcttttccttagtgactaatggaagtttgaacatctttcatatacttattggccatttagaaatcctctttgtgaagaacctattcaagtcttctgcctattttatattggatgatctttttctttctttcttttttttttttttttttgagacagggtcttaccctgttgtccaggctgagcactgtggtgctatcatagctcactgcagcctcaacctcctgggctcaagacatcctcccactgcagcctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtctcctgagtagctgggactacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactct

SEQ ID NO: 37940 - DNA, 5074 bp, Homo sapiens
cggcgagggtcctgccgagggaccccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggtgagtgttgcgcgcggcgagtgttgcgcaccttgtgagacagagtttccgcaacagtacgcggactgcctccggcccaccgcgcggcgcgtatggcggttcgcaccgggtcggagccgcagcggcgcgagcccgtggtgacctgggtgtctcagctgttcctggaacactgactgaagtcctgccctggctcttagcttcggggatccgcgactatctggggaccggtaagggtagcggtgtcgccgcacaaaccaagtttgttttaaccctgggaattcgggaaccccgagaagtcctctgttcagcacctcggatagcactgggttctctcctgggctgtcagaaggaagatggctgtcaccacaactcctaacatatcccagctaagggcccctccacacgcagtcatcttcccatctttcccacaaataatgtaattttttgttagtgacatttcggtgcctttctttagatttatgttccccagctctcttaacctcaggtccctcattccctaccctcacctgtaaataggagagagcaaagggatggaaaaggggtacggggagaggaaggcgaaataaccgtagacaggaaagagttcaaactgtctcactagccagtgatgctggaattcaacttctgtttcaactgccctttgtaatagtaactaaaacaacagtttaatttggctatgagaaaggaacaagagaagtggccagtgtccaatgggtgacaacagtccaaagatacactgcactacagggggttggggaaagaaaaagctgaggacaaaataactttcattctgatcatggttccccatgggctgtcgaatcacctctggtgctctactgagtctgaatctccaacctcgagactcaggtagcttcacttttaccagctcccctgacaattcctttgcattgcttttgaaatttgttgaaattttatggtgacttaaaaagctcatagagaataatgtattcatccaagctgctttgggttccacctggaattgaggaaattttaccttatgtagatgtttgaaatggggagaaaaccaaggaacagtttccaaatatctgtggtatatatttcaggttaaatgtttgtttctttgacctgtgctaacttggcattaaagagaagacacataggaaggttgtatatttaaactatgagaaaaatgtttcatcttcaataggagaaacaatccccttcacccatctttcttctttctcctgtagtcatgagcttttaacctatgcctaaaaattgagccagtgctacaaatataaggatagatcttgtggataaagaattttagacacagaaggaggaagaaaaatccaaaacatgccacatagaagactccactttctgaccccataattccctgtgcccagtcacacatattttgagctttgcctgctcaacatgtcaggggctcagccccctcccctagctttctctgccatctgaataaaggttatatggattctagtctaatttttctaatcacacagactgaccccaaagtagtatcatatttacttaaattatgtgagttagcgaattaatatgactgacttttaatcatgcctattcaaatgggtttttttcatacttaatctatttgattcaccaagctcccaaaatgctactaatcttccttttgcattgttgaggaacttgagcagagctcactgggtagcagctagctcttccctgggtatcacctcaaatcttgacttctctccctctctcaccctcttctcatcatgtaacaggattgtgggggaggagaagaggaaggctgctctttccagaattttccatactgctttttatgctcttgttgttatcacttattactattatcattactttaatccaggtgatggaatggcacgtgtagtgttagcaacttgaaaaaaatagataataagcaaccatcaataaaaatagtcttatagaaaggcattttgcataataactgatttgcattggaccctacatttagggttgttattgtctcaatgacaaaaggtttacttagtgactgtctcgctagaattacaacattctgggattttggctcggatgcaaaagacatgtgagaaacgaggttgcctagccaaaattatgtagtgaaatcaatgtaacaaatatttactgagcttctaccatgagaaagacacttatgattggtactgtggtggatgcagagatgagcaggcgtgctatggctgatgtccagatagaatttcccatctaatgtgatcttgaccataccacacaaagtgtggtaaataccacaaaacatgcatacatggttataggagccatcagttaacatcgctaccttagtacgagtgcattattctgatatttgttactatttggttttgaaggaatctcacatcacatacatttaaaaatcttttggtattagtatgcaaaacattcaacattaatttttaacaacaagatcacttagatacaactttagaatggaaatattattgctccttaaatatcttaagcttctaatggtgtttttatttgttcatcatatgtcaggaataaaataagacattttaattattaatggatcatctttagattcttacgtagttatatatttaatcttctcagacacgaagcttaaatactcattaagagcttactaaatacgtgccttcaagattttgttgcactaataaaatgctttctttcattgtgaaaataatatatgtgtatttaacatcacttaatataccagtatatttttaataataccaagaaagacttcagagggctgtaaaaaactcctgaaatgctaagaaatatcatgcatgttttgtaaatgttcacatattagtactctctttatcatacccaagtgatgtgttaaatagaaaaaaacttaagatcattcgaatgtatagacttacaatgattttatatttaatatttatataagaaaaaggaaagaatgtatgctgatgattcctattttaccaaacaccatgatttccattgaaaaatactttttctgtacaacagtgactaaatgtgaagaaaataaacatgaataatttgtgcacttgcatttgtataattttatatctgatctcatcattatagacattttgttcaaaataataaagtctgttgtatccagcaaagaaaaaaggaaaaaaacaaaagatctgtacttacaacaaattaacaaattaataagaatgcaaataattcatcagatttaaattgagtttttaggatgtgtttataaactttttttaaattgttgtttttctttgaagattgaaagtatttgcaggaatactcgataccattttaggtaaaatattaacacaagaaagcaaatgacccttaggttattaatattgattttatctctaagacaagaagataaaaggaattttgaggaaatatccctgattaggtaaataaaaatttctcctttttggttagaaaaatctcaaacaaaattatatcagaagtggaaaattatccagtgaaattagattgtgaaagcagtcaatctaagttaaaactgcatggaaaatttttttttaaattctttaaaatttctatgggtttaaaatccaaaggcagattcctaactggattcagtgaacccctccactttcacctttccaaattttatttgtttcatttgcatgctcagccttatgaaaagtcgtgataagaaattggagatgaccttattataataaggaagttatgatgtcaaagcaagcatattttggtccacaaaagttcatttgcttaatgaaatcacagaagcttctttttatcattacatcaaattgttttcccaggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgca

SEQ ID NO: 37941 - DNA, 177374 bp, Homo sapiens
gagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagagggtgagtctgggggcgcgggcgtgggcggggagcgccgcgatggggagaggaccccacccaagccaaaatcgagcccccgcttgtggactgagaaccctccccaggggcggggggcggtggccaggacggtagctcctgcatcgcgtagggggagcgggaagcctctgaccttggcctttgcccgcccgggctcgcgcctccgcgccctgcgtgcccgacctgagcccgaggaaccttgccccggtgcccgccccgccgcgggctcctctctggagcgcgcctccgacccgtgccccggcccctccgagcccaagtcgctccggagacacgacacgcgtcatctttgggtcgcggccgggaagtggggtcactgggtctggacagccccgaacagccaagtcccccgagcgcatatggtgtaggtagagccaagcgccctgagtgcctcaccggtgggtgacgctgcctggggtcagggactgcagagcccccctctacccaactaccttggatctaggcccgtggccaccccggactctaggtccatgtttacccttttgggttctgtttccagatgtccggaggcaaattctaaagccttagcaacagcagcaattgtagcagaagtagtggcggttttttaccctatttattgtaattggtatcaccgcacgccacagcctagtctatcttatctctctggactgtcacagtggcccccggaggcagatacagttatgcacccatttcacagaggagtaaactgaggctcatgtaggacgcataactcccttgccctaaagtcagtgccagagccaggacttgagcctctgtgtgtcccgttctgcccaagaatctggactactgtcccttgtctgctgtctccttgacccctcctctcccctcagccctgcgcttcatgaaggagcctttgaccttgagtgagcctttcgttccccctgaccccatgggcccctctcccacgtgtgggcagcatcttccttgggcttgacaataggcacctttggggttgtaagatgaagatggcgcaatcatttaaggaatatagcctgggtttcccactgtggggtctgaggccctgctttaaaaatatctgttgggttactgtttcagatttctccataaaaggaaatcagtcgtgatgaggaaggggtcagggagggaaggaattgaagctcttaaatgtattgatggggaaacgggtgcatgtaaaatcaggtgctagagtggaccaaccgggtttgctgagtcgactctgtcaatcacataatgtctaaaagccccgggcccacccccccccagccccgcccccaggtgcctgggagacagtaggtgctcaatgaagggtggcggttagttggagttcttgttaagaaaatctggccagctgcggtggctcaagcctgtaatctcagcattttgggaggctgaggcgggcggatcacgaggtcaggagatggagaccatcctggccaacatggtgaaactcccttctctgctcaaaatacaaaaattacctgggtttggtggcgttcgcctgtagtcccagctacttgggaggctgaggcgggacaattgcttgaacccgggaggaggaggttgctgtgagctcagatggcaccactgcactccagcctggccaaagagcgagactttgtctcaaaaaaataaaaaaaaaggcggggcgtggtggctcacgcttgtaatcccagcactttgggaggccgaggcgggtggatcaccagttcaggagatcacgaccatcctggctaacacggtaaaaccctgtctctactgaaaaatagaaaaaattagccgggcgtggtggcgggcgcctgtagtcccagctattccggaggctgaggcaggagaatggcgtaaacccgggaggcggagcttgcagtgagccaagatcgtgccactgggcgacagagcgagactctgtctcaaaaataaataaataaataaaaagaaaatccaagatgagtggtttcgaactatgccagattctatgtgtgcgtgtgtgtggttccctgttcttctgttccttgtagctttggtaattaattgtggatctgtgcctgggctttcagggtcagtaaatggatttaccatttctttgcacatttatggcttccatatgggcaggggtttatggtttgttgttgttcaccgttgcatttctagagcccagaacgatgcctggcacatagtaggtgttcagtaaatatttgttctgcagtggggcacaagtggtggagttcctgggtgtactgggctcctttatcatcttaaggagttccttattctctgcataataccttcctaagaattagaagagcaagctctcagcaggtgctgttctatgcgctttgcatatataatctcagttaatcctcacggcaaaaccccacgaggtgcggtttaatcttcccttttcacaagtgagaaaacttcgcttgaggccagcaggcagcagggctgggattgcaatctagctagtgtggctgcagagcaatggtttcttaacaaatctttgttcttttgagtccgagcctccgtaccccccacgattggggtgatggtgaacaaaatcctgtcaaataaatgggctgtgatgcctcttgaaggcttggggaggggcaaagaacttttcagatcattaatctctaatgtcaaccaatatggcttttttttttttgagacggagtcttgctctgtcacccaggctggagtgcagtggcacgatctcagctcactgcaacctccacctcccaggttcaagggattctcctgcctcagcctccccagtagctgggattacaggcgtgttccacaacaccggcttattttttgtatttttagtagagacagggctttgctgtgttagccaggatggtctcgacctcctgatcttgtgatccacccgcctcggcctcccaaagtgttgggattacaggagtgagccaccgtacctggcctttttttttttcttttttttttttgagacagggtgtcactctgtcacccgggctggagtgcagtgacacgatctttgcgacctccgcctttcaggttcaagtgcatctcctgcctcagcctcctgagtagctgggattacagtcgtgtatcaccacccttggctaatttttgtatttttagtagagatgggatttcgccatattggttaggctggtctcaaacttctgacctcaagtgatctgcctgcctcggccttccaaagacctgggattataggtgtgagccatcactccgggcccaatatggcattttgattgggatgaagggtggaggaaaatcagtgtgatttttgtatctatctctctagctatctattattttttgagatgaggtcttgctctgttgcttaggctggagtgcagttgggcaatgatggctcactgcagcctcgacctcctggacgcaagccatcctcctattttagcctccgtagtagctgggaccacaggcacacgccaccctgcctggctaatttttactttaatgtgtagagctgaagtcttgctattttgtccaggctggtctcaaactcctggcctcaagcgatctgcctgccttggcctcccgaagtgctgggatcacaggcatgagccacggtgtctggcctctgcagttattcttattctttgcttctctcctggagacctgcttcttgcccttccccattcatgcatagagaccacagggtgtgggctgagtccccagggctccccacctcaccccactctacccttgacttccattcctctttggtttaagcagaactctcaatcttggcactgctgacatttggggctggatcattcctggtggtgggggctgtcctgtatgtagagtgttgagctggaaccatggtctccacccatgtggtcctgggaggatccccttccccccaggcatgacaaccactaatgtctccagacattgccaggcacgtctctgcaggagttaaccttttccctgtctgagacatttacccatctgggctcttgctctttctcctctctttgttcaataatcctcggccgggtgcagtggctcacgcctgtaatcccaacaccttgggaggctgaggtgggcggatcccctgaggtcaggagtttgagaccaccctggccaacatggtgaaaccccatctctactaaaaatgcaaaaattagccaggtgtggtggcgggtccttgtaatcctagctacttgggaggctgaggcaggagaatcgcttgaacctgggaggcagagcttgcagtgagccgagatcacaccattgcattctagcctgggcaacagagagagactctgtctcaaaaaaaaaaaaaaaaaagaaaagaaaaaagaatcttcatttacccacgtgctttttcagcctctaaacacccagtaccccccaatccccattacctaccactgacctccagcctccaccctgtccagcttccccaggccagtcctccctgccctttccatctcactcttttctcactgttctgcccccagcatctggcttgcatctccgctgctttaccgatggctctcgaagttaatctctcatctcccagttgcgtctcctgcagcctcacctcacttgacccctctgggtttgacattgccagtcccccctcctggaaggctgtgtctcccgtctcacctgtgcctaagttcttctgttttactgttctcttctccttctacctgggctaagatgttggctctctcttcccagagggtcagtgtttcctttaatcttctctcagctcacttttttttttttttttttttcacttcttcacccgggctggtgtgcaatggcatgatcttggctcactacaacctccgtctcctgggttcaagcaatggtcctgcctcagcctctccagtagctggaattacaggcatgtgccaccccgcctggctagtttttgtacttttagtagagacagagtttcaccccattggccaggctggtcccaaactcctgacctcaagagatccacctacctcagcctcccagagtgctgggattacgggcatgagccaccgtgtccggccctttttttttttttttttttttccaatttttatttctttttagagacaggattttgctctgtcacccaggctggagtgcagaggtttagtcctagcttactgcagcctccaagtcatggcctggagcagtcctcccacctaggttccccaagtagctggaatcacaggcaggtgccaccatgcccagctaattgaaaaatttgtttgtagagacagagtctcactatgttgcccaggctggtcttgatttcctggcctcaagtgagcctcctgccttggccttctgagaaactaggatcacaggcaggcaccaccatgactagctaatttttaaaatttatttgtagagacagagtctagctatgttgcccatgctggtcttgaattcctggcctcaagcaacctgcttgcctccgcctcctgggtacctgggctcacagacagtcaccaccatgcctggctaattaaaactttttttttttttttgtagaaacagggtcttgctatgttgcctaggctggtcttgaactcctagttcaagcagtcttccctcctgggcctcccaagtgctgggattataggcatgaggaaccattgcgcccagctaagaaatttacatagattccgacttcttcatctgaacaggggtcagcaaactatggccctcaggccaaatcccacggtttttgtaaatgcagttttattggcatgcaaccacactcatttgtctactcatcatctatgactgcgcaaaaatgccccgacacggcaggttgagtagttaaaacaggaattccatggccaaaatatttacactttggccctttacagaacagcgtttgctgacctctgatctggaacagacgccttgaggtttcattcatgatagcatgcctaatagcttgtgcagtccctggtacaactcgaatgaagtgagtgaaatgaaacgctatgtctttctctttacaccgcaagagatgttaaagaaacgtgtgtcatttgctgcactgaatatacggattccaaggatgagaaaaatcaccgtgatgttgcctacttagccatgtgtatttatttaaacagctatattggcattgaatgaggatttcatgctctcaaccctgtatctagaacccaaaatataactggtgtatataatgagattttttttttttctctcaggcctctcttgtgttaatttctgttaagaatacttctgggccaggtgtggtggctcacgcctgtaatcccaagcactttgggaggccgaggtgggtggatcacttgaggtcaggagttcgagaccagcctgaccaacatggtgaaaccccatctttactgaaaaaatacaaaattagccaggcgtggtggcgcatgcctgtaatcccagctagttgggaggctgaggcaggagaatcgcttgaacctgggaggtggaggttgcagtgagccgagattgcgccactgcactctagcctgggtgacagagcgaaactccatctcaaaaaaaaaaaaaaaaaagaatatttttggccaggtgcagtggctcatgcctgcaatcccagcactctgggaggctgaggtgggaggattacatgtgtccaggagtttcagatcagcctggacaacacagcaagaccctgtctccactaacaataaaacaaaaattagctgggcatggtggcatgtgtctgtagtcccagctacttgggaggctgagatgggaggacctcttgaggctggaagggcaaggctgcagtgagctgtgattgtaccactgcactccagcctgggcaacagtgagatcctctctctgtctcaaacaaaaaaagaatacttcttggggtggcctggttgatattttgcagctgcatggtatttacagtttttaattaaatagtgacgggtaatgcattctcattgcaaaaagaaaaattacaaaagtgtagaaaggaaaaaaaaaacacagaagtccttctgcaaaatcttgtggtggggtgcagtggctcacacctgtaatccctggactttttaggaagctgaggtgggaggaacacttgaagccagcagtttgagaccagcctgggcaacataatgagacattatctctagaaaaagtttaaaaattagctgagcatggtggtgtgtaccggtagtcccagctactcaggaggctgaggtgggaggatcgcttgagcccagaaggttgaggctacagtaagccatattcatgccactgcactccaacctgggtgatagagcccgaccctgtctcaaaaagaaaagaaataataaaaaaaaatcttgtccccctgtccccaaaagcattccattcatgtccagggaggtaactgtgccattggtttatgtatctttttgatgtttagtaattttttaggctaggtgtcatggggccactcctgtaatcccagcactttgggaggccgaagcaggtggatctcttgagcccaggagttcaagaccagcctgggtaacatagcaagaccccgtctctacaaaaccctacaaaaaaattatccagatacagtggtgagcacctgtggtcccagctactagggaggctgaggtgggaggatcacctgagcctgggaagtcgaggcgccagtgagctgtgattgcaccactgcatccagcctgggtgacatagtgagactgtgtaacaacaacaacaacaaaatattttaaacattatcatacagtaaaattggctttttaaaggtgtaccattttatgatttttaagccatgtgtagagttgtatggctattgccacaattaggatagagaacagtctcgttgttgtccaaactccctcaattcacccctttatcactaaaccacctccacccctaaccacagatctgttctccatccctatagttttctctagactttaaaagattttatcttataattggattaatattcctaaagttgaaattttaaatttgagtctggttgatcctcatcattcccagatcccatattttctttttaaaatttaaaatttaaatttttattttgagaggcaggttcttgctctgatacccaggctggagtgcagtggtgtggtcctaattccctgcagcctccaactcttgagcatcaacgatcctcctgcctcagcctcctgagtagctgggactacaggcacacaccaccatgctcagctagtttttattgttatttatttatttatttatttttgagacggagtctcactaactctgttgcccaggccagactgcagtggtgtgatctgggttcactgcaacctctgcttcctgggctcaagcaactctcctgcctcagcctttctagtagctggggttacaggcacgccaccatgcccggctagttttttttatttttagtagagatggggttttaccatgttggtcaggctggtctcaaactcctggcttcaagtgatccgcccacttcagcctcccaaagtgctgggattacaggcgcgagccactgtgcccggcctaatttttaacttttcagcagggataagggctcgctatgttgcccaggctggtctcgaactcctggcctcaagtgatcctcccatcttgacttcctaaagtactgggattacaggcatgagccactgcacctggccccagaccctgtatttttgaattcacctactcactcaaatgtatttgtaaccctcaaaccagcatgctcagtgcctttctggtcattttaggacactcataagtacgagtctcaaatgtgaggtcaagtaagagggcattccaccttcttgcttcagcccttatgcgtcagattcatacaatctgcacactgaggattaaaactagtcctttttgagcaggcgcagtggctcatgcccagcgctttgggagtccgaggcgagtggatcacgaggtcaggagatcgagaccatcctggctaacatggtgaaaccctgtctctactaaaaatacaaaaaattagccaggtgtggtggcgggcgcctgtagtccgagctactccggaggctgaggcaggagaatcacttggacccaggaggtggaggttgcagtgagccgagattgtgcctctgcactccagcctgggtgacagggtgagactcaaaacaaaaaacaacaacaaaaaaacctgagtcctttttgtggttatttggtgccacatttttagcatttttgtgctttcagttggtgatggggctgtttcaaatgccccccagggtgctgaagccctgctctctactcttccttggctaaggagggctgtcaccacccttgtggagaaaaggcagcgtggcggggcacggtggctcacatctgcaatcccagcactttgggaggttgaggcaggtggatcacttgaggccagagtttgagaccagcctgggcaacatggtgaaaccccatctctactaaaaatacaaaaattagctgggcgtgatggcgcacacctgtaatctcagctacctgggaggctaaggcacaagaattgctcgagcctaggaggtgaaggttgcagtgagccaaggcggtgccactgcactccagcctgggcaacagagtgagaccctgtctcaaaaaaaacccaaaaaaacaaaaaaactccaaaaccaacacacacacacaaaggcatgtgttacataaactttgttcaggcatgagttctattactgttggccgtgagttcggtgttaatgaatcaacaatatagattcaatagtgtctttcaacagaaacacacataaaacaaggctaggtattgatccatggataaatgtgttgtggccagaagttcgcaggtacttaccctcgcattttcctaggaacaatggttcagtattcactagttcaacattcaggggaatttcacagagccaaactaccaccaataacaagaatcggctgcaagtggtttaaaactggtgaatctgtggctcatacccgtaatcccagcactttgggaggccgaggcaggtggatcacctgaggtggtgagttcgagaccagcctggccaaaatggtgaaaccccgtctctactaaaaatacaaaaattagccgagcacggtggctcatgcctgtagtcccagctactcaggaggctgaggcgggagaattgctggaacccgggaggcagaggttgcagtgagccgagactgcaccactgcattccagccagggcaacagagcaagaccccatctaaaaaaaccaaaccaaaccaaacaaaactgtgggtttgtcattttccgtttagaatcctttgaatgcaaatgccctttttgttgtattttcatctgcgtggaaaccgctgggttgataccttttggaaagttcatgagatgtccaaaaacccctggcccatgtttcagggaggggaatccctgccctctgccaacactggtggcagggagaggcagcagtggctctcgggattttatttatttcatttattcatttacatttttttgagaaagggtcttgcactgttgctcaggctggagtgcagtggcgcaatcacagctcactgcagcctcgacctcctgggctcaagtggtcctcccacctcagcctcctgagtagctggcactacaggcgtgtgctaccacgactagctaatttttgtattttagtagagatggggtctcaccatgttgcctattattattattattattattactttttttgaggcggagtctcactctgtcgcccaggctggagtgcagtggcgtgatctcagcttactgcaagcttcgccttccgggttcatgccattctcctgcctcagcctcctgagtagcagggactacaggcgcccgccactgcccccggctaattttttgtatttttagtagagacggggtttcaccgtggtctcgatctcctgacctcgtgatcccccacctcggcctcccaaagtgctgggattacaggcgtgagccactgcgcctggccatgttgcctattattattattattttgagcagtcttactccgttgcccaggctggaatgcagtgtcacgatctcagctcactgcaacctccgcctccagggtttaagcaattctcctgcctcagcctcctgagtagctgggactacaggcatgtgccaccacgcccagctaatttttgcattttagtagagatggggtttccccatgttgcccaggtgggtctcaaactcctgacctcaagccacccacctgcctcagcctctcaaagggctgggattactggtgtgagccaccttgtccagctggcttgaaggattattattattattactattattttgagatggagtcgcactctgttgcccaggctggagtgtagtggcacgatctcggctcactgcaacctctgcctcctgggttcaagcaattctcctgcctcagcctcccgagtagctgggattacaggcgtacaccaccacgcccagctaatttttgtatttttagtagagacagggtttcaccatgttggccaggctggtcttgaacccctgacctcaaatgatccacccacctcggcctcccaaagtgctgggattactggtgtgagccaccgtgccccgccggctcgcggggttttagaaacatattttgtttccagcagaacaagctttgctatcctgcggtgccacgtacagactggctctaagctcctgttggagttcaaagcggacttgtgggaatgaatgtttaatttcacatctggcattttcttccagttccttagaagtaggatatctcatcaggtttatataaaagcccctgatgtatgttcaggaaaggcaggatgctatcatgagattcttatttcctttgcctttgtgggaatgtggaaaccataggtactgtctaaaaattaccctttttatcaatgcaggcaaaagtagtcagacaggaagggactcgagagtagggatgcaactgcttttttaaattgattttaaaatctcatttattcttatcattagagacagggtcttgctctgtcatcccggctggagtgcggtggtgtgattatggctcattgcagccctgaactcctgggctcaaatgattctcgcgcttcctcctcccaagtagctgggactacaggcatgcaccaccatgcctggctagtttttttatttttattttttgcagagacagggtctggctgtgttgcccaggctggcctcgaactcaagaccttaagtgatcgtcccgcctcagcctcccaaagcactgggattgcagatgtgagccactgtgcctggtgggatacaactgttttctgactgcctgtgtatgtgtctgtgtgtgtgtgtgtgtgtttgtttgttgttgtcattctactctcaaggatgtatcttgttgtttccttgcagaagatcagaaaagggaggacctcatatgttccctcctaattatacccagttacacggtctccataccacctgttacaaagtgactttctggtctggcaggacttctcttgtttttcctcctgtcttctgtgtcctgtctgctcttgtctgtataaatttcaggactcctgaaatagcacggaagcccccttctaatcctgtggtttgatgtttgatattgttaggattacaaaactatgtcatagactagaggagtcagacattccagagttcacagaaggtgttggtgtccgggtggctgtgggacacaggtgcccttcctagtccctggcctttcatactgtgccccctggagcccctctttctttcttttttctttttttttggagatcgagtctcgctctgtcacccaggctggagtgcagtgcagtggcacgatcttggctgattgcaacctctgccttccaggttcaagcgattctcctgcctcagcctcctgagtagctgggattataagtgtgcaccacaatacctgactaatttttgggttttttgtttttttttttgagatggagtttcgctcttgttgcccaggctggagtgcaatggcatgatatcggctcatcacaacctccgcctcccgggttcaggcgattctcctgcctcagcctcccaagtagctgggactacaggcatacgccaccatgcccagctaattttgtattcttagtagagatggggtttctccatgttggttaggctggtctcgaactcctgatctcaggtgatccacccgcctcggctgcccaaagtgctgggattacaggtgtgagctaccatgcccggcctggctaattttttatatttttggtagagacgggtctcaaactttggccaggctgggctcgaactcctgacctcaagtgatccacctgccttggcctcccaaagtgctggaattacaggcgtgagcaaccgcacccagcctttgttttgttttgtttttttgttttttgttatgagacggagtctcgctctgttgcccaggctggagtgcagtggcgcagtctcgactcactgcaagctccgcctcccgggttcacgccattctcctgcctcagcctcccgagtagctgggactacaggcgcctgccaccacgcccggctaatttttgtatttttagtagagacggagtttcaccttgttagccaggatggtctcaatctcttgacctcgtgatccgcccgcctcggcctcccaaagtgctgggattacaggtgtgagccaccgtgcctggccttgttttgtttttgagacagggtctcctcgcactgtcgcctaggctggagtgtagtggtgtgatgtcaggcctccgcaatctccacctcccaggctcgagcaatcctcaacctcccgagtagctgggactacaggtgcacaccaccacacccatccaatttttttttttttggtagagatggggttttgctatgttacccaggccaatctcaaactcctgggctcaagcagtccacccacctcagcctcacaaagtgctgggattccaggcgtgagcctctctttctatcattttcttctctcagttgtctccgtgctacctttcctgcaatatcacctgttgtcactgcgtccaccagcatccgtacctgttcccccatcttcccaatgcccacgggacccacatccctgagtatcccaaagccctcacagactcaatatgctgccaactcagcctgttgttcttgccactctaaactgttcctatctcgaatgcttcaggctcattgacgatccctcctcactctcttctccctcttctcttccatttctcctgggtatgaagtcctgttcacacaaactgcccctggtttctgtggtgctatgcatgctgtcttcagtaccttcttcattctgctgccagaaggctgtttctctctttcttttttattttttaattttatttttatagacatggggtcttactgtgttgcccagattggtctcagacttctggacttaagtgatcctcctgcgtcagcctccccaagggctgggattatagatgtgagccactgtgccctgtctagagggatatttattttattttattttattttatttcttttctttttttgagatggagtgtcactctgtcacccaggctagagtgcagtggcgtgatctcagctcactcaacctctccctcctgggtttaagagattgtcctgcttcagcttcctgagtagctgggattacaggtgtgcaccaccatccctggctaatttttgtatttttagtagagatgaggtttccccatgttggccaggctggtcttgaactcctgacctcaggtgatcctcccacctcaggctcccaaagtgctgcgattacaggcatacgccaccataccggactcatttttgtatttttagtagacatggggtttcactttgttggccaggctggtctcaaactcctgacctcaggtgatcctcccacctcagcctcccaaagtgctgggattacaggcacacgccaccacaccaggctaattttcatatttttagtagacatggggtttcaccatgttggccaggctggtctcaaactcctgacctcaggtgatccaccccccttgacctcccaaagtgctgggattacaggcgtgagccactgtgcccagcctgtgtggctctcttttggttaccctgtggtatcctgttttctcaagctcatcctccctggtgggtccatgatccctggaaattgttggtcttctccggccttttgaaattgctgccttatgaatgtccagagttgggtatctgcctttctctcccaaggaggaagaatcctgagggggcatctttgcttttaggtcccagggctttcactgacttcctccttgctggcttcttggtttgttccaaagatgtcctcggtacatcttctgagactaatgacatgataagtttctggaaggactatgatctggatgatgagggtttcatcacagtcctctttcagttctgtcctacagattacacttgttttcttccttcatcctttgtcttcactggttcactgtttccatctgcattcttctgttctcatttctttttgttgttgttttattttttattttttaatttattttttaatttttttgagaccgagtctcactctgtcacccaggctggagtgtagtggcacagtcttggctcaatgcaacctctgcctcccaggttcaagtgtttctcctgcctcagcctcctgagtagctgggattacaggcgagcgctaccgtgcccggctaatttttttgtatttttagtagagacggggtttcaccatgttggcctggctggtctcgaactcctgacctcaagtgatctgcccgcctgggcctcctgaagtgctgggattacaggcgtgagccaccgtgtccggccttggttttttttagaaatagtgtctcactctgtcacccaggctggagtgcagtggtgcagtcatagctcactgcagcctcaacctcttgggctcaagcaattctcctgcctaagcctcctgagtagccgggagcacagacgcgcctcaccacgcctggctatgttttgtatttttagtagaggtagggttttgccagttgcccaggctggtcttgaactcccggactcaagcagtccacccgcctatgcctcccaatatgttgggattacaggcatgaccactgcacccggccaacatctctgcagttctttgttttagtactttgtcctttagctctggtggtagcttatcacagttatttaggtgcgtctttcctttacttgctgtaagagtgcaaccttatttgtcttgagagtccccctgggcctggcacaatgtctggcccaccgagatgcccagcaaacgtttgctgagtgaatacaggaatgatttccatgtagctgacttgccgggtccagaacctgcatttgatccagacgcctccattccttctcgcagaggtagatttgaaagctattcttgcaggcaggtggagaatcttaaggatctctgacaccccagtgtgtccaagctctaatttctggaggtaataaatctgggaatggattccatctggctcagatgggagacagaacaggtatacacagccagagaccccagttctcatctcttctttgtaggtttcattatgctgttgtcatcatttaaaggaaactgaggccaggcacggtggctcacacctgtaatcccagcactttgggaggtctagacgggtggatcacctgaggtcacgagtttgagactagcctggccaacttggcaaaaccctgtctctactaaaaatacaaaaattagctgtgcgtggtggcgggcgcctgtaatctcagctactcaaaaggctgaggcaggagaatcgcttgaacccgggagatggaggttgcagtgattcgagatcacgctactgcactccagcctgggagacagagtgagactccgtctcaaaaataaaaataaataaatgaataaataaataaaaaggaaactaaggcgtgcagaggggttgaagatgttgtccaggatcacacagttgacaggtgacagagctgggttgggaagccagattcgttagatttctagtgtgccccaaaactggtataggtggtggcctgacaccagaacccaagacttgttgaggcaggacctcctgaatttaagaggaagcagtttgaggactggaaagaatgtggaaagggacgtgtgggccccagaataggtcagcagggagcattttaagaatgctgttactggccgggcttgatggctcacacccatactcccagcacactgggaggccgacgcaggactgcttgagcccaggatattgagaccagcctgggcaacatggtgaaaccccatctctacaaaaaatacaaaaattagccaggcatggtggtacgcagctgtagtcccagctacttgggaggctgaggcaggaggatcacttgagcccaggaatttgaggctgcagtgagctatgattgcaccactgcactccagcctgggcaacatagcaagactctgtctcaaaaaaaaaatcctgtaactgaagaacaaggacctttatgattgaaaacaggaagtagaaaactcttagcattgtaaaggatttcagaatcttctagaaagttctttctctgccctgctcccaacccatctcccctgctgttttcatgatggagagaaaatcagggaagaaaggaacacttcctaagatggctctcatgtccgccttctctccttctggaaaattctcagattcaggaccagcacggtccaatacagctctgctttgatggaaatactctgtatctgctctgtccaatatggcagccaccatccacgggtggctcttgagccctggaagttgtggctggtaagactgaattctttttttttttttttgagatggagtctcgctctgtcatccaggctggagtgtaatggcacaatctcggctcactgcaacctctgcctcccaggttcaagcgattctcctgcctcagcctccctagtagctgggattacaggcatgcgccactcccccgaccccgctaagttttgtatttttagtagagacggggtttcaccatgttatccaggctgatctcaaactcctgaccttgggtcatccacccgccttggcctcccaaagtgctgggattacaggcgtgagccaccgcacctggctgaaactgaattttattttcactttaattcattgaaatgtcaatgtaaacttttatttaattcatggaaatgtaaaaaaaattagtactcagttctgttactggaaaactctcccatatatttggaacaacttggttatgtgaacttgaggtagtaggcgggactcgtctccagaggcggggatccagccctggaccaaatggaggactagccacaaggacagggctggccgggcgcagtggctcacgcctgtaatcccagcactttgggaggccaaggcaggtggatcacctgaggtcaggagttcgagaccagcctggccaacatggtgaaaccttgtctctactaaaaatacaaaattatctggatgtggtagtgcatgcctgtaataccaactactcgggaggctgaggcaggagaatcacttgaacccaggcggcagaggttgcagtgagccgagatcatgtcattgcattccagcctgggcaacagagtgaaactccctctctgaccaaaaaaaaaaaaagtgctgtctaacaccaccagctcaccctcgaattctttcctgggtgaagccaaaaaccctcccggggtaaggctcaattttggggcttgcctcttctacatcaaacctacattttcgatgatactctttataaaatctacatagacaaatcaattttttttttttttttttgagacacagtctcactctgttgcccaggctggagtgcagtggcctgatcttggctcactgcaagctccgcctcctgggttcacgccattctcctgcctcagcctcccgagtgtagctgggactacaggcacctgccaccatgcccagctattttttttttgtatttttagtagagacggggtttcacatggttagccaggatggtcttgatctcctgacctcgtgatccacccgactcggcctcccaaagtgctgggattacaggcgtgagccaccacgcctgggcgacaaatcaattatttttaaagaaaaatgagcctccgtttcgagatgggctgccagggtaaagcacacaccacatctcgtaggcgtcatgggaaaaaaatcctgcagaccagggatccccaacccttaggccacagaccagtagcagtccatgtcctgttaggagctgggctgcacagtagaggtgagcagagggcaggtgagcattgccgcctgagctccgcctcgtgtcagaacaatggcagcattagattctgataggagctcgaatcctgtcgtgaactgtgcatacaagggatctaggttgcctgctccttatgagaatctaactgatgcctgaggatctgaggtggaacagtttcattctaaaaccatcaccacccatcccgtgttcgtggaaaaattgtcttctaccattggtccctggtgccaaaaaggttggggaccactgctgtggactatctcattaatcattttttttttaggattgattatatgtgggaattatttatttatttatttattttgagatggagtcttgctttgttacttaggctggagtgcgacgggatgatctcagttcactgcaacttccatctcctgggttcaagcgattctcctgcctcagcctcctgagtagctgggattacaggtgtgagccatggtacctggcccattcggcatattttagtacggagatggtggtcaggcacggtggctcacgcctgtaatcccagcactttgggaggccgaggtgggcggatcacctgaggtcagagttcgagaccagcctggccaacatgatgaaatcccatctctactaaaaatacaaaattagccaggtgtggtggcacacgcctgtaatcccagctactcgggaggctgaggcaggagaattgcttgaaccccagaagtggagtttgcagcaagccaagatcatgccactgcactccagcctgggcaacagagtaagactcaagtctcaattaaagaaaaaaaaaaaaagaaaaaagaaaatattagctgtcacttagcaccctcttcctcattgcctttttctacctgtacaaagagtggccattaaccaggtacccattatgaagaacttgaagcatccttcacgcccactcagagatgttaaaagccagcagaagtcctcgtgtctatttctgccttcatttctaacatcctctgggtattttctgtcccagtggtaaactgctctattgtctttcactaatagggacacatacggctttaatgaattaagagttagattcataggatatttaaaaagaaaagcaattcttgattgttccctacaattatagctgtttaatctttactcataacaactttagtgagacagaattcacatgacatacaattcacccattttaagtgtgcagttaggtggttttgaggacatttacagttgtgcaactgtgaccacagtcagttttagaatatttgcatcatcttcaaagaaaccctgtaccctctagctactactttccatcccccatttccctagctcttggcagccacgaatctattttctgtctctatggatttgcctctttcggatttttttgtatgaatggagtcagacaacatgtggccttctctgtttgacttcttttatggagaaggttcatacctgtaatcccagcactttgggaggccaagactggaggattgcttgagttcaggagtttgagagcatcctgggcaacatagagagaccactatctctacaaaacaaatttaaattagctgggcatggtggtgcatgtctgtggttccagctatactggaggcataattttgttttgtttttgtttgtttgtttgtttttgtttttgtttcgtggggtttttttggttttgttttttgttttttgagatggagttttgctctgtcacccaggctggagtgcaaaggcacgatctcagctcactgcaacgtccgcctcctaggttcaagccattctcctgcctcagcctccgtagcagctgggattacaggcatgcgccaccccgcccagctaatttttgtatttttagtagagacaggttttcaccacgttggccaagctggtctccaactcccgacctcaggtgatccacctgcctcagcctcccaaagcgctgggattaaaggagtgagccactgtggctggccttttatttacatttatttatttatttatttagagacggagtctcactctttcatcaggctggagtgcagtggtgcaatcttggctcactgaaacctccaactctctggttcaagtgactcttctgccttagcttcccaagtagctgggactacaggcactcgccaccatgcccagctaattttttttgtatgtttagtagagatggggtttcaccatgttggccaggatggtctcaatctcctgacctcgtgatccgcccacctcggcctcccgcagtgctgggattacaggcgtgagccactgcggccagcctgtatttacttttgagacaagatattgctctgttgcccaggctggagtgcaggggtacaaacacagatcactgcagtcctgacctcctaggctcaagcgatcctcctgcctcagtctcccgtgtagctgggaccagagacacacaccagcattcctagctaatgttttaaatttttatagagatggagactcgctatgttgcccaggttggtcttgaactcttgggtttaagcaatccttccgtctctacctcccaaagtgctgggattacaggcgtgagccactgcactcagcctcagctattatgaataatgctgctatagacatttgtgtacacgtctttgtgtggacgtatagtatcatttctcttaggtagttacctaggagtggaattgccaggtcatatggcaattcttggtttaatattttgaggaactaccagagtgttttccacagtggctgcactgttttacatccccatcaggaatgcaaaaggataccagtttctctacattttattttttctttgagatggagtctcgctctgtcgcccaggctggagtgcagtgatcttggctcactgcaacctccacctcccaggttcaagtgattctcctgcctcagactcccaagtgtctggaactacatgcgcctgccaccacgcccagctagttgttttttgtatttttagtagagacggggtttctccgtgttggccaggctggtcttgaactcctgacctcaggtgatctgcctatcttggcttcccaaagaactgggattacaagtgtgagccacggtgcccggcccatttctttacattctttgcacttgtaattgtcactctttttggttttagctatcctagtggggataaagtggtatctcactgtggtttgaatttgtatttctctaatgtccaacagccagttaatctttcctttttttctgttttttttttgagacagagtcttgctccatcgcccaggctggagtgcagtggtgtgatctcggctcactgcaagctccgcctcccgggttcatgccattctcctgcctcggcctcccaaatagttgccactacgggtgcccgccaccacgcctggctaatttttttgtattttttagtagagacggagtttcaccgtgttaaccaggatggttttgatctcctgacctcgtgatcagcccatcttggcctcccaaagtgctgggattacagccatgagctggccaccacgcccagccgttgtgtttttttaatcgagacgaggtctcactctgttgcccaagctggagtgcagtggtgtgatcacagctcactgtaacctcctattcctggacccaagtgatcctcctgtctcagcctcccaagtagctggaattacaaccacatgccaccatgcctggatatttaattattattattattttttagagttggggtcttgctatgttgcccaggctgactttaaactcctggcttcaatcgatcctctcactgtggcctcccaaactgctgggattacaggcatgagccactgtgcccagccctagttaacctttgaatgcatattcatgtctgattttggttctgccatagcctggggaggatggcggccaagtgttctttctacctgcagtgtgtgtgtgtgtgtgtgtgtgtgtgtgtgtgtgtgtgtgagagagagagagagagagagagaaatgaaatatagtgtgggactcagggttgagaagcccagggctatggccaaatctaagattaggatgccagccaggcatggtggtttatgcccgtaatcccagcaatttgggaggctgaggcgggtggatcacgaggtcaggagatcaggatcatcctggtcaacatggtgaaatcccgtctctactaaaaatacaaaaattagctgggcgtggtgttggacacttcttgggaggctgaagcaggaaaatcacttgaacccaggaggtggaggttgcagtgagccaagatcacggcactgcacttcagcctgggcaacagaacgagactccacatcaaaacaacaacaacaaaaaccccacaagaatttcatagaaacaatgagtaattttttttagggtaagttatgtcccaaacattacatgggatatacttatcctcaaaaaggtattattgcttatctgaaattcaaattcaactaggcattctgcatttttctttgctaagtctggcaaccctgccagtcactggtgagttgtgtgtccttgagtgatggtctttgcctcttggagcttcagttttctcatctatgggatggggacagaacttgctgggaggcaccaatggcacgcggggttctttgacatctctggatgtggaagctgttgatgtgactgactgggagcctcagactggggttgggtccctgactaggaggggtgggggggctgggactggcatccttgtcctcttgaagctgcctcccagcctgagcttggtccctgcagggttcctgcttggttcagaccccaggcagccagtgttgaggggagggtggagattaatccatagttgtgtactggggctttcctccaacttcctagcaagcaagtgtgtgtgtgtgtgtgtgtgtgtgtgtgtgtgtgtgtgtgtgtgtgtgttttctcgacttagcctaatccatttgctgcatggaatgtgatccaggatcactgctactttttttttcccatttgtttgcttttgctgtgttttgtcgttgttattgttttttctaatttgtgcttcttttgtgggtaattctcagggtggattttttttttttttagaggatttactattcttctttagaacaatctgttttcctcaaagatattggtggaaggtttagtgttttggaacaaaataagcaggggttgtatactgagccttatattctaggtgctgaggactgtggtgtgtgtgttggggaggcggtgtgtgtgtgtgtgtgtgtgtgggtgtgtgggtgtgttggcagagagaagccatctaaagacttcaattttgaaaaacgttaactcaggtgtaagggacacaaggaggagaaacacgcaaataggtgtgccaaggaaaggaaatcagggacggctgcctggaggaggaggcagcatttgaactggatatcttgaagcatgatgggctggatttagaaatagggagctaaggtacaaagcacttcgccagccaaaagatagactagcctagagatgactgttatatgtttgggggaataaacaacagcaagaagaacaacaacaacaaacaacaaaatagctgacattagtgcagcacttactatgtctcaggcactgtttgagtgcttgccctgagttgtttcacttcttcttccatataagccatgttacagaggaggataggagtcttggagttgtgcaagagttgtgggcaggcctgtttagtggtgtgcaggggatgtaggggcagaatcttgagggaagtgcaggatgatggggagccatggtgggcgttggggcctgggagggaccgccttcaggagaatgagaactcagggcatttgggcaatggagatcgggctccctgggaagccctcaccacacccaggtaaaaggtaattaggtcttgattgcaggtcaggagagcagtccgggaaggaaagtcagccagcgaggtgggaggattgacaaaacaaatacatttagctttccttgccccatttctgaccgcgggcacctttatccccgtaaattatctcctgaagatcttctatgttgacgcactggagacagttcccctttctccttctgcacctgccgcgttactcaatcccctgtaatcccattgtcccgactgcatcatttcagaggtggtgattttaaggattttaacagggcttgccaaaagaattattttcttggcgttttgaaagtaattacttaggcatgggtactttacagagaaagctactcatcccggctggctgcagagtttacagggcccgggatgaaaacacagggcccaggtttcctgtccatgaagccggctctgcccctgatccttctgatgcatccaccgtgcgtctgctcacctgtcttgctttctgttcattttctcttgtagtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtaggggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatgactgtggctgtgtttcaataaaactttatttacaaaaacaagtcgtgggccggattttgctcgagggcagcagtttgccaccgcctgtgctagtcagtgaatgttcttcttgcttgggagaggaaaaggagtggaaaactgtagattcggtttttttaaaaaaatagtttagttcttatctgattatagaagtgatattgcttataatagacatttggaaaaagacacttgtaaacgaaaaaaaagcaaaacattcatcttattccacaacgcatgtcgccgagagtagtttattgggggttgttccttctagtgatcttcaggaatctgtcgtgtctactgaaggtttccttaaccattcctgttattgggcattaagatgatttccaggccgggcacggtggctcaggcctgtaatcccagcacttggggaggctgaggcgggtggaccacttgaggtcaggagttcgagaccaacctgaccaacacggtgaaaccccatctctactaaaaatacaaaattagccgggcgtggcggtgcacgcctgtagtcccagctacttgggaggctgaggcaggagaatcacttgaacccgggaggcggaggttgcagtgagccgagattgtgccattgcactccaccctgggcaaccagagggaaactccttctcaaaaaaaaaaaaaaaaaaagataatttctagttttcacaaagagagtgatgaacattttagagtcaaagctttatctagcagttgtttctttaggcttgctttccagaagtgcaatttctgggtcagaggctcttggtgcagattgacaaatggtgttccggaaatgttgtgccaacggccactcctcctagctttggaggagagggaacaccttggccagctttgagtgttatttgaaaaatctttcataatttactgcgggagggaggagctgacgtgttgtcattgtttctatttgcatttctttgattgctatcggggttgaaccttttaaaacatgtttatttatcatttgagttttctcttcctgttcatatcctttgcccatttgtcttttagtacctcagtagcttttgcaaaattaatctgtatgtggttttcatcagtgaaggctactaaccctttgccaattgcattttgttgtttttgttgttcagtggtttaaatgctctgggaagtgttttgctggagaagcttaaaatgtttatggagttcagagctggatttcagtgtgccacttctgtactttacacttagaaagtcttcttctacccatgaaaggttttttttctctacattttatattttaattttttttttttttttgagatggagtttcactcttgttgttaagactggagtgcgatggtgcaatctcggctcactgcaacctctgcctcccgggttcaagcggttctcctgccccagcctcccaagtagctgggattacaggcacccaccaccaagcccagctaatttttgtattgttagtagagacgagatttcactacgttgaccaggctggtctcgaactctcaggtgatccacccacctcggcctcccaaagtgttgggattacaggcgtgagccaccgcgcccagcctatattttaattattattatctaaaaaaattcatcctcactacttgagatctgtttgtgtgtgtgactcaacgggcgtttcgtttctctcccaaatagctaactgggggcctcagacagctgttgattatagaaatctacctctttgccattgctttggggtctgtttctggtgtgtccatagatctgcctctccatgccacagagcggtgactgttctgatcatggtagtgactgttctgatcatggtagttttatcatgttttcatgctcaaggaggcaattccacattcacacattacttgtttgttgtttcatggacttcttttcacatttccctgggaagaactagggaacatgcgatggaggtgggaagaagttaagtgggtggcttgagggttgtatcacaaaagatagaagggaggggagaaaggaggatcttcttatctgagcccaacgctctggggaagccacccagagtgagtgagtccttaaatagacctaaatagaatccttggaattgtctgtgaggactcccttggagcccccagcatgagtccttccatgggacatgttggatggttggaaatcgggagtgggatagttgaaaaaggaagatgggttagtgaagggtggtgggagaggggaccgttattattgcactgtggaaaaatcctgagaatattgtaggtcaggggcaaggagaagctaaactatgaccagagaggttacttaacttgcccagagccacacagctaataaaagacagaactggggtttgtgccaaatttatgcaagacatacaccagaataaaagctatgattttttggaggagtgggaaggatgtcctctctgtttagaaacaagtgagctgcttctagctgggacaccaggggaaacagtgaacattcttttattctattactgagttttccaaatgtagtgcttgtttgaaaagctctaggcctacctatcttgagatataatttaagacattcctctatgaatttatttttgtatctgttttagacaaaatatccagaatggtgttatctgcaattgagtctcctgctccctgctgggtgttcagttgttgttgctgttgtttgtttgtttgtttgtttttgagacagagtctcgttctgtcacccaggctggagtacagtggcacaatctcggctcactgcaacctccacctcctaggttcaagcaattttcctgcctcagcctcccaagtagctgggattacaggtgtcaccacatccggctacttttttttttttttttttgagatggagtttcgcttttgttgcccaggctggagtgcaatggcatgatcttggctcaccgcaatttctgcctcctggcttcaagcgattctcctgcctcagcctcccgagtagctaggattacaggcatgcgccaccacacccagctaattttgtatttttagtagagatgggatttctccatgttggccaggctggtctcgaactcccgacctcaggtgatctgcccgccttggcctcccaaagtgctgggattacaggggtgagccaccgtgcctggccaacacctagctaagttttgtgtatgttgtagagacagggtttggccatgttggtcaggctggtctcaaatttctgagctcaagcacctcggcttcccaaagtgctgggattacatgcatcggccactgtgcctggctgtgcctggctgtgcctgatgttttgagtgaattaaaaattgctttgctattaagaaccaggcttttgtgtccaggaggtcgaagctgcactgagccctgttcatgccactgagctccagcctgggtgacaaactgagactctatctcaaaaacaaaagaaaacaaaaacaaaaatgaacacaaaacaaaacaataaaaagaaccgggcttgtttttccagtactgggggttttgttacccggagaaggtgcgactaacacttcccggggtaccgggttcctggcatgtggtatatatctcagccatccattagtagcagtatccccagggggccaaaaaatgattgttttttgaactgttgcccctgtctttgagagcaactcagcttcagctttctttcccctcttcaatttcttgtattgtgataaaatacacatagaataaatttttcatcttaactttttttttttttgagatggagtcttgctctgccacctaggctggggggcagtggtgtgatctcagctcactgcaacctccgcctcctggattcaaatgattctcctgcctcagccttccgagtgactgggacttataggcaccagccaccatgcccggctaagttttgtattttcaggacagagggggctttgccatgttggccaggatggtctcaaacccctggcctcgagcaatacacccacctcagcctcgcaaagtgctgggattacaggtgagtgccaccgcgcctggccccatcttaaccattttaagtccacagttttcagtggcattaagcacgttcacgtggttttgcaaccatcaccaccaccatctcccaaactttctcatcctcccaaactgaaactctgtccccatgaaacactcactccaccatctccctctcccagccccctggcacctaccatcctattttctgtctctatgaatgtgatgactgtagggacctcctgtgagtggaatcagacgggatttatccttttgtgcctggcttatttcactgagcatgttgtcctcaaggttcatccacgtggtagcctgtgtcggaaattctttcctttttaaggctgaatcatgttccattgtatggagggagcacattttgcctgtgtattcatccatctacgggcacttggtcgctttcacatttctgccattgtgaatcagggccactgctgttgacgcatctagcttttcaatgcctgcattaaccttgttgctgaggctttaggaaacttatttatttatttattttttgagacggagttttgctctcgtcgcccaggctggattgcaatggtgcgatctcagctcactgcaacctctgcctcccgggttcaagcgattctcctgcctcagcctcccgcgtggctcggattacgggcacctgccaccacgcccagttaatgttttggatttttagtagagatggggtttcaccatgttggccaggctggtcttgaactcctgacctcagataatccactggcctcggcctcccaaagtgctgggattacaggcgtgagctaccgcgcccagccttaggaggcttatttgatgtctgatgggatttttgaatacagaatagattgagccttcagaggatactcccctgtcttaggtgacagaaatgggctggagaaaactatccatcaacccctcttttcccccagagtcttttcagatacttctgtgaacatccgtagttgctatttttgtcttccacacttggcagcttctggaagcatcaggggaatgcatcaacatttaggatgaaggtgctggtttgtcctttggacctagtttaagcaattccgagcaacatccaccccttcttctacctgtcccttaagcactttttacagggagaccaaaaaaaggctttcaatggttaagggggccgggtgtggaggccccacacctgtaatcccagcactttgggaggccgaggtaggtggatcgcttgaggtcaggagttcgagaccagcctggctaacatagcaaaacgctgtctctactaaaaatatgaaaattagccaggcgtggtggtgggcgcctgtaatcccagctacttaggaggctgaggcaggagaatcactcgaacccgagaggcagaggttgcagtgagctgagatcgtgccattgcaccccagcctggccgacagagtgaaactccattttttaaaaaaagaaaaaaaaatggttaggggaattaaaagaaaaacaaaaaaacatggcatgtgctaatgatccatagcctggacaccctctctccattatcctgcaatggatttggggcaaagataccaggagaggtccaatgcacgaagccttacatgggaagagtggagacggggtctatgcagttcgtttattgactgcctactaggtgtcatgttctggggcgctcagggcataggaagggagccagcctttgcctcctcagagcggccagtctagtggcaaatgcagatgttcacgatcaaaccaagtacactcagaagagggggagagttagagggagatctacattagttcagccagctggacgcggtggctcatgcttgtaatgccagcactttgggaggccgaggagggcagactgcttgagctcaggagttcgagaccagcctgggcaacatggagaaaccccgtctcgacaaaaaatacaaaaattagccaggcatggtggcaggtgcctgtaaccccagctacttggaaggctgaggtgggaggatcgcatgggccccgggggcggaggtcgcagtgagctgagatcacaccactgcactccagcctgggcgacagagtgagactcggtgagactctgtctttaaaaaaaaaaaaaagaagttctttgaggcaagcagcaccggcttccagtctcgttttaccattgactggtcacaagctggttcaagcctcagtttctccatctgaaaaatgggggtcattatgggacctgcttcttagggtggtggtgtgggggttgaatgagatggtgcagggggaggcacttaacctagcctcaggtgctccgtgagtgtcctggaagcttccagtaagtaagcaccatgggcccaccctatctgggcagactagcttccaggtgaatatctaccagggctcagcctcatttctgactttggttttgaggcaggcagaggaacatgtatcttgcgacctgctgatgagggatgggtgccacacctccagccccagagggaagaccaccctgatttttgggtgccaacagcatgggatgctctggaaattctcagctctgggcattttgaggggaccagaagccacagggcttgcctgaccagctgctttagccaaacccactggcattttctttctgggaggtcaccccagctgctcactgccggccagaggggtgggtgaggccgggacatgctgggtgccaggggaaaccaacccgagatgccacatatggacgtcggcaccaaagcaggagggggaggctgaaagcagcaaatccctcctccctgggtctgagattacagctccgagtcaaagtctctcaaagtgtggtattgtgcctaccacattaaatatcacgtatttaaatgcacgagtttaaatgcatgctcttggagggtttgatttttggcagaatttttagctgcctatggaaactctctgcttctttttcttcttccatttaaaaagtttgccttgatattttatttttttacatttttatttagtttttaatatttttttaaattgagatgggagtcttgctatgtggctcaggtcggtctcaaactcctggactctaaggaatccccccacctcagcctctcaaagtgctgagatttcacatgtgagccaccacgctggacttgacttgattttgttttctttttcttttttttttttttgagacagagtctcgctctgttgtccaggctggagtgcagtggcatgatctgagctcactgcaacctccgcctcctgggttcaagcgattcttctgcctcaacctcctgagtagctgggattacaggcacgtgccaccatgcctggctaatgtttgtatttttagtagagatggggtttcgccatgttgcctaggctggtcttgaactcctggcctcaagtgatccgcctgccttggcctaccaaagtgctgggattacaggtgtgaaccactactctgggcttgccttggtattttaacaatcggaattgtctttgtggcaaatgctgatttcatgccagccgtggttctgggtgctttgattaggatattgcatcccatcttcccaacaatcttatttattgttgagaccactaaggcttcgagaggttaagcaacttctacttccaacactgccccgcccaccccttccgccgcgcaccccacacacatgggtagtaagtagtggagatgggatttgaagctggggattctggctcagaatccaagctctttacctttgtgtcttatagatgtcattgcgggaagttggtgaaatgcaggaaactgtaaaaagaaaggaaggaaggagggaaggaaggaaggagggaagaaagaaaagaaaaggaaggaaaaaaggaaggagggaagaaataaaaggaaagaaaggaaggaaggaaggagggaaggcgggaaggaaagaaggagggaaggagaaaggaaggaagaaagaaaggaaggaaggagggaaggaaaggagggaaggagaaatgaaagaaggagtgaaggaaggaaggaggaaagaaaaaaaggaaggagggaaggaaggaaggaagaaggaaaggaaggagggaaggaaggaaggaaagaaggaaaagaaactggagaggaaatctagaatttgcccctgccaacatgtgtgttgcctcttcttatcagccttctcattctgtcttgacttagggcctctcctatcagactaagctctcctgaaggcagggactttgttgtatctcaagcacctgtcatagtacctggctcacagttgacaatgacatccttaacactcatcaatagctagtgtttactgagcacttactatgtgctaagcaatgccttaggggatcccatcacagcctatgagggtttgttatcctcattttacagaagagggaactgaggcatggctaggaattatgagacttgctctaggagacctagctggggaatggtttgacttcagacttgtctgacgtaaggcctttgcccagtgatcagcaaactacgacctgtgggccaaatccagtccgccagctgctatttttgtatgacctatgagctaagaattttttattttatttttatttttagagatggggtctcactctgtcgcctgggctggagtgcagtggggtgatcataggccactgccacctcagtcagcctcctcagtagctggaaccacaggcaggcaccaccacgcccagctaatttctttttatttttttagtagagatggggtcttgctatgttgcccaggctggtctcaaacaattgggttcaagcaatcctcctttcttggcctcccaaagtgctgggactataggcgtgagccactgtgcttgcctggcttaagaatgctttttcacatttttggccgggcatggtggctcatgcctgtaatcccagcaccttgggaggccgaagcgggcagatcactcgaggccaggagttcaagaccaccctggccaacatggagaaaccccatctctactaaaaaatgtacaaacattagctgagcgtggtggcgggcacctgtaatcccagctactcaggaggctgaggcaggagaatcacttgaacctgggaggcggaagttgcaatgagtggagattgcgccactgcactccagcctgggtgacagggtgagactctgtctatatatgagctggacattcagcattcagggatagaggctgtttcagtgggacttgggagcaccacggcctgaggccatacagcccagctgccctttgctggtacttccttccttccttccctctttccttcctttctttccttttctttcttccctccttcctttcttccttccttccttactttttgagactctgtctcaaaaaagaaaaaaagaaaaaaaaatgtggggtagagcactgtactgaaaaaaattccacagtagttgtaattcatttttcactcagatgattagcattttttttttttttttttggagctctctgtttgggtggaggagggcagtatatgtacaaggcaaggcccccactccaccctcctccctcctcccaccccgcctttccccttcgagtgagtcatcgaacccgtgcttctagacgtgtttggagcagagcacctggaaatcatgatgttctctagataacagggaatattgataaattcccttgtggcgatgtcactgtcgtccatacagaagacaggaaagtgtaacgcctgcacacggggatccaacaaaaagaaaaagataaggtgggggaggccgggcacggtggctcaggcctgtaatcccagcactttgggaagccaaggtgggtggatcaactgaggtcaggagttcgagaccaccctgggccaacatagtgaaaccccgtctctactaaaaatacaaaaattagctgggtatggtggtgggcacctgtaatcccagctgcttgggagactgagacaggagaatcgcttgaacccaggaggcggaggttgcagtgagccgagattgtgccactgcactccagcctgggtgtcacagcgagactccatctcaaaaaaagaaaaaaaaaaaaaaaaaaaaaggtagggtagagcatgtaacgtgaatgatggcccacttgaatctctcattcgtctttcttcccttttatgttgtcaaagatctttaaaaaaaaaatctaggagagaaacaaacaaaaaaaactgtactgaaaaaaattccacagtagttgtaattcatttttcactcagatgattggcatttttttttcttgttttttctttttgagacaagggtctcaactctgttgtccaggctggggtgcagtggcgcaatcttggcttacttccgcctcctgagtagctggaattccaggcacgcaccaccatgctggctaatttttgtattttttgtagacatggggtttcaccacgttacccaggctggtcttgaactgctgggcccaagcaatccacctgcttcaacctcccaaactgttgcattatattataggtgtgagccactgtgccagccaggattggaattatttatttatttatttagtgagatggagtcttgctctgttgcccaggctgaagtgcagtggcgcaatctcggctcactgcaacccctgcctcccgggttcaagtgattctcctgcctcagcctcccaagtagctgggactacaggcgcccaccaccacacccggctaattgttgtgttttttttgtatttttagtagagacagggtttcactatgttggccagggtggtctcgaactcctgacctcaggtgatcctcccactttggcctcccaaagcgctgggattacaggcgtgagccgccatgcccagcccttatttattcatttttattttattttaaaataaaataaattttaaaaatttgattgaaattttttaaacaaacttttcactttggagatgattggattttgtagagcaggaaagaacaagtaccctagagagtatgtttctgggctcccggctcctcttccgggggttgaagatgaattgccgttggcctttgtaaaagaggagagattgttccagattggagtggcagagatgtgctttggtttgggtggcaaggatcacaaagaaagaagatgaggttgggtgtggtgggtcatacctgtaaacccagcactttgggaggccgaggcaggaggatcacttgaacctagaattcgagctcagcctgggcaacatagcaagaccccatctctacaaaaaattttaaaaaattagccaagcatggtgctgtgtgcctatagtcccagctactcaggagtctgaggtgggaggatcgcttgagcctgggactttgaggctgcaatgagctatgattacaccactgtaccccagcctgggtaacagagtgagaccctgtctcaaaaacaaacaaacaaaaacagaaggaaggaaggaaggaaagaaagaaagaaagaaagagaaaagacaagacaagaaaaaaaaaaaaaaagaaaagacagggtgagagggaagggtattcgggtggatgaaatggcaaagagaaggccaagaggcgttttgtgggcaagagtgaagagggtgcctcatgccgggaagggaggcttggaccagtgcagggtccttatgggctccaatgccgtcatgaaggtcacacaggggctgtgtttaggaggggctgtttccaccaatactgagtggacagccttgctgagccaggctttttgttgcgtccccgaagtccttgctgagtcagggaggaagtcaaagtaactatcaggttagataagctgatgggtgggcagaaagtgttttggtgggttcaaggctgcgctgaaagatggtagaccagttgaccgtgtggtcacttggctgccccagagatgatgctgtctaaatcttgagtggtgaagataacgaatttacaattcccaccattgcctggcttcctggagcgggtgggtgcggggaccggggaggggggccgggggaggctgagggctatcagttgaaactgaccttttggcccaatccttttgggaagaaggcgggtagagttaaaatccatcgtaatggaaaggcggctttccctttggctgtctgctaacttggtgactggcctgacaagtttttcttttccttcctcctacctgatactcactgaccggttacttcccatgtcacccgaccctttgtcagaattaaaatctgttctttgtgactgaacacctgaaatgccccggggaggacccaaggaagtcagcgagcgcctgtgcgtcaggctggcagcccaggtccttcagtgatctgtttctctcaatgcgcctgtgtcagatagaaccgtgcatttcccagtaaaaggaggtgatgtgtgtgctggagtttcaagattgtaccccttatcctatctcccctttcctctgtcttccctctctacttttttattttgttgtttgtttgtttgtttttgagatggggtcttgctctgtcacccaggctgcagtgcagtggtgcgatcatagctcactgcagcctcagccttttgggctcaagcaatcctccagcctcagcctggccagtagctggaactatgggtgcatgccaccacgcccagctaattttatttacttatttacttatttattaaagagatggagtcttgctatgtttcccaggcagctcacaaattcctgtcctcaagtgaccctctcgcttcagcctcccccattagctaagactacaggtgcgcaccaccatccctggctaatttattttttaaatttttctttttgtagagatggggattttgctatgttgcccaggctggtcttgaactcttagactcaagcaatcctcccactttgggaagcccaaagtgttaggattacaggtgtcagccaccaggccgacctgtttgctcatttttccttttccttttttcttttcttttcttttttctttttttttttgagatggagtttcgctctgtcacccaggctggagcacagtgacacaatctcggctcactgcaacctctgcctcccaggttcaagcgattctcctacctcagcctcctgagtgctgggattacaggggcatgccaccacgcccggctgatttttgtattttttagtgaagacggggtttcaccaggttggccaggctagtctcaaactcctggcctcaaatgatccaccagcctcagcctcccaaagtgttgggatgacaggcgtgagccaccacactcggcccgtttgctcatttttaaacataaatgatgtcaagagtgggaagcaaacaagaaagtgttgaaagcattgctctcctctgctccctggttacctatcatcctggggcccgaggagtggctgcagattgggccaccttcctccaatcacaggtttgggaagtggaccaaagtctttcaacacactggacttagcatgatcatcaaatttgcactggaggggccaggcacacgcctgtaatcccagcactcggggaggctgaggcgggcagatcacttgaggtcaggagttcgagaccagcctggccaacgtggtgaaaccccgtctctactaaaaatacaaaaataagccgggctggtggttggaacctgtaatcccagctactcggggggctgaggcaggaggattgcttgaacccgggaggtggaggttgcagtgagtcgagatcacgtcactgcactccagcctgggtgacaaaagcaaaacctcgtatcaaataattaaataaataaataaacaaataaataaataaaaaattacactgtagggcatgtggtaggtgaagcccaccattgtcaagtacctacctagagggtttggggtagagggtcctgtggcttcttctattttttttttttggcggagtctcactctgtcaccaggctggagtgctgtggcacgatcttggctcgctgcaacctccgcctcccgggttcaagggattcccccgcctcagcctcctgagtagctgggactacaggcgcccgccaccacgcccggctaatttttttgtattttagtagagacagggtttcaccatgttggccaggatggtctcaatctcttgaccttgtgatctgcccgccttggcctcccagggtgctgggattacaggcgtgagccaccgcgcctggctgtggcttctttatcctagaagtttctttgcctctcgttttgtcccaggcgaggagggtcttggatctttaatgactccatggcttattgagtgtagcccagaaagaatggttgtttaataggctttattaccgagtgtttccaagggcttacctggggaaggaaaacatttttactcggaggtctgataaggatgggctttaaagcgctggcagctagtcatgtccacacgcggtgtgcgaagcacggcgttgtttactgaccacctgcaaagcccgtcggctggtgaacaaggctcttgtcccaggctgcctcattggtggtgatgatgttaagagtttcctcatttgcaaataaattgactaacctagcagacgggtttgatccaaagtggtcaagattccttttctttaaatttgttttttttttgagatggagtcttgctctgtcacccaggctggagtgcagtggcgtgatctcagctcactgcaacctcctggattcaagcgattctcctgcctcagcctcctgagtaactgggattataggtgaacaccaccacgcctggctactttttttgtatttttagtagagatggggtttcgtcatgttggccagaatggtcttgaactcctgacctcaagtgatccacccacctcgacctcccaaagtgctgggattacaggcgtgcgccactacgcactggcaaatttttgtattttcagtagagacagggtttcgccatgttggccaggctggtcttgaactccggacctcaggtgatccacccacctcagccacccaaagtgctacaattacaggcgtgagccaccgcacctgggctattttcacttctttcgaagttatacctaggagtggaatcgctgggtcagttggtaattctatatttaattaatggaatcaagatttctttttcttttctttttttggttttactttaaaaaattctatcttattacataaaaaaaccacaggttcagaaaagccacaccaaacaaatgaatagcctaatggttcactctaacgtcaacactcatataatccctaactctggttgagaaatagtactttgccagaacaccccctccaaaagccatgccacggaccacatcctagtcacaggcctcttcccccagagtagtcactgtcctgtcttttgtagacatcacttccttctttctgtatagttttatcacccaagtgtgaatctgtagacaaatatttagctttgcccattaaaaaaaaaaattgatggccgggcatggtggctcatgcctgtaatctcagcactttgggaggctgaggcgggaggatcacttgaagccaagagttggagaccagcctggacaacatagtgagaccccatctctactaaaaataaaataaaaaattagccgagcatggtggtgcatgcctgtagtcccagctactcgggaggctgaggtgggaggatcgcttgagcacagaaggttgaggctgtaatgagccgagattgcatattgcactccagcctgcgtgacagagcaagaccctggctcaaaaattaacacaataaaataaattgatgtgtttgtttgggtctctagcagtggttttgaactgagggtgattttttttgtctcccaggggacatttggcaatgtctggagatattttttggttgtcacaactccagggaatgtgtgtgtactgctttcattgagcagatggaggccagggatgccgttcaacgtcctgcaatgcagagacagcccagccacaaagaatgatccagccccaaatgtcaatagtgctgaggggcagaaagcctggtccacaggttctccctccatccctttccttttaccttctctctgttgaagagctgggctttctggcttggggtgcagtccccagtctgagtgttgctgatcgtacgttcctgggacagttctgcttgcccctctgagctccagactcagagctagggtcacactcaggttctacctcttggactgactttatttaacaagtaccatttcagcactctctgcagtcagctgttttcaaaggcgaccatgcttgatgctgttcgtttgcacatggctctgagtggtggtgtgttctttgattttttttctttttcttttgttttaaagaaaaacacaccgttttttaaacacggttgcccgaactctcatcttcttcctccctgccctccctccctccctcctctccttccttccttccctccctccttccttcctttttctttatttcctcccttccttccttctctccctccctctcccttcctccctttatccttctctctttccttccttccttctctttcttttctttctttcttttcttccttttctttcttctttcttttcttctttcttccttgctttctttttatttcttacctcccttccttctctcccttcctctctccctcctccttcctctttccctttctccctcctctttctttttctctctcttcctttcatttttctcccctcccctccccttcttctcctcccctccttcccctctcctccttcccatcccctctcttcccttttcttcctttccttcttttccctccctctctctttcttttctcctttcctttcctttccctctcttttctttctttcttttctttcgacagggtcttgctctgtcacccaggctggagtgcagtagcatgatcatagctaacagcagtctggaactcctggtctcaagccatcctcccacctcagcctccagagtagttgggactacaggcccctgtcaccatgcccagttattttattttatttttttttgagacagagtctggctctgttgcccaggttggagtgcagtggtgcgatctcagctgtctgtaacctccacctcttgggctcaagtgattctcctgcctcagcctcctgagtagctgggactacaggcacctgccaccacgcccggctaattttttgtatttttagtagagacggggtttcaccctgttagccaggatggtctcgatctcctgacctcgtgatccaccctccttggcctcccaaagtgctgggattacaggcgtgagccaccgcgcccagccgctaatttttttttaatttattttttgtacagatggagtctcactatattgcccaggctggtcttgaactccagggctcaagcagttctggcacactagcctcccccaattcaatgggattacaggtgtacccattttttaaaaatgggccagactaaatatttgtctagagatccatacttgagtgataaagctatatgaggttccatctgggaattcggttctgcggtaaaacggtgccgacgggcctccctttttttagtgtctgacaaacagggcacagaccgaacttcataacaaaactttgtgttcttgacgaaggcaagttttgctaagaaaattatttttataagcgagaaaggtatgaaggttatttgcaaaggaattttactggggtgagaaaaaaagcaagaggtttaccttaggattcctggtggtaaagaagatggaatgggcagaagacgtcatcacagatgtcacggggagagcgatagctgaacctctgaaaggaaagaggttcccagggaaggatgaatttgatgcaggaaaaaagttagaggatggtcttaaatttgtcaatgtagttcagaggaaagtgtaattcttcacagacttttagttttgaaaggatggcttcaaaagatactgggggacatgggcgcagtaactcacgcctgtaatcccagcattttgggaggccgaggtgggcggatcatctgaggtggggagttcgagaccagcctgatcaacatggagaaaccctgtctctactaaaaatacttaattagctgggcgtggtggcgcatgcctgtagtcccagctacgtgggaggctgaggcaggagaccatcgcttgaacctgggaggcagagtttgcagtgagccaagatcacgccactgcactccagcctgggcaacagagtgagactccgtctcaaaaaaaaaaaaaaaaaaaaattctggccaaccgggaatagtccaggataatccattcttcagaacttgttcttgctaactcagttaagtgtcgaatggcgtgggttgtctactgtattttagaggacattagaatatttatgaagggctttcccaggtttactcataacttcattttcctcatgctatttgtcccttaaagtctttctgaaatctttcagttgccacttcttctgggtgggtgggtatgtatgttgagggtcatgctttttttttttttttttttttttgagatggggtctccctctgtcgcccaggctggagtgcagtgatgtaatcacacctcactgaagcctcaacctctcaggcttaagtgatcctcccacctcagcctcccaagtagctggcactacaggcatgaaccaccgtgcctgactaatttttaaaaaatatttttgcaaaattagccaggcgcggtggtgcacgcctgtagtcccagctacctgggggactgaggtgggaggattgcttgagcctgggaggttgaggctgcagtgagccaagatcatgccactgcactccagcctgggtgacagagcgagaccctgtctccaaaaataaaaaaataaaaaataaaaaataaaagatggagtcttgctgtgttgcccaggttggtcttgaactcctgggctcaagtgatcctcctgccttggcttcccaaagttctggaattataggcatgagccactgcacctgtctgggtcctgcttttggtagtgatatagaaccaacttagtgaaattctagaatgacgctgtccactaaggtagctctgccagccacagccacatgtggcaatttaagtagaaattcattaaaattagatatttgtccctcagttgtactcaccatatttagacaatgcagacagacaatgttgctatcactgcaaaaacttgtattgggtacctctgccttagaacttttcattccatgatgaaagattgttctggagtcagacaggcctgcatttgaagcctatatctgttttgtgaccttgggcaaattgtctagcttttctgaatgtctgttttttcttctatcatgaggacatgataagggaaccagtctccaaggttttcctcagctttgaactggtatatcccctctttcgataaaaataaaaatccagttcctcttccctacttggagtttgttcttttttcctctaaatataaaatataccgttgaatgttttttcaacctctccaccccttgagagtccctggaatagagaggaaggagtggcttgggaaagttgatcacaacaaagaggctattataggtacatctaatcgagaagaggaacaaggaaggagtaggtgtgttgaccggggctcagagtgtcttgtctgtgggtcaccaagaatgaggaatgtgtcagctccttcctggcttctcctctctgggaacagagaacagtgcattgcagcttaagtggagtaaaatgggtgtgggtttggaggaagtggattaaggatggggaaggggccgtgggagagaaccccagcctgagtttgtcttcctggctcagcactgagtgtctcagtcaacacatgaatgccagtaatgggaatctatttggattcacttaagccatgaggtgggggcagtgtgttaactggggcaacacagggctctcagcttgaatcagctagcttttgctgtgtagcaaaccactctgaaacacagaccttggaatttatattcaagtttaatcatggagcttgtatcagctagcttttcctgtgtagcaaaccactctgaaacatagaactaggaacttgtatccaagttcattcatggagcttgtatcagctagcttttgctgtgtaacaaaccaccctgaaacatacaacttggaacttgttgtatccaagttcagtcatggagtttgtatcagctaatttttgctgtgtaacaaaccaccctgaaacatagaacttagaacttgttgtatccaagttcaatcatggagcttgtatcagctagttttgctgtgtaacaaaccaccctgaaacataaaactgggaacttgttgtatccacgttcaatcatggaacttttatcagctaacttttgctgtgtaacaaactactctgaaacgtaatggcttaatcaacaatcatgtacttagctcatgattctttgggtcgctgggcaagttttcttgtttagacccaccagctgaccacaaacacaggctcttttctctctcatgtctgggatcaaccagtgggttgtctggtagctggatggtctagcatggcctcactcacatgtctggtggttggtgctggctgtcagctgggaggccttggttttcttccctgtagctgctcatcctccagttggctagtttgggcttagattacatgatagtctcagcgttccaagagtggcaagagatcaatttccagtacaaaagtgccttttgagtttctgtttgcatcttgtgtgctaacatcccattggctaaggtgagctgggagggaaagggagaatatagtctttacctgttgatggaagaggaagaatttgtggccctgtttgccatctgccaaagaaccctggagtgggaaacagtggggctcataaaacatttttttaaaaacctcttattttaggttcatgagtacaataacattttaatcagaatttggagctcaattggacatcaggactgtgtatggtgtgactgaggacattaaatgatttttttttgagtaggaatttaactttatgaattccacttgttgaataaccaattccttccccagtaattcttgatgttttcttcatcaggtattaaattcaaccaaaaccatgaatttgcttttgggatatcaattctatttcaagtcctctgtgtcttaatcttatcccagtaccatactgtttatagatttagaatatgtgtttttttagttttgtttttgttgtcgttttgtttttaaagaagtggggctcggctgggcgtggtggctcatgcctgcaatcccagcattttgggaggccgaggtggctggatcacttgaagtcaggagttcgagaccagcctggccaacacagtgaaaccccgctactataaatacaaaaattagccgggcatggtggcacatgcctgtagtcccagctacttgggaacctgagacaggagagttgcttgaacttgggaggtggaggttcaatgagccgagattgtgccactgcacttgagtctgggtgacagagcgagattctgtcttcaaaaaaagaatgggggctcactgtgttgcctaggctggactcaaactcctgggtgcaagtgatcctccttagcctccaagttgctgggactacaagctcatgcctggtaagaacatgctttataaagtggcaaatctagttttttccctattacaccttttagaagagtgtttccttttctggttgaactaaatatttccctcctctcactctcatataaaacccattgagggctgggcgcggtggctcacgcctgtaatcccagcacttggggaggccgaggcaggtggatcacgaggtcaggagatcgagaccatcctggctaacacggtaaaaccctgtctctactaaaaatacaaaaaaattagccgggcatggtggtgggcacctgtagtcccagctactcgggaggctgaggcaggagaatggcgtgaacttgggaggcggagcttgcagtgagccgagatcatgccactgcactccagcctgggcgacagagcgagactccatcttgaaaaaaaaaaaaaaaaaaaaagcaaaaacaaaaacaaaaaaacccattgagatattgatttaaaaatttaattaaaaacataacccatttcccagaggaaaaaaagtgcagctcgctgccagcactcctttaattttacataaacatgttctttgaggctgaagcaaatctgactgattttcaatatgagaaaatataaaacggttcttggagttatttctaaacagaacttgtctctaatcttaatgtaacagaaatgtctataatgttacattaggattagagaatagattattcttgggacaaatggaaaaatgggttaaaatccataaattaagaaatcaatactttcgtatttttcctttccgggcaggtatgggatctccttttccatttgctcaaatctttttttttctttttgagacagagtctcgccctgtcacccaggctggagagtagtggcacgatctcggctcactgcaacctctgcctcccaagttcaaacaattcttgtgcctcagcctcctgagtagctgggattataggcacacaccaccatgcccggctaatttttgtatttttagtagagacggggtttcaccatgttggccaggctggtctcgaattcctggcctcaagtcatctgcccacttcggcctcccaaagtgctgggatgacaggcatgagccactgcgcccagccaatttgttcaaatcttttatattgtcctttcttcatctttatcctgtattatttttgtgacgatggttcctgatttctgtatcacagagttttgttgtgttagttatggctactatgaatagcatatttaccctgaatccagatactttagtgaaattgattggtaggtttttaaattgttttattcattgtgtgcaatttcgtcctctacaaattatggtcatttaaaaaaattatgtctgctcagttctggaagcatgaaaaaaattatgtctaaaatcatacctcttgtttcggttttaaatcttattctattgaccagggcttctagactaacattaaatatttaacaatggtattatccgacatctatgtttaatagatttcctaatataaaatcatccttgctttcctgtggtaaaacctacttggttgtgatgaattattctttcagcataatgttgaattcgatttgctaggtttgctttgtttcgttttctgaattcttgccatctgtgttcatgagtgaaattgggctatgtttttggttggttttattttgcaatgtcttcatcagtttggattatttattgtgttctagccacataaaatgaaatagcaggtaactgagtattcattgacaaattttatggtgccataacttttggggggaagcaattctttgataacttaagaaaaaatttaggccaggtgcggtggctcatgcctgtaatcccagcactttgggaggctgaggcaggtagatcactggaggtcaggggttcgagaccagcctggccaacatggtgaaaccccgtctctactaaaaatacaaaaattagccaggtgtggtggcgcacgcctgtaatcccagctactcgggaagctgaggcaggagaatcacttgaacccaggaagcggaggttgcagtgagccgagatcgcaccactgcactccagcctgggcagtagagctagactgcatctcaaaaaaaaaaaaaaaaaaaaaaaaaaaaaccaaaacagtgtgtgactggctgtgacgtaaggcagtcagacctctccttcgaaatgggccgtgattcatctttatttttgtagggctgtgtcacgttagaaccactacagcaaaagttttcattggaaatctaataatgtttttttagtctgccatctggagtctgtgctccttgtatgtctttattgttcaagactaagagtggtgtgtgtgtctgtgttggggggatggggtttggtaattttgctaacatggctctaagaatctgtcccgcttcccaaaacctcatttttctctgctttagcagtagcccaacactgaaaacagagtactgcttttttagaggagttctgatttggattccttttctttctttttttttaggccaaaattttcatttataaatagcttctgtggtacacaacatgcaaatatttttggtttcatgatattacaccagagttgcagagttgtagctgttttttttttttttttttttgaggcagtctcgctgtgtcacccaggctggagagcagtggtgcgatcttggctcactgtaacctccacctcccgggttcaagcaattctcttgtctcagcctcctgagtagctgggattacaggcgcccacaccacacctggctaatttttgtgtttttagtagagacggggtttcaccatgttggccaggctggtctcgaactcctgacctcaagtgatctgccctcctcctcagcctttcaaatgctgggaatacaggcatgagccaccacacccggctgaacttttattattttaaaaacatttttatttatagtaaaagtcacacataaaatgaaatttgctgtttttagaaagaatgtttaaaaagatgtgtaccatgttgcccagtacagtggctattcagaaacagccatagtacaccacagcctcaaactcctgggctaaagggatcctcaagcttcagcctcccaagtagctggggctacaggaacacaccaccacatctggcttgcctccttctccttctctttctccttttccttctccttctcctcctccttcttctttttttttttttgagacaagagtctcactctgtcacccaggctagagtgcagtggcatgatcttggctcactgcaatttctgcctcctgagttcaaagcaattctcctgcctcagcctcctaagcagctgggattacaggtgcataccaccatacctggctaatttttgtacttttagtagagacggggtttcaccatgttggccagtcccgaactcctgacgtccagtgatcctcctactgcggccttccagagtgcacaggcatgagccactgtgcctggcttgttttcttctttttttaaatttaatgagtttaggcagggtttctcagcctcaacagtgttagcattctgggctgaacccctctccgtggtggggactgccctgtacattacaggaagcttagtagcatccctggcctccactcaataccagtagcaaccccaagtcatgacaaccaaaaatgtctccggatactgccaagtgctgggatcacaggcatgtgccaccatgcccagctgatttatttttattttattatttttgagacagtctcgctctgtcgcccaggctggagtgcactggcacgatctcagctcactgcaacctctgcctcccgggttcaagtgattctcctgcctcagcctcccaagtagctgggattataggtgcacgccactatgcctggcaaagttttgtatttttgtagagacggggtttcaccatgttggcaggctggtctcgaactcctgacctccagtgatccacccgcctgggcaatatagcaagaccccatctctaccaaaaatttaaaaaaatttagccgggggtggcggcatgttcttgtagttctggctactcacgaggctaaagtgggaggatcatttgagcccaggagttggaggctgcagtgagctacgatcacaccactgcactccagcctggacaacagggcaaggcctcatctcttaaaaaaaaaaaaaaaaacaaaataaaataaaaagtgaataagtgaaagtaataaaatgtaagatacagttggagttctctttgtcatcttcccttgctatattctcctcccttcttcccagaggtaacaactctcttaggtttggtacataaacttccagccctgcatgtattttgacacataaccttgtacacacgtcaatgccagatacaggttcagtatcccttattcaaaatgcttgggaccagaagtgtttcccacttgggattttagaatatgtgcgtatatgtaatgagatactgtggggctgagaacgaggtctaaacgttaaattcatttatgtttcatgtacatcttatacacatagcctggaggtaattgtatacaatattttcagtaatattgtgcgggaaacaaggttttcaccgccctgactgtgacctgtcacaagaggtcaggaatggaattttcttccactgctatcatgtcggcgctcaaaaagttgaattttggagcatttaggattttggattttcgggccaggaaattttggagcatttaagattttggattttgggttatcttcagttgttctttaaatctatttatttatttatttgtatttgacaacgagtttcactcttgtcaccctggctggagtgcaatggcgcaatcttggcttactgcaacctccgccttgcctcaagcaattctgctctctagtggctcagattacaggtgtgcaccaccacgcctggctaatttatgtatttttgtagagatggggtttcaccatgttggcctggctggtctcaaactcccgacttcaggtaatccacctgcctcagcctcccaaagtgctgggattacaggcatgagccaccacgcctggcataaatctttctttaaatctttcgctgctgtaataaaatatacatcataaaatttgccatcttatttatttttcagtatacagttcactggtgttaaacactgccatttatattgtaatacacttttgagtattctaaatatctgcatatattgggaagctaagtagtactatcccttaggaagccattgtgtattttgcacgtaaagcacatttcagttctgactggccacacgtggctggtcctgctgtaatggatctagtctttaaaaatactccgcgagagcttgcagtgagctgagatggcgccactgcactccagcctgggcgacagagtgagactccgtctcaaaaaaaaccaaaaaacaaaaaactctgcgatcttcctcaccatgcacacatatgatatttttgtgattgtgattccaattgctacacctgctgcatgagttcttaagccaaatgcttttttttttcctctcagccactatgttctttaagtttatgcctcttgattcagtattgctagttcattcttttaagtgctacatagtatcttgtatgaataagccacatgctactcaccagctcccctagtgggaggcattgagattgtttccggtttgtttcttttataaacaatgctgcaatgaacatcttggtgtccatctcctcctacccatttgtgaatggttttctaggattgatgttcagaattgaagtcacagggaatggagtatgtgcatttttagatctagtatatactccccgaatggtctccaaggtggctgtgacagtttcaccagtgatgcattaaggtatatgtcaaatgtgggcaaggctgcaggaaaattatgttaattccagtgcatggaaattggtatcctatggtattcttttgcatctccctgattcctggtaagactgggaatctctctgtatgcttcttagccatgtcttcctacctcttcctcctctttccctgggagctgttttggggtgggggggctgggcctttttcttcagggactctgcattggcaacgtcacaaagaggtgcacaagggattgaagtgtcggaaatgctttgctgctgtcattgcatttctttacccagcatttcaattgtgctttgctttgcttttctcacttgaaattgtggccagatagaaacccagttagactaataagcatccatctttttaaatctctttgagatgctgatgtttggatatcttcagttgctcttctttaaatctgtaattttttttttgtagtaataataggacatgcatcataaaattgaccatcttaaccttttttttttttttttttttttttgagaattcatctgttgatggacatttgggttgtttccgccttctggccattgtaactaacgctgggaaaaacacgggtctacaaatatctgtttgtggctgcccaagttttggggacacatagtggaagcccaccccttcctgattgaagcatggggcccattgagagacttagcccataggagcctctttccagtgaggaatatggagggaatggagggcagtacaaaagttctccggcctggacccttgtgattctttgaaggctgagacgagagatgagactcatggctgggttcactttttggttcactttccctttccttttttttttttttttttttttgagatggagcactctgttgcccaggctggagtgcaatggcgtgatctcagctcattgcaacctctacctcctgggttcaagtgattctcctgcctcagcctctcgggtagctggaattacaggtgcatgccaccacgcccggctaatttttgtattttttagtagagatggggtttcaccatgttggccaggctggtcttgaactcatgacctcaagtgatctacgcacctcagcctctcaaagtactgggattacaggcgtgagccactgagcctggcctctttttccattttctgttgcatcaatggaaagtccatctcctgcccgtggacgttttctatgttgatgtggaatgtggcatttgtccaggaacttggtgctttttttttccctctattatttcatttgcttttggattttgagagatggagaacttccttagtgtgggagggaaacagttatggatttactttatgattctacattcaatcctggtctcttcaaatgatttcagggcttgtttggccaggtcaagtctgttctaggaggattttctttccatccttcctctgggaaatgaatgagtataaaaacatgcccaagatggagggaaacctccccttcccttttttgcctttttcttcctggttttgtacataactgaacattttgattttgggatgagaggatattagttcattctcacattgctataaagaactatctgagactgggtattttttaaatttttaaaaatttaatttaatttaatttaatttaattttatttatttatttttttgagatggagtctcgctctgtcacccaggctggagtccagtggcgccatcttcgctcactgtaagctccacctcccgggtttacgccattctcctgcctcagcctcccgagttgctgggactacaggcacccgccaccatgcctggctaattttttgtatttttaaatagagacgggatttcaccatgctagccaggatggtctcgatctcctgacctcatgatccacccgcctcggccttccaaagtgctgggattacaggcgtgagccaccacgcccagcctatttatttatttttttgagacagagtctccctgtgttgcccaggttggagtgcagtggcatggtctctgctcactgcaacctccacctccccggttcaagcgattcttctgcctcagcctcctgagtagctgggattacaggtgcctgccaccacgcccggctaatttttatagttttagtagagacggggtttcaccatattggccaggctggtctggaactcctgacctcgtgatccacctgccttggcctcctaatgtgctgggattacaggcgtgagccaccgcgtctggcctgtttttttgtttatttccataggttttgggggaacaggtggtatttggttatatgagtaaattatttcgtggtgatttgtaagttttggtggatccatcacccgagcagtatacactgaacccaatttgtagtcttttatccctcactcacttcctatcctttccccctgagtccccaaagtctattgtatctttttttttttttttttgagacagagtctcacgctgtcacccaggctggagtgcagtggcgcgatctcggctcactgcaagctctgtctcctgggttcatgccattctccttcctcagcctcccgagtagctgggactacaggcgcctgccaccatgcctggctaatttttttgtatttttagtagagacagggtttcaccgtgttagccaggatggtctcgatctcctgacctcatgatccgcccgcctcggcctcccaaagtgttgagattacaggcatgagccaccgtgccgggccttgtatcattcttaagactttgcatcctcataggttagctcccacttatgagtgaaaacatagatgtttggttttccattcctgatttacttcacttaggataagagtgagactaagtaatttataaagcgctgggattagaggcgtgagccatggtgcctggccaatgtctggcatcttttctttggtgtaatgttttgagattcatccatggttttgcatttatcaatagcgtatttcttttgtgttgttcagtagcattccattgtgtggagagacgacatttagtttcaccattttagctgttgagagacatttgggttgttttcaacttttggctattattcataaacctgcatgaacctgttatacacaattgtgtaggagtcttttatgtggaccaatgccttcatatctcttgaggttatatcctggagcagaatggatgagttgtgtagtagaagtgtgtataaggagtgggcaggccaggtgcggtggctcatgcttgtaatcctagcactttgggaggctgaggcgggtggatcacttgaggtcagcagttcaagaccagcctggccaacgtggtgaaaccccgtctctactcaaaatacaaaaattagccgggtgtggtggtgggcacctataatccaagctatggtgggagaattgcttgaatccagcaggtggaggttgcagtgagctgagatcgcaccactgcactccagcctgggtaacaaagcaagactctgtctttaaaaaaaaaaaaaaaaaaaggaaaggccagattgttttcctaagtggttggagtctgttatatttccaccagcaatgtatgagagttctaattgctccacatccttagcagcacttaatatttattgtcaatctttattattattattgttattattatttttagagataggatcttactctgttgcccaggctggagttcactgcagccctgaactcctgggctcaagtaatcctcccacctcggcctcctgagtagcttggattacaagcacacatcactacacccagctaattttatttttgtaaagatgaggtctcactaccttgcccaggctggtcttgaacccctgggatctcaagcaatctccctcctcatccttccaaagtgttggattacaggcgagagctgcagcgcctggcccctttcactttcttaacagtatctttgaaaagcagctgatttttcacagggtgttgtaattaatttaattagctccacactgtggctttgaaaatcttccgtaagctctagcgccagacacatggatatttgcagaatcttattttctagagtcctggaaattttctttcctgtgagagagttgagagcgataattttagggtggttattcatcttcagacacaaggagtaagaatgtagggagttcgtgactgtgtttggagaggggagagcatagcagtggtctaatgatcttctcagggttctcaaagggtggacgagctgcaggttgaaacttgccttgcttttagactgttgactgagtttgtagttaagcagataagtgccaaaggagaagtcagggctgactgattgcaagtgatgattgaatactggccctcacaaccatctgtgaaaagtctatttccagaaattttttttattttgttattattattattattattttttgagacggagtctttctctgtcgcccagtctggagtgcagtgatgcaatttcagctcactgcaagctccgcctcccgggttcacgccattctcctgcctcagcctcccaagtagctgggactacaggtgccctccaccacacctggctaattttttgtatttttcgtagagatggggtttcatcatgttagtcaggatggtgtcgatctcctgacctcgtgtccacccgcctcggcctcccaaagtgttgggattacaggcatgagccactgcgccgggcccagaaatatttttaagaagagatttttgaaaaacccttgttttcatgatgggaggatatgaaaagcagtgttttgaaatctcctccttagatcctgatactcggaactgtcgattctcccattttcattttctcctggatagattgtacacttgtgccttggtatcttcaatgattccaaaacccccctggggatccagtccctgacataaaatggcgtagtgtttgtacataacctacatacatcctcctgtatactttaaatcatcttggtctggcagtgtggctcacacttgtaatcccagcacattgggaagcagaggtgggaggattacttgagcccaggacttcaagaccagcctgggcaacatggcgagacccccatctctacaaaaaatttaaaaattaattgggtgtagtggcatgtgcctgtagtcccagctactcaggaggctgagacgggaagattgcttgagccagggagttccaggctgcagtgagttatgatcgcaccactacactccagcctgggcaacaaagaaagaccccatttccatttaaaataataggggccagatgcagtgactgatgcctgtaatcccagccctttgggagcctgaggtgggcggatcatcacttgaggtcaggagtttgagaccagcctgcccaacatagtgaaaccccatctctactaaaaataaaaaaaattagctggacaccatagcgcgcctgtggtcccagctactagggaggctgaggcaggagaatcacttgaacctgggaggtggaggttgcagtgagccgagattgcgccactgcaccactccagcctgtgtgacagaatgtgacagaatgcgggcacatcacgagatcaggagatcgagaccatcctggcgaacatggtgaaaccctgtctctactaaaaatacaaaaaaattagccgggtgtggtggcgggcgcctgtagtcccagctgctcaggaggctgaggcaggagaatggcgtgaacccagggggcggagcttgcagtgagcggagatcgtgccactgcactccagcctgggcaacacagcgagactgcgtctcaaaaaaaaaaaaaaaaaaaaaaaaagacagaaaaagaaaaaacaaaagacgtttagctttcctgggtgacccagtgttgcagggattggccatccttggtataaggcataggatgtgcagggtagcaggacagcagagtgggcagtgtgtggggtttctttcattgatagggtggttcccagcactcggggtcagggcttgcttgtagaagtttctgaaaagttgcagtcatgtttcatttctttctccccctacctagcacatgccaggccacacagcatagtacgatggtttggaaccaggcttaacctgttagtagccgtggggctctgggcaagtccactggagttctccgggatctgtttcctcttttgtaaaatgggaaccaaaaggtatcacaggctgggcatggtggctcacgcctgtaatcccagcactttgggaggctgaggtgggtggatcacctgaggtcaggagtccaagaccagcctggccaacatggtgaaaccccgtctctattaaaaatacaaaaattagccaggtgtggtggctggtgcctgtaatcccagctactcaggaggctgaggcaggagaatcacttgaacccaggaagcggaggttgcagtgagccgagatggcgaggtggcgccactgcactttagcctgggtgacagagggagactgtctcaaaaaatcaacaccaaaaccaaacccaacatgtatcacaagctcgttgtgaggatcagagaagaggatacgggaatgataaacatggtagttacattgttgctagcattgtagttatattgcagctgtacattgtgacctattgtagctactgttatttctttgattaagtttagcaactgaaattttttttttttgagacggagtcttgcactgttgcccaggctggagtgcagtggcgggatctcggctcactgcaagctccgcctcccgggttcacgccattctcctgcctcagcctcccaagtagctgggactacaggcgcctgccaccacgcctggctgattttttgtagtttaagtagagacagggtttcatcttgttagccaggatggtctcgatctcctgacctcgtgatccaccctcagcctcccaaagtgctgagattacaggtgcgagccactgggcccggccaacaactgaaatatttaacatacaataaaatgcacatggccggggtgcagtggctcacgcctgtcatcccaacactttgacaggctgaggcaggcagatcacttgaggtcgggaatttgaaaccagcctggccaactactaaaaatacaaaaattagccagacgtgatggtgcgttcctgtaatcccagctactcaggaggctgaggcaggagaatcgcttaaacccaggaggcggaggttgcagtgagccaagatcaggccattgtactccagccggggtgacagaaggagactctgtctcaaaataaataaaataaaataaaatgcacagatctgaagcattgagttcaatgaattttgacaaaaaatatatgcacctgtgtaaccaccactgaaaacaaaatggaggacattgcctcatcccagccctttccagtgaattcccagtacccccgggaatgaggtgttacaatgattactatcaccattgttgattattattgtttagtttggttttattgaagaagcgggtagagaaagaaatagttagcctcatgcaaaaagtagggcatatgagagcctgagatatggcttaagaagagtattgtttgagaagtttggctgagtgtggtggcttatgcctgtaatcccagcacttcgggaggctgaggtgggagaattgcttgagctcaggagttcaagaatagcctgggcaacatagtgagactctgtctctataattaaaaaaaaaaaaagagacagaaaagtttaaggtatgttggcaggtagtcctagatggggtttactgccaggagcagttaggattcaaagagcaaaaatttgagggtaaaaggatgtatggcaggttgttggtggtggatatatagccccaacatccagtcactttaaactcttatcaagacaacacagggccgggtgccgtggctcatgtctgtaatcccagcacaatgggaggccaaggtgggcagataactggtggtcagcagttcgagaccagcctgaccaacatggtgaaaccctgtctctactaaaaatacaaaaattagcagggcgtggtgttggggacctgtaatcccagctactcaggaggctgaggcaggacaatcacttgaacctgggagatggaggttgcagagagcagagatcacaccaccgcactagagcctgggcgaaagagagagactccatctcaaaaaaaaaaaaaaaaaaaaaaacaaaaaacaccaccaaaaacaagacaacacaaagcgtttgaacgaaaacagcatttgcagatgcaaattcaggatccgaaattaattcttcccccctctttgctgagctgccagaatgttccaaggagatccctcctttccagtttcctccgtggcgcacaggctgtgccgagtaagtgggcaattgtgagtttctggaaatcagcgagctggtgtggctcctggctcctggctctggccaagggagttggcttccctgtgtccatgccaggaggggaggctggaggcttctaaaggccgcagctccgctgtagacacgcgcctccttggcactggctttgttgaaatctgtccctagatagtctctcttctgcacagacctctgaggtttttccatactgcaaagggccttgctgcaggaggaacagtctgacctaatctctcctagaggaggccttgagctaatattttttattttttttttatttttgagatggagtctcactgtcacccaggctggagtgcagtggtgcaatctcagtccactgcaatctccgcctctcggattcaagcgattctccctgcctcagcctcccaagtagctgggattgcagatgcccgccaccacacccggctaatttttgtatttttagtcgagatggggtttcaccatgttggccaggctggtctcgaactcctgacctcaggtgatccacctgccttggcctcccaaagtgctgggatgacaggcatgaagcacctcacccagccaaggtaatatttctgaaaggtggagtaccatgctatgagctagacacttggtgtggtttatcctgtcatcgcctcagtgacctcaccaggtggacactgttaggattcctaatttgcagagggagaagttgaggctgacagaaaggtcagcactgtgctcaaagtgatccagctgctaccaagatgaactgcaggctttgctctgagctcacagcctgacctcagtctagagctgggaatctttctctccctcattgctacacctgatcaattactgagtcccatccctttaactgcttacatggccttcaaatccatcttccctacctaagctgcccattcattgacctgtgccttctgtccatctgctgagagccaggtgctgtgcgagcctctgagaatgtggccgagaacaatatggataaaagttctgagccgggtacgctgactcatgtctgtaaacccagtgttttgggaggttgaggcagaagacttccttgaagccaggagtttgaggccggcctggacaacacagcaagaccccatctttacaaaaacaaaaacaaacaaacaaaaaaaagaaaaagaaaaattagctgagcatggtggcactgacttgtggtctcagctacttgggaggctgaggtgggagcatcacttgactccaggagttcgaggctgcagtgagccatgactgtgccactgcactccagcctgggcaatagagcaagaccctgtctcaaaaaaaaaaaaaaaaaaaaaaagactgtaaatgtatcctccagagtaattcttctttttcatttttcaaaagcatccttgctttgtttatgcttccaaaagtttaaaaactgtagctaagttccaagaaagaaaaagggaagcaaaggaaaaggaaaacacagacccagaggccctttatggggttgattgtatgtgaagtccataaattgatggagagaaggagcaccttggcagtatttacttgtactctcctatgtcatggatttcctctccattttcccaagggttctttcctgttcttagaaatgttttgtgattttgcttcagacacagtttgtctacttcttgtaagcattgttcttagattgctggctttatatctatcactcccttgctcatctgcccatccatctatccatccatccatccatccatccatccatccatctatccatccatccatccatccatccatccatcatccctccatccacttgctcatctgcccatccatccatccatctatccattcatccagtccattcaccacccaccatctattatccatccatccatccatccattcatccactcacccattcatccatcatccatccactcacccatccattcattcagtcacccttcatccattcactcacccatccatccatccactcatccaatcacccatccatccatacatccactcatccattcatccatccatacatccactcatccattcatccatccatccacccacccagacgtccatccatccatccatccatccatccttctgtctactctgccaacaatccacacacctgtccctccatcccttccaaccactcacccagcaatcttctcatccatctatccacccatgcatacatccacttattcattcatccatccctccacccacccattcatccacccatccatgtgtccattcatctctccatctatccgtgtgtctatcatctaatataagggagatgttttgaagtattaaaagtgattattttgtagcataggggacagggattgtgttttctttacttactgctaccttattaaatgcttactagttctaaaagccctgcaattgattcccttcaattttccaactctataattgcagcatctgcagataatgatgacttcttgccttttgccaataattagaccagttattgctgttaaccttgttatggcaggaacttccagaacagtgttcagtgacgcagctgaatatggtcagcccagtctcatttctgatttgagtggaatgcctcaattgttttactgcagaggataattatataattgttaatactcttgaccttcctgtctttagcctcactgagtaaatggggtgtgatcatgaaatcttgattgtctcatagatgcaagagacataaacgacatttgtctgtgtataatgacagcagatttattttgctaagctgttaagctgttaaaataagcctttaagcccccgcctcaattttccagcagagtggaatgttattttgttgcttctggccaagtgtcgatattcattttagggcaggtcttcatggaaagtctgctggactataggtctggatacttgccggaccctgtgtcatcactaaagttagggtgcgtttcagaaccaccctgtaccacagtgaagagggacaaatggccttagggagcaggacccatgggggccctctggggctgtttcttgtgccctgagagaggccctagatttgggacagtctgatttacctcccctcccttttttttttctgggtgatgctaccctggtttctgtgttgaaatatgaccctagtgtgaaggtcgcggtctcagaccatcttgtttctggtatgttaagaaacagaaaaacaccttttaggacacaatgttaaccattgaggatacatatcagtgttctggaaaaacaaaaacaaaaacaaaacaatctgtaccgcgactgtggttttcatcagggtgggctgcctttccgatccataaccctgtgtggcttgatggagaacatgttttgtaacttgcaagggcatctgcaatagccgggtcctcttggtgaaaggggaggacccacattaggtctaagctggctggagtcgatgcaaaactctcacatgctttggaaaaagcacgtgatctttcgacgagaatgcaaatgttgaccgggtgcagtggctcatgcctgtatttgcagcatttggggagactgaggcaagcggatcgcttgagtccagaagtttgagaccagcctgggcaacttggtgaaaccccatctctacaaaaaatacaaaaattaaccaggtgtggtagtgcatgcctgtagtcccagctacttgagaggctgagttgagaggattgcttgagctcaggaggttgaggctgcggtgagctgtgatcacgccactgcactccagcctgggcaacagagccagaccctgtctttaaaaaaaaaaaaagaatgcaaatgtttgcttgattattcagctggtatttgacacacagttctttgttccagagggactgtccagcaacaaatagtgaattcgttaatttttcacaccaaacctattgaaaataaccagaaaaggtatatgctggaaaactcagtgttctagaaacattcatgtttgccatcccaagagcaaaagtcatggaatgcctgatgcttagtgttaagaggaaggaattccacacagcctgtggctagcttttcttatttcattggtgtccaagacaagatttgaactgtttactaaaggaaattagcatcataagtctcctctggcatatatttccagcatccaagtggagctgctgagatcttgctcaagagtagcaaaattggcaggaggaggagggcattagtttttacatcagcttaaagaattttttttatcagccatttttgcaatttggaaacctgtttggagtaggggtatatggagatgaaattgggctgtttctaggattcacctcctccttcaggcattttttttttttttttggaaacagggtctggctctgttgcccaggctggtgtgcagtggcgtgatcatggcttactgtagccttgacctcttgggctcaagcaatcctcccacttcagcttcccgagtagctgggaccacaggtgtacaccatcgcacctggctaatttttatatattttttgtagagatggggtctcactatgttgccagggatggtcttgacctctcaggctcaagcaactctcctgcctcggcctcccaaattgctgggattacaggcaggagccactgcagttggtacttagagttgttttttttttttttttttttcccttgagacggagtctcactctgttgccaggctggagtgcagtggtgcgatcttggctcactgcaacctccacctcctaggttcaaaccattctcctgcctcagcctcctgagtagctgggactacaggcacacgccaccatgcccagctaatttttttttgtatttttagtagagatgtggtttcaccatgttggccaggatggtctcgatctcttgacctcgtgatcctcccacctcggcctcccaaagtgctgggattacaggcgtgaggcaccacactaggccgatcctcagacatttttaattttccttttttagtgttacagccagccatttgaaaaatgagacttccccctaaccttgtgtcaaactcagagacgttgtcatcttggctttgatgtggtggaggagaggggcttctcattccgggacggggtttctccacctggggcctgcggatactggggctggattgttctctggggtggggccgtcctgggcactgagggtgctagcagcatccctggcttccacccattccatgcctggagcgccgcccccgaggcatggcaaacacaaatgtctccagacactgccaggtgtctcctggtgggcagaatcgcctccatttgaggacccctggaccagggtgctggaatgggggtgaggggcactctgcaattattctctgctctttttttgaggggggggaaatggaaaccaagagcccatcatcagcctcgtggctctgtggtttgacactgccatgctaccgacaaaaaccacgtccctagacttgggggaccaaggaatctggaggaatatgatgatagtcatttaatgaaggtgggtttatgtattactcaagtgctgggctggggagtcaggacatagccacagggaagaaaacagaaaggtccttccctcttggaagcccctcttgaaacacctaattggtgacatggtacactggagaatcagagagtgtcactcaagcattttggcttggtggtggggcgggggtggcgggtcaggcactcaagcacccctaagctgatctggagaaagtgtcggggaaggggaacattagcgtttctccctgaggaatcatcttacacctataacggcaactggcccacagtaacattgatggagcaagtgtcttcttgtggctcggccgctcaatagctgtgtgaccatgggcaggttactgaacctctctgtgcctcagtcttctcctctgtaaaatgggaacatctaggattgttgggggaaataaatggttaataattggaatagtgctgggtgcataggaaactctaagtgttacacagcatgtggccacaacctcccctctcccctcctctctcctctttgctgctgccctgctgccttaatgggatactcccctctctgtctctgtctgtctgtctgtctgtctgtctctctctcatccccttttctttcctctgttcccccacccccacctctgatgcagtttggaccaagttttcttcagccagctaatttagagacaagaacctggatatttattgggcgtttgggggacttccttacagccctaggtctctgtgaaaagggccctggattatctctgcaaaagcccacctgctattggttagccaggactgtctccactttcagacaccagcttcatccaaacactctttgctgtatttataaccacggtgcatttcctcgggacgcacatcttacggcttcttggccccttcgcccagggtgcactgcctggaccatcgccctccggcagagacagtgtctttctttgtatgttctccttcctctggtcgagatgtggcttggtcacctggagtggggccgtcggcaagtcgcctgggcttcgtggaggctcgctgcccccatggcggaaagctcggccacacaccctgatgtctcgacacctttgagttgcccatgaatgggttttcagagcttcccgtgtttacttcgctgcacgcctctgtttgtgctctggggaaattcttggcagaggaaaagccaattggaaaacagccctgcttggtgtcagggcttgaggttgagggagaaagactgaaacggagatttgcatgagctggtttgagcatgtcacaagactttgtctttaaaaaaaaaaaaaaaaaaattggcctggtgtggtagctcactcctgtaatcccagcactttgggaggctgaggcaggcggatcacgaggtcaagagatcgagaccatcctggccaacgtggtgaaaccccgtctctactaaaaatacaaaaattagctgggtgtggtggtgtacgcctgtagtcccagctactggaggctgaggtgggagaacggcttgaacccaagagggagaggttgcagtgagccgagatcatgccactgcactccagcctgggtggcagagcgagactggtctcaaaaaaaaaaaaaatttttttttgttccagtctattctggtggcttagaggagggaagatgggaaattttgggtttaatagagtaatatccatcaggttgagggctttgaagcacctgggaatatccataagtcactactgagcaccagctgtatagagttattgagcatgtattgtctcccaggcacatggtcctcacaacaatcttttcacagagctaggatttgaacccacagtctctctggcttcagaaccctagcttttcttgctatactctgccttacagaggaagggaacttttgtactgggttttgaagggtgaataggagttcaatgaagaagcagcacattctgtgctaaatttggcttcctgatcctcctagaattggccagaagccaatatctggaggccaaaattgggtcactagggtgaccaactcatcacagggccctggattatctctgcaaaagcccacctgctactggttagccaggaccatcacagtgtgcccaggtaaccctgcgtttcaccccaaagcagaattttacaccagagcctggacaccagttgaattttctttaactcatttctgtcaatggttacctccaaaaatgctcccttgtgtctttatgctgggcttctttctctagatacttccatttcttggtttgggtgaaaatcaaatgaggtaattaatgcttgtgacatgtaaagtgtagtgagtggcacatggtaacctctttagttttagccagttggttttttttgtttgtttgtctttgagacagagtctcactctgtcacccacgctggagtgcagtggcgcagtctcagctcactgcaacctctgcctcccaggttcaagcaattctcctgcctcagcctcccgagtagctgggattacaggtgcacgccaccacactgggctaatttttgtattgttagtagagatggtgttttgccatgctggccaggctggtctcaaactcctgacctcaggtgatccgccctccttagtctcccaaagtgctggcattacaggcatgagccacagtgcccagacagttttagccagtttttcactggcctccctctttgccttttttgcaagggagctggcctccctgtccctggagtaagcaaacttccttatacctatagcttcctctaaggaagcgtagttacctacagcctggccctccccaaggacacagctgtttcctccaccaagagcaaggagtggacataatcactgccaaatagggaagccaggctggacaccgtggctcatgcctgtaatcccagcactttgggaggccgaggtgggaggatcacttgaggccagggattcaagaccaacctgggcaatgtagcaagaccctgtctctaaacaaataaaaaaattagccagctgtggtggcccatggctgtagtcccagctactccagaggctgaagcaggaggattgcttgaccgcaggagtttgatgctgcagtgagctacggtcacaccactgaacaccagccaggacaacagagcaagaccctgtctcttaaaaaaacaaaaaaataaggaagccagatgggtgctgggtgtacgggacacatgtcaaaagtcagacctctatctgagtaaggaaacaggttcagagtcaggattaaagaccaagacagcttgaggtcatcagaggccaggaatttccatacaggctgcggtccaaagtgccaagctgggctagatagatgttggggaagagtctctgtcgccctctttccttccccgttaatgctatcagctgagcatgggtcactcctgattttttttttttttttttttaccgaggacataggctcagagtgtcttctagctttcaacccaccccagactctgacttagcctttcccaaatggtgctgtgcagaaaaatgaaaaaattgctaggaggatcatgtgcctggtggatagtacatgcttgatagctgtaaacagttggtgctcaatatatcgtggcttgtggatcttcccagctgcttcagaaccccaagcctgctgtataattgtacttgatcccgacaacagccctgccagatgggtgttactctgattcctgtgtcctggtaagtggacggggggcctggagtagctgaattgcctagagaaggggacatagctagaaaggaaaagttgaaacccagtgtgatgccagagtccatgcaaactttatcctgaaaggagggatctctttttttttttttctgagatggaatctcactctgtagcccaggctggagtgcagtggtgtgatctcggctcactgcaacctccgcctctcaggttcaagcgattctcctgcctcagcgtcccaagtagctgggattacagacgtgtgccaccacaaccggctcatttttgtgtttttagtagggacggggtttcgccgtgctggccaggctggtctcgaactcctgacctcaggtgatccgcccgcctcggcctcccaaagtgctgggattacaggcgtggccactgcgcccagccttcttcttcttcttcttctttcctcctcctcctcctcctcctcctccttttttttgacagagtctcactctattgcccaggctcgagtgcagtggcacaatctcagctcactgcaacctctgcctcctgggttcaagagattctcccacttcagcctcccgagtagctgggattacaggtgcgcaacaccacagccggttaatttttgtgtttttggtagaaacggggtctcgccacgttggccaggttagtctcaaactcctcacctcaagtgatccgcccgcctcagcctcccaaagtgctgggattacaggcgtgagccactgcgctcggcctggtgaagaccttcttgccggtggggactctgcagagtcctgacagggagcagggcatcacatggcgagggagctgagagtgtcagctcaggtctctcttcctcttcttataaaaccaccagtcccactcctatgataaaccattaatccatgaatggattaatccacttatgaggacacagcccttttaatcacctctgaaaggccccacctctcaatgctgccacatgaggaattacatttcaacatgagttttggaggggacaaatattcaaatcatactattatgttaccagtaaaatttaaaatataggaataataattgccgatgtgtggcagacttaccaaatactagaccctgtgctaagtgttttatatctattattttatttaattttcttggtcactgcataacatatgctctgttagtcccagtttttcgaatgggcataacaagaccgaacctacctagagttggcacaagttgtaaaaataggatccgtggccgggcacagtggctcacacttgtaattccagcactttaggaggccaaggcgggaggatcacctgaggtcaggagttcgagaccagcctggccaacatggcgaaaccccgtctctacttaaaatacaaaaattagccaggcgtggtggcgcgcctgtagccccagctcctcgggaaactgaggcaggagactcgtttgaacccgggaggcggaggttgcagtgagccaagatcgcaccactgcactccaggctgggcgacagagcgagactccatctcaaaaataaaataaaacaaaaaaataggattcacttttgccaccaacttgaaaaggaggcaaacacaagattactcatctctggagaggaggcattcagatttgcctactcagcattcctggagatagaaccagattttgcatgggttagaatcatattttgcttgggaagccactcagacctcattgtgtggactctattcccagagccagcttcctttattccttcagactcttatgattggctcaggggaaggcacatgactcagactgggccaatcagctttcttaattcctccagcctccatgattggttcaggggtgggcatgtgaccccagaaggttccataagattcagttctgggactttagtgggagtgatagagagatttttccttgctaaatcttccttgctgtgaagctataatccaggtgccaccatgtagagaccacgtgtctcagacttctgacaccatagaaggaagcaggactgcgaaaaggaaagggagagagatggggtccccatgacatcatttgacacctggatctagctgtacctgaaagtgtccttgtcctatgacttgttagttaaatgagccagcaatcgttcttttcttttttttcattttctttctttcccttccttccctccttccctccttcctttcctttcttttcctttccctccctccttccctccctcccttccttccttctctctctcttccctcccttccttccttccttctctctcccccttccctccctccctcccttccttccttccttctttccttcgttccctccctccctccttccttccttccctccctcccttttctctctctctctctcttctttctctctgtataactgagctttctattctcacaaactgaaagaggtcttgctaatccaaggcatgacaatcagagcaacatgtgaagcccaaagagctgcagagctcccctccatggcttccagccccgggggtggtcagtgaaagtaactggagcccggagcttcagaggccagtgtggaggttggaaaggttgtggtcaggagagagtaatatatctggtccctgcaacagacacccctgcagttttatcctgaatcctgggtaatttccccaggtcctgggaagcctaataaagcccctactcagatgttggattgcaagtcctttttgtttgtttgttttttaaatccactttaaatatgtctgaaaaccacacacagagtgactgctgcacagaagagcgaatggttcatgccttcttctttgctgccaccaacaagtcagttacctacttctctgacatgggacccttggctggagctcactggctgccttcctgccacctgtaagcctcggcacttgctgttccctctacctacatgcttttccctgtgatacttcctcatacgatttcctcagattatctttgctcaaacaacaggcaagggctgggccttaatctcacacctgtaatctcagcactttgggaggccaaggcaggtggatcacctggggtcaggagttggagaccagcctggccaacatggcgaaaccccatctgtacaaaaaatatacaaaaaattaaccagatgtggcagcgggtgcctctgatcccagggacttgggtggctgaggcaggagaatcacttaaacccaggaggcagaggttgcagtgagccgagatcatgccactgcactccagcctgggcaacagagcgagacttcgtttcataaaaacaaagaaacaaacaaacagaaaaaaacaacaaaacaaacaaacagaaaaaaccaacaaaacaaaaaacaagaggcaagaagttcagtgtgcagaatctctgagaaaaacccatggttgttaaccccaggtctgccccttttgagcagggtgacattaggcaactgatttgatttctcttagatgaaatttcctcactccctgcctattcaaccacagtactgaggacatttggagctggattatctctctggtggcagctgtcctgggcattttagggtgtttactagcatccctggcctccccccactagataccagtagcactcccaccccacactggttgcaacaaccagaaatgtctccaagacacttccacgtgacccccggggggtcagaatttctccccttccccctgtgttttcctatggaggtggaacgtgtttatttctttgctcaccgttttgcaatctctcttcccccgccacaaggcagggactcttctatctccgtcaccatcccatcctcccacagtggagacagctctggggactctcctgagcagcagattcttgggtgccacattctgttccattcctggggaatttatctctttactgagtgatgggtacatgagaactttctgtgtcacccttgcatcttttctgttttgtttttacaaaagaaaaaaaagaaggccgggtgcggtggcttacgcctgtaatcccagcactttgggaggccaaggcgggtggatcacgaggtcaggagatcgagaccatcctggctaacacggtgaaaccccgtctctactaaaaatacaaaaaattagccaggtgtggtggcgggctcctgtagtcccacctacttgggaggctgaggcaggagaatggcatgaacctgggaggcggagcttgcggtgagccaagatcgtgcccactgcactccagcctggcagacagagcgagactccgtctcaaaaaagaaaaaaagaaaaaagatatcactcgatgactgctaccgaaacattctgtggctgggagaggaaaataccagaaagggtgaatgtggtcggttgaatgatgcctctcccttcccccagagatgcccacatcgtaatccctgtcacctgtgaatttggtacctcacttggcacaaggctctttgcagatgtgattaagttgaggatcttgagacggggggatgatcctagattatctggtgcaccaaatgccatcgcagggatccttttcaaggaaagagggaggcaagagattgaaatgctacggccaagaaaaaggagctgccttaaaagctggattctctctggagcctccagaaggaaccaacctttgtaacatcttgattttagccctgtaagactcattttgggcttttcaccaccaaaactgtaagaaaataggcaggccatgatggttcatgcctgtaatgccagtactttgggaggccaaggtgggacgatttcttgaggctaggagtttgagaccagtgtgggcaacatagcaagaccccatctctacaaaaaaaaaaaaaagaagaagaagaagaagaaaaattagctgggcttggtggcacacatctatattcccagctacttgggaggttgaggtgggaggattgcttgagcccaggagttcgaggctgcagtgagccatgattgcaccattgcactccagcctaggcaacagagtaagatcccgatgcaggagaaaataataaatgtatgtcgttttacatttgtgggcgtttgtgacagcagcaatgggaaatggatacggtgagaaacccagcacctgggcctggaaaccccctctgggcgggtctctagccaggggccaacaggagtcagagcagggccttggtgagaggtggatacggggccccagcatcctgatggccttgctgtggcttctggggacacctgcagtggctccattacaccgtggcaatttgttccttcccagaccccctggatacaaggggcctgcattttcgaacccagagcccggggacatcccccgtggttccctgttaccctctggatgtctgtcctgctactatgcacctctccccaactcctggtacacagtgggagttcaggggccgtctcatttgtaccgcataacatcacggaggtccaagacgccatgtaatattctgtttaggatttcagaggcacagtcagttacatccatcttctttttgtctttgagacagagtcttgctctcttgcccaggctggagtgcaatggcacgatctcagctcactgcaacctctgcctcctgggtttaagcaattctcttgactcagcctcccaagtagctgggattacaggtgcacgccaccacacctggctaattttttgtacttttagtagagacggggtttcaccatgttggtcaggctgatctagaactcctgacctcaggtggtccactcaccttggcctcccaaagtgctgggattataggcgtgagccaccgtgcccagcctgcttccatcttcttagccacttttccctcaggtgagaccatgagattaggaacctgtttcaattcccgtcggaatttcccaacagagctggggctttgtgattcgaatatgttcagagaaggaagcagaaggaagcagaaatgaaggatgttatcagaaaaggagactcagggttgggtgtggtggctcacgcctgtaatcccagcactttgggaggccaaggtgagtggatcacctgaggtcaggagtttgagaccagccaggccaacatggtaaaaccctgtctctactaaaaattacaaaaattagccaggcgtggtggcatgcgcctgtaattcaagctactcgggagactgaggcaggagaatcacttgaacccgggaggcgaaggttgcagtgagccaagatcatgccactgcactccagcctgggtgacagagcaagactccatctcaaaaaaataaataaataaataaataaatacaggaaaaggaagctcggtagttttcaggggctgctggcgtttccaagctttaggcattttgctttgagtctttttctgtctttcgagtcatcctgaagtggaaccgagagaggactgagtgggtggagggggtggtggtggggacggctgtctgctctgctggaattgagagtctgggagatcattgtggtgtttttggagtgattcttaaccccagatatagacagtgacacaaggggcataaatacgaggaacagtgaccttccctggtgtccttgtttgaagcatttgaccatctgggcaaggcctgggagtgtctgaactggctggtgcttccatgaacaagcacagactcagagcccatggtcctgggttcgaatcctagttcttccacttctttgctgtatgacctttgtctacaaaaaataaaaatttagccaggcacagtggcgtgtgcctgtagccccagctactcgggaggctgaggcaggaagatccattgagcccaggggtcgaggctgtagtgagctatgattgcaccactgcactccagcctgggcaacagaagcagaccctgaagaaagaaagaagctgggaagacagggaagaaggaaggaagaaaggagggagggagaggggaaggaaggaaggaaaaaaaagggagggaacaaggaaggaaggaaggaggtggggacggagggaagaaggaaggaaggagggagggaaggaaggaaagggagggaggggagggaggagggagggagggaagaaaaaaagggaagggaaggaactttggaactactgaacatctctgtttcctcatctataaaaagagggataagtcatcatcatatcttcctctatggtcattgagtggatgaaataagacagcatttgcaaatcccctaatgcatacctggcccctgattttgttccttgggctgcagcgatgatagaggtttaaaacctccaaacgctgtgttgaaatctctcacgtggacaaccagcccaccagcagagaatgtcatttttccatcctgggtaaacagggtagagaagaatgaggacctcaggccaggttagagagacctcgcttggtgaccttgggaaggcttttaacttttaactttaatgctaacatctggttccctccagttaggcagtcggcggcctagccgtcttgtcttgaagtttctcttgccttccatcatgggtttatttgttcagcaaatgtttatggagggccagcacaggggggaataagaactagagttctgggaggacgtgtgaagaaacaagttccgagccccagggaggaaagaggtcattgcctccctctggggaaaatgtctcttctcatacctggttcacttcttaaatggaatttcccccttcagatgagtaaggcgtttaatcacaaagagaaaacaccttcatcacatagccatccttaaaaggcatttattgtgaagctggttcatagacttctcgcccaggttgctaacagccaacctgtctgggttttgggaagttaaagtgtctgtatcccatttcctttttttttttgagacaaagtcttgccctgtcacctagcctggagtgcaatggcacaatctctgctcactgaaacctctgcctcccgggttcaagcgattctcctgcctcagccctcccgcgtagctgagattgcaggcgtgcaccaccacgcctggctaattttttgtatctttactagagatggggtttcaccatgttggtcaggctggtctcgaactcctgacttcgtgactcaccagcctcagcctcccaaagggctgggatgacaggcgtgagccactgtgcccagccagttctgactttttaacttgtgatttgacttttcctgtctgaagtctttctctgctggacgtgagttgttgaaggtgttgcttttctttgtagacaattagaggcgctcatgcactgggctatggacaataatactttgaagatgtgcaaatgatttgcaacctttgttgcataaattatccctctgagatgctgtttggcttgataaataaaggacctgcaagagagaatttatcttgagcattccttgggggagagaagcaaaggggaagtgaatgctgcataataattctttgcatactttatggagggtgggttcctgcagtgccctgtagggttttttgtttgttttttttttttttttttgagatggagtcgctctgtagcccaggctggagtgcaatggtgcgatcttggctcactgcaacctccgcctcccgggttcaagcgattctcctgcctcagcctgccaagtagctgggactacagacgtgctccaccacgcccagctaatttttgtatttttagtagagacagggtttcaccgtgttagccaggatggtctcgatctcctgacctcgtgatccgcccacttcggcctcccaaagtgctgggattacaggcgtgagccaccgcgcccggccccctgtagtggtttaaagcatcttcactgttattctaagcctcacattttaaacagagctgaaaaaggactctaattgctggcctgggatccttgtgtgctgtaggaattcactgagggggcggggctggagagggctgctagagggtggtacagaagcagatggaactttctctctggctggacacagtagctcacacctgtaatcccagcactttgggaggctgaggttggtggatcacctgaggtcaggagttcgagaccagcctggccaacatggtgaagccccgtctttactaaaaatacaaaaaattagcaggacgtgggggtgggtgcctgtagtcccaactacttgggaggctgaggcaggagaatcgcttgaacccgggaggtagagcttgcagtgagccgagatcatgccattgcactccagcctgggcaacaagagtgaaactccatctcaaaaaaacccaaaaataaatttaaagaaaaattttctctctgattctgcctgcctgcctgctagactggaagcaccatgaggtcaaggtccacgatgtcttgtcgctattgaagcgcctccaaaacatggcagaccctcagcaaatcttggacagatgaatgggcattcgattcaacatgtgtctgctaggtgggagctgagcgggaatcgcagggcttgggtcccggggatgatggggaatggcagtgtgactgtggggaagccaggggaatggggtgctggagcccccaaagctataaatcagggcctgatgaacagacagacagatggaccaacttaaccatttcagccccatcggctttgatgatttccctctggctctggcaagagtctcgctcaccaagtggttctcaccctagggtgggtctggatatttctggggacatctgtggttgtcacacgtcggggtggggggagatgctcctgacatggagtgggtggaggccagggatactgctcagcaccctgcaatgtacaagacggcccctccccagatgaagatccgactctgaataccaccagtcctgaggctgagaaaccctactttaagataacagtgatgggggaattatccaccccagagtctgagtctgtgacttgggaaacggccccggcattaccaggtgttgaattcgtgagaatacaaggagaaggcgtgtagcccgtgacccagtcctgccccagacaaaccgatattccctccaaagctctatttggcagaagaagtgttttcgttccctcttgcctgtggtatctcccctgataagcgttgtggattgttccagaccgtgttgacggggacagcttccttctccgcggctgccggccctgaccctgcagctttcagtctgtgggagtagagtcagctgttgagcagtttactctgtccctgtgtcaatgggattgtgcatgttttggttcctgaggggtcattgatggtgcacttttcttttgttgttagtcaatttaatttgttactaataataaaatctggaacttacctgaccccaaaggcccaggtcgttaagaatgcttggtggaatgcacgtccttttcaaataccggctcctttggaaaacacagaggatggagtgaaatccttacctggattgtactggcagtgggatgacagcgtcacctcctgaaaatggaatgtagcttattgctaaataagacagcgcagtgcctccctcgcacctgtcatcttggtgcttagagaggccaaggtgggaggaattctcgaggccaggagttcaaaaccagcctgggcaatacagaaagagcctatttctactacaaatataaaaattagctgggcatggtgacatgcacctgtagtcgcagctacatgggaggctgaggtgggagaatcgcttaagcccaggaagtcgaggctgcagtgagctgtgacttgctactgcactccagcccatgcagctgagcgagatcctctttcaaacaaaccagccaactaacaagcaggccccaaggggacaatttttctggaattacctgattgtatcaagaacagtttgatcaacacctgtaatcccagtactttgggaggacggatcacttgaggtcaggagttagagaccagcctcgccaacatggtgaaaccctgtctctactaaaaatataataattagctgggcatggtggtgggtggctgtaatcccagctacttgggaggcagaggcaggagaattgcttgaaaccgcgaggcagaggctgcagtgagctgagactgtaccactgcactccagcctgggccacagagtaagactctgtctctctctgtctctctgtctctgtctctctctctccatatatacatatatatttatatatataacttatcttgaagacggttttggcacgccttaacttttatgccagaggccagtgccttgcttgtgtcaccctggttccaagaatctgcatagtttttcccagcccattctacagacagggaaactgaggaccaggcacactaggttcccctccaggagtcgcacagcgaggagaaagtggagccatgacttgatgccaaacactgagactccagaacccatattttctcagctcttaggtttttgtcaatttcctaaatttgtgtgtgttttagtggggctgagtttctcctgttaatttgtttatggagaggagacactcttgtttacttttttttttttttttttgagacagagtctctgttgaccaggctgcagtgcaatggctcaatctcggctcactgcaacctccacctcctgggttcaagcgattctcctgcctcagcttcccgagcaactgggattacagtcacacaccaccacacctgactaatttttgtatttttagtagagatggggttttcccatgttgatcaggctggtctcaaactcctgacctcaggtgatccacccgcctcggcctcctaaagtgctgagattacgggtgtgagccactgcgcctggctcttggcgttctcccttagtaatacttcttgggggtcattttgaatctctgtttcttctgtggtcacgttcatttggaatttacttattcaacccacaaccaatagacatttccagccctttgttagtataaacagaacttctctttgactttcacagcgtttttgttctggaggtgctatccttgattgctaagacacccacgacattgctcttggaattggagtagggtggatgaaatagtattcaaagatgggggtggtgcaaatgttctgtatttcaacctgtacattagtcaagtgttatttttaccctcatgtacatctattatggaataaaatacatgactttggccaggcgtcatggctcacacctgtaatcccagcactttgggaggctgagacgggaggatcgcttgaatccaggagttcgagaccagcctgggcagcatagcaagaccccttctctaaaaaaaaaaaattagctgggcatggtggtgtgtgcctataatcccagttactcgagaggctgaggcaggaggatcagttaagcctgggaagtcgaggctgcagagagctgtgataggcagcctgggtgacagagaaagaccctgtctcaaaacaaaaaacaaaacaaaacatgacttttatggagttgagctcaacgtttgcatacacatgaggagcagaagctggaggtttcaaataaatatctggcttctgcaggctgcctggagagaggtgagagcgatgcattggtcacccagcctggagtgcagtggtgtgatcacagctcactgcagccttgaccttctgggcacaagcaatcctcctgcttcagcttcctgagtagctgggaccacaggtgtgtgccactatgcccagctaattttatttatttatttagagatggaatcttgctctgtcgcccaggctggaatgcagtggcacaatcttggctcactgcaacctctgcctcctgggttcaagcagttcccatgcctcagcctcctgagtagctgggatcacaggcatgtgccactatgcccagctaatttttttttttaatggagtcttgctctgttgccaggctggaatgcagtggcgccatcttggctcactgcaacttccaactcccctgttcaagcgattctcctgcttctgcctctcgagtagctgggattacaggcacgcgccaccatgcccagctaatttttgtatttttagtagagagggggtttcgcatgttggccaggatggtctcgatttcctgacctcgtgatccgcccacttcggcctcccaaagtgctgggattacaggcgtgagccactgcgcccagcctaatttttgtacccctagccgagacagggttttgccatgttatctaagctggtctcgagctcctgggctcaagcgatccacccgcctgggcctcccaaagtgctgggattacaggtgtgagccactgcgcccggccacagctgttgttttctcactggcttgagaattgttctcttaagctggtcaaggttatgacggtttgtgtggcctgtgcacgtgtgtgtggtcaaatcccatttttctaaagcaaagtttctatttgggtatctgctgtttaatttttcagggattttttttttccggttgctaaggaaagtacattaaattttatctttgtatcctgtagaactctttgtgaataatacacggccagagggaagataggctgaggaaacagataggaaggaagttcaagggggggatttctatgtgagaaccaagaaacacctttgatctttagatttcaaagtgggaagttcaaggtgaggtgggcgtggaattaggagtaaacccaagaagagcgagtgggcggttcctcctggcagccacagaatagttacgtggcatgaggtcagtagcatctcagagggtgttgttgtctttgacttagatgagttccaagaagcagaagttcgtgagccaaacacgaggtggttttctggggggtacaagggctggaagaggggccagctcttaaccacaaatccctttccatgcccaaggccaagctccttgtaactcttttctttctttgcctccctccctccctccctccctccttcccttccttccttccttccttccttccttccttccttcctttccttccttccttctcaaacaaggtctcactctatcacccaggctagagtgcaacggcacagtcatagctcattgcagcctcaaacccctgtgctcaagtgatcctcctgcctcaggccctcaagtagtttttaaacttgtttgtagagatgggtcttgctatattgcccaggcttgtctcgaacttctggtcttaagcgatcctcctgcctcagcctcccaaagtgctgggattacaggtgtgagccactggcccggcccattctcctttctttagccaggctagggagacataagtggggaaactcatgttgttttttgagatggttgctttattctcgtgatattttccctctttccaacttccttgagccctccccagcctcctcttagtgtctgtgtgtgggtgagggggctttggtataccttctgctttgggtctcattcattttaattttttattttgttttgttttgttttgttttgagatggagtctcactctgttgcccaggctggagtgcagtggcaccatcttggctcactgcaacctctgcctcccgggttcaagcgattctcctgcctcagcctcccgagcagctggggattacaggtgcatgccaccatgcctggctaatttttctatttttagcagagacaaggtttcaccatgttggccaggctggtctcgaactcccgacctcaggtgatctgcttgcctcagcctcccaaagtgctggggttacaggcgtgaaccaccgtgcctggccacgggtctcattcattttagttggagcccaaattcactggtggttcaagttcccaatcattctcggcattctataatcacaggcctcagagagtaatgctcccaatggccctcaaattatggtttccttaggaggctattaaatcttgatttctgagaggaaaattggggattttgtgttttcccttttagacttgagtgttctgttactgtggatgagctcttctagaaacttccaagcagtttcaaaggggatttagatgtcatcaggaagtgtggttgacaacgtgatatttgggctttagaaaaacagcgtgtcacccgttttatttattccttgatgactctttttttgtttgtttttgttgtggtcgttgttgttgagacagggtctcactctgccacccaggctggactgcactggtgcaatctctgttcactgaaacctcctcctcctgggttcttgcaaatagacagtcccatttggtggtgacgggagacagtgacagatcatcaagcattagattctcataaagagcgtgcaacccagatccctcgcatgcacagttcacaatagggttcacgctcctaggagaatctaatgctgctgctgatctgacaggaggcgcagctcagatggtcatgcaagcaatgaggagtgactgtaaatacagatgaagcttccatcgctcgcccgcccctcgtccactgctgtgcagcctggttcctaactggctggtttgaaactagactgggcaacatggccaaaccccgtctgctcaaaaaataccaaaattagctgagtgtggatcacaagtgtgtgcctgtagtcccagctacttgggaggctgaggtgggaagattgagtgagcccaagaggtagaagctgcagtgagctatgatcacacccactgcactccagcctgggttacagaatgagattctgtctctcaactccctgaggggtgggggacccctggtttaatccatccaaccctctcttcccatgaaataaaggaagttgtgagtgctattttgtgcgtcatcccctccagtattcaagtcagcccaaggtacttcgatggttcccgtctgcacatggggaaaccgaggcacagaaagcagactcatgtgaccaggaagtagctgtgtctgctcgaaactcaggtcgacctgataccataagtccttgcactccacgtgctggctattgaagctgtggctcgcaggtctgatgggagagcctcagacagtgtctcactctgtcacccaggctggagtgctgtcatgcagtcataacccactgcagctttgacctcctgggctaattgatcctcccacctcagcctcccgaatagctgggactacaggtgtgcaccacaatgcccacctaatttttgtattatctgtagagatgggcgtggggggtgtgaggggtcttgccatgttgcccaggctggtcttgaactcctgacctcaggtgatcctccagcttcagcctcccaaagtatcgggattacaggcatgagagagccactgcaggaagccaagagagcagatttggacaatgtagaatttctccacgctcctcctactgtccccatcttaggcctggctactgcgggactgacaggcatggctggctgtccatccgttccttagtttgattgcatggcagacatgaggaaggaaggtgagaactgagctagaaagttggcatttggtgctctggtttctcaatgcaagaaagtaacactttggcttttatagaataaccttctgaggaaattaacaacccgggcgtttcagccccctgtgaacttgattggagcatggtcacaatttgtaacgaaatgtgcttgcatgcccagtgctaaagatttctctctgtctaccctctaggctgtggaaaggtctgttctaaccattagcttgtatctggagctcagatggtgccggacactccgtaggagctcagatctgttgatagaagccactagagaatgggacaagcaacaggaggtgttttgctgcctagtaaactttttttgagatgaagtttcacttttgttgcccaagctggagtgcagtggtgccttctcggctcaccgcaacctctgcctcctggcttcaagcgattctcctgcctcagcctcccaagcagctgggatgacaggcacccgccaccatgcccggctaattttttttgtatatttagtagaaatgaggttttgccatgttggccaggctggtctcgagttcctgacctcaagtgctctgcccgcctcggcctcccaaagtgctgggattacaggcgtgagccactgcgcccggctctacccatctttcttacatgatgatgttcagcagccagcctgataggggagcattgtttgtcctttttttccttattgcattttccccgcataggtgccagggctcagtagcataaatccaggtagaactgggaagttccaggtatctgggctgtttgctctggtggacaaagagcagctgcaaggtgggtcttgattagccagtgaagtctgaggatccagagggaaacttattcctttcttttgttgaaatcaacatgagcaggaaatggatctttcccccaatcagagaacttcacatgtttttctaatagaatagcagtgtctgaggtatatacacggggagtggccccccgggaaaacgaggccatgaggctcctggcatggagatgacacacgaagactctcgtaacttatagaggggaaaataaagcagtcattccaggctgggcatggtggctcacgtctgtaatcccagcactttgggaggccgaggcaggtggatcacctgaggtcaggagttcgagaccagcctggccaacatggtgaaaccccaactctactaaaaataaaaaattaaaaaaaaaaattagttgggcatggtgctgggcacctgtaatcccagctactcaggaggctgaggcaggagaattgcttgaacccgggaggcagagattgcagtgagccgggagcctgtaatcccagctactcaggaggctgaggcaggagaattgcttgaacccgggaggcagagattgcagtgagccgggagcctgtaatcccagctactcaggaggctgaggcaggagaattccttgaacctgggaggcagagattgcagtgagccaagatcacaccactgcactccagcctgggtgacaagagtgaaactccatctgaaataaaataaaatataaaagttaaagcagtcatcctggcttttaggaacccgcagaatcaggaggtaagctaaaagtcgtctcccttttgtcacgatggaatgtgaaataggtgcattttccttctgacttatgattctgtttcacggtgcctctgcagaaattcagtacgtccccatgggcacctgtgtccttcaggagttgaggaaattttctccattccttgtccctgtccctagactctgccagctcgtgcatgtagaagctcccgggaaaactgtcaacctgtgcacattcaagaccgccatatacttgttattgaaaagccatcagtcatgtgagcagaacttttttatggttgagattgtccccagggaaacccgccttgcaattcagaccttccacggagatcgattccaaactctcatcccgttcccacttcctcgttcccatggaggctgcggttctctctctctgtgccgcttacagattgtcatacctatttccaaaaatgacacagaaaacttcaacgtgtggctaaatttgaacagagaaaaataagcaaagaattcaaggcgcgaggcgttttcagggagagagggagagcttttgcatggtttgaagggatgatctttaatgagttgagggtcacctagaatagaattaaactgtagagagcaaattgttggaaatgcaaggagaaacttcggagaagactccaacacagcctggatctgggagatgagactcaggtaacaaaaagtttgaataacatggttaataagattgtggtaacagataggactgaactttgcactctgcaaacaatatacattttaaagtgctcttggaatagttagaaaaatcaatcatctgttaaatctgaaaaaaaaaaaaaaaaaacaacaaaaccccaccccaaaccaatacattccaaaaaagcagacattgtacgggttctaatctctggctgcaagtaagcataactggaattaatttttaaaagcttaactgaacaagcatgtaagagagactcctaccacttgataattaaaaagaaaatgaaaaccaaaaaaacaaaaacaaaaaaaccgaaaagggctgggcaccatggctcacgcctgtaatcccagcactttgggaggccgaggcgagcggatcacctgaggtcaggagttcgagaccagcctggccaacatggtgaaaccccgtctctactaaaagtacaaaaattagctgagggtggtggcgcataccctgtaatcctagctacttgggaggctgaggcaggagaaccgcttgaaccccgggggcagaggttgcagtgagccgagatggtgccattggactcttctagcctgggcaacaagagctaacctccatctcaaaaaaacaaaaaacacaaaacaaaacaaaaaaacaaccaacccctaagtcttaagttggaggatcgaaacactgcaaggatagactatttgaagatgacaatgatgtgaacatggagacaaaggcagaggtttaaatgattatagaggaaatttgcttgataatttattatatgaatatagagagaaatcacaaaaatgagatgatgaatattggaaataataagcacagacgaactgattagaaaacaaatagaactgacaaaatcaaaaagctggatcttttagagagatgctgctcagtagggtggccacaacccacgtgaaaattaaattaaaaattcattttctcagtcgcacgagccaagtttccactgcttaggggccatgtatggttagtgactactgaaatggatagaacagatacagaacttttccatagctgctgaacgtttgttggacagtgctgttttagagggaggaatcaataaaacagaaaaactaagacaaaggagggggagagaacaaatattgtagataaaattaagaatgaaggcctagcgcggtggctcacgcctgtaatcccaacactttgggaggccgaggcgggtggatcacgaggtcaggagatcgaaaccatcctggttaacacggtgaaaccccgtctctactaaaaatacaaaaaattagctaggcgtggtggccgcgcctgtagtcccagctacttgggaggctgaggcaggggaatggcgtgaacccgggagggggagcttgccgtgagccgagatcgcgccactgcactccagcctgggcgacagagtgagactccaactcaaaaaaaaaaaaagaatgaaaatagatgtaatttatttattattgattgattgattgagacagagtctcacttggtcgcccaggctggagtgcagtggtacaatctcagctcactgtaacctctgcctccagggttcaagcgattctcctgcctcagcctcccgagtagctgggattacaggcgcccaccaccacacccagctaatttttgtatttttagtagagaagtgatttcaccctgttggccaggctggtcttgaactcctgacttcaggtgatacacccgcctcggcctcccaaagtgctgggattaaaaacagatgtcatttaaatccataaaaaattgtaaagacagctctactaacaattttggaaatattaaaaataacttcatttactgattcaagtgttacttttatttagcttaattgtttctctttaccagaaattgaggctctgaatttgccccagagaatgggtatgccattctctctcataagctgtactctcttattatcagtaatttctaaatagcctgtaaaatttatatggactcaaaatgcaggaaacatcaataggttgaaactcaacaacttgtaaaaagttactcctgtacttaattgcataaaatgtgtattgcctacatgaatgagaataaaaacttccaaaatgcccccaacaaacaggggtttttgcaccttgccatgagtagctttctggagcaagccggagtggttagagctgtgactcggcaaccacaaacacaaccatttttgtgtggaagtgtggctcttcagccttttttttttttttttttttttgagataaggtctcactctgttacccaggctggagtgcagtggcgtgatcctagctcactgcagcctcaacttcctggactcgagcaatccttctgcctcagcttcccaagtagctggaactacaatcatgtgtcatcatgcccagctaagttttattttttttaatctttaatttttttaagaaatagagatgaggtcttgctatgttgcccaggctggtcttgaactcctaggctcaagcaatcctcctgcctcagcctccccattagctggaactacacttgtgtatcatcatgcccagctaatttttaattttttatttattatttttttaaagagataaggtcttgctctgttgcccaggctggtcttgaactcctaggctccagcaatcctcccacctcagcctccaaagtgcagcctctatatcttgaactccacacctcaaacccagattgtccacatgtgagcacctgtctttttggtttgctgtttctctcgtgagttgtatccagttgcccaaggtggaaagttgggcgtcatccagcaggtaagtcctgacacctccacctccccgatggcttcagaagccagcctcttcttttctgtttcctctgcctctcaacttcctcatccatctaccataagccagaaaaatgacccccaaatgtgaatccgatggtgttctttctgcctgacatctttctttggcttctgctgtggggtaaagtccaagccccttggttccctgtctttcctctctggtctaatcttctattcctctcatcctgtactttgcccttcatcaactctgaactgtttatagttctctgaacatagcccgagtgattcacacatttgcatgtactgttcctctcctgctgtgataaagggacagtcacctaatccccgcccctccgttgcattttttttttcctacaagatttattatgcacctactgtgtgtatggctctgggatgctgtaataagcaagacagacacatctttcccttcacggggcgtatgtgtctcgtgcatactgggagggcagggacagggtctccattcatttctgcattccaatgccaagagggtgtcagatctgggtgggtcgaggtagggaacaggtaaacataactcacagtgtgatgccgtgttacagccaggctgggttcctcacgcctgtgatggcagcgctttggggagccaaagtgggaggattgcttgaagccaggagtttgagaccagcctaggcaacatagagagacccgctctcaaaaaaaaaaaaaaaaaaaaaagctgtcgcagtggcactctcctgtagtcctagctccttgggaggctgaagcggaaggatcacttgagcccaggagtcctagactgcagtgagctatgatggctccattgcactccagcctgggccacagagtaagaccctgtttcaaacaaacaaacaaatttaaaaaatcaaacaaactcccactcccccaaactccataccacaccctctcctggtctctctgggagacctggattcgagttctggcagagctggttattggcaaagtagcccctctatgcctcggtttctccaattctaatggtgatgattgcttgaataattgagttaatatgacctcattgatggattggaccgtgtgtgctgcaaacagattacacactttaaagtgtattcatgcctgtaatcccaacactttggtagactgaggcaagaggatcacttgaggccaggagttctaaaccagcctgggcaacgagtccccatgtctacaaaaaaatagaaaaaattagccaggcatagtgatgcacgcctgtagtcccagctactcgggaggctgaggtgggaggatggcttgagcccaggagtttgaggctgcagtgggcgatgatcacaccactgcactccagcctgaggcgacagagtgagaccccccccccaaaaaaagtgtatttatgggggtgaatgttaaatgagaatgtccactcgctgccttggtttactggaactgcaaattcaatggggacacacaagttttcaaatgcatgcggaatactggctggaggttaccccaaaaacgtagcctgtggattttaagaatgtatttatgagtatggttctcgttttctgggtgagtggtgggtgagaatagagggtgcactggcccggcgagttcggagatgcggaccctccccccctgcaatgtgaggaattttgctgtgtgaccctagtgagccgctgcacctttctggacccctcccgagggaggcctggggtcagggggcccctcggcagtcccgggagctgccacgcggtgacccgatctcctcccgggcacacgcccagcgccgcgcgcagcctaagccaccccggtggatgcttgatgagcccttgcaagctcggtttctccttttccctagctttttccaaagttccatccgtggcagactcgacctgcggggtctgcagccacgaggggccctcccagggcgccctttcctctggccgggaccgcccggcggcggccactgcccgagcgccagtctggggagcggagcccggcgcacccggggggcggggccagcgcccctgcagcacgcccgcccattggctgagcgcgagggcggcgctgcggccgccgcaaccgccggggccggattccccggagcggagtgcgccccgggctttgtgctgcgctgaggcctccggctcgagggggcggagccttgagcgcctagggctccctccctcgcccccatgggcacacacgcagacacgggcacacacgcagacacacacacacgcccatcatggacacacacacacgctcgcccaccatggacacacacacactcccaccatggggacacacacacactcccaccatggggacacacacacacacacacacacacacacactctcactctggaaccgaccaatcctggggctgcacagacacacacgcgcacacactctctctcgttctctctctctctctctcgttctctctctctctcgctctctctcccactctggaaccgaccaatcctggggacacacacacacacacacacacactcccactctggaacctgccaatcacacacacacacacactcccactctggaacctgccaaacacacacacacactcccactctggaacctgccaaacacacacacacactcccactctggaacctgccaaacacacacacactcccactctggaatctgacacacacacacacacacacacccaaacacacacactcccactctggaacctgacacacacacacacacacacacacacacacccccactcccactctggaacctgccaatcctggggctgctctagcgaggagacccctgggaccccgcctccttccgggcctctgcgtgcgcagtatatctcctaagagatccgcagcatggagagggcccgcccccgtggacggactcactccctccccactcactcactcactcgcttactcactcactcactctctctccgaagagaagaagcctgcggctcccgaagcgggaaggccctctggtactctgttccctttctagcctctatatgcgccgtatgtctccaaagagctgcgcagttctattccaaaggcgtcatcgcgtgtggggcggtattgtcaggcaaggaaaaggggcgcttccccgcttcaaggacacgcgctcctgcggtcgtcgctgctgaccacgaagctgtcaaaagttcacctccttggctgcccccaacccctgcccctttgccattaaatcatttactagattccaactagaggaatttggctccggggactcgaacctctgaggtcagggtctggggccagtgtgggagagaaaggccttgaatggaaacaaaataaattactttaaggagtttataaaactcacacttatagggagagccgcggggccctgtggtcaatgtaccagcaggcccatgacgcaactgttccgtttggaaatttctggaaagcagtaatttttggaatcataaatcttgagtattttttttttaaactttggaaaggtttttaaactttttttttttaagttttttttaaacttcggaaagttttaagctttggaaagaatgtaacaaaatgttattaacatatgtggagctatcgaatcatttaatggtggtttctgtattttctgttttgttttttatcacataccttcttaattaagaaaaacccaaactaatttgaactttaaaagggaggcaaacaaaaaagtgtcagagtgactggatttttgtgcgcaagtcatttaacaatgcagcgctgcgtctcctatttctctggcttttaaccttgctttggacaaattggtcgctttttgttttgatgtcgtttcaagcttacggaaaaattgcaagattatatctagatcaatcaattgtttacgttttattctacttgttttattacctttctaatatatttatgcacacacattatatacatttttttcccctgaactatttgagagttagttgcaggcatgatacatactccttaattcttcagtggatatttcctaagaacaagaaagttctgaggccaggcgtggtggctcatgcctgtaatcccagcactttgggaagctgaggcgggcggatcacctgaggtcaggagttcgagaccagcctgaccaacttggagaagccccgtctctactaaaaatacaaaattagccaggcgtggtggcacatgcctgtaatcccagctactcgggaggctgaggcaggaggttcgcttgaacctgggaggcagaggttgcagtgagccgagatggtgccattgcactccagcctgggcaacaagagcgaaactccgtctcaaacaaaaaaaaaaaaaaaaagaaagaaaagaaagaaagttctcttacataatgatggtactggtgccgttgtcaaaatcaggaaattaacattgatacagtattttaatccaatgtcttctataatcttatctgttgtctcaatattgccctatatagattttttttcctaggcgaaggttccaatctaggatcacactttgcatttgaatgctgctgtctcttaagtccgcacaattcctcagttttctgtgtctttcccaacattggcttttatttatttatttatttatttatttttatttttttttgaggcggagtcttactctgtcacccaggctagagtgcagtggtgagatcttggctgactgcaacctctgtctcctgggttcaagtgattctcctgcctcagcccccaagtagccgggattacaggcatgcgccaccacacccagctaatttttgtgtttttagtagagaaagggtttcaccatgttggccaggctggtctcgaactcctgatctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatgtctcgaggacaggggatggggtttttgtgtcatctatgttctgatgctttttcatttaatacgagaacaggtttcctatgatttggcacactgggacattcgacatgtgtttgttgaatgaaaaaaagaaaaaagagaaatgctaacaatttgttgaatagtccataaaagagcaaagctggcctggcgcggtggctcacacctgtaccagcactttaagaggccaaggcagacggaggtcacgtgtttgagaccagcctggccaacatggtgaaaccgcttctccactaaaaaaaaaaaaaaaaaaaaaatcagttggtgtggtggcgtgtgcctgtaatcccagctactcaggaggctgaggcaggagaatcgcttgaacccaggacatgggggttacagtgagccaagattgcaccactgcactccagcctgggtgacagaaagagattttgtctcaaaaaaaaaaaaaaaaaaaaaagcaaagctattattaaaacacactccacacttcacccctgagccccatattgattttgtaataaggcaaagataatttttttttctttttttgagatgaagtctcattctgtcgtccaggctggagtgcagtggcacgatcttggctgactgcaacgactgcctcctgggttcaagcaattctcctgcctcagcctcccaagtagctgggattataggtgcctaccaccacgcccagctaatttttgtattttgaatagagagtgtttcaccatgttggccaggctggtctcgaactcctgacctcaagtgatcttcctgcatcagcctcccaaagtgctgggattacaggcgtgagccaccatgcccagccaacaaagatgattttaagagaacctttgtaaaagctctcaccgatgcctgtcattattagaatatttgggagtagaatcatgtaactgatcaataacattgtttactgtctagcagaggcttttgaaaaatgtatttcctggctgggcattgtggcttacgcctatgcccagtttgggagctcggggagagcggatctcttgagcctaggagttcaagaccagcctgggcaatattgtgagacctcatctctaccaaatgtatatatacatatacaaaaattagccaagcatggtggtgtacgcctgtagtcccagctactcaggaggctgaggtaggaggagcacttgaacctgggaggcggaggttacggtgaaccaagatcatgccactgcactccagcctgggcgacagagtgagacactgtctctaaataaataaatgaaagaagaagctacttgaaaaaaatatgtatttccaaatatatgtcagttttgacaggatagtacacatacatagtaaaaaataaaaataaaatagggcacttttttgtgtccctttcagagggacatatgtcccatgtgtcctcccccctcctgcccctaatttttttgtttgtttttttatgagatggagtctcactctgtcgccaggctggagtgcagtagcgtgatctcagctcactgcaacttccgctccccaggttcaggtgattttcctgcctcagcctcccatgtagctgagactacaggtgcgcgacaccatgctcagctaatttttatatttttcgtggagacggagtctcaccatgttggtcaggatggtttggctctcctgacctcgtgatccgctcaccttagcctcccaggcttagcctccttagcctgctgggattacaggcatgagcagaagaatctcttgaacccgggaggcggaggttgcagtgagctgagatcgtgccactgcactccagcctgagggacaagagtgagactccatctggggaaaaaaaaaaaaagaaaaaaaagaaatactgcatcaaattgcacttgcctcttggtgcaagattcgttcctttgctttgaactgcctccctgaagcaaattggtgtttctgtgactccctctgtctagggaaggggtcctttagtggggacattgtctttcttggggagggtccaccagaggactctgacacagcggtctcctttctcctccgtcaacttagttagattttagtccctgatcttctcagcagtgtatagtgaaaaagccaccgcagctgaaagtttcaggaagatgatagttgcttctgtgtgctcacccaggagcttttgggaggtttagggagaactgggggaaaattgggaccagcagctcaatgtggctttgaaggggagacagcggatggacacagaacttgcatttttggagaggggaggtctgggtagatgttccctacatacacagcagcacttgtgtgcaggtgtgagggagtgacagcccccggacggtttggcattttcctgcaagtctgccatcttgtctggcagacatagcctgggctgctgactgtccctaccccaaaccagaatttgggcaggaacggacacttgggctcattacgtgtcaatgagggggatcaggtcaggggcacagggagaggaaagtcaaccccgtcctccactggggctgtttctcatcttgcatgacacgtggctttcataatgtcttcactttgcggtctctctcaccagaagaagctgctgttttgtggctagttcatctgtgtcatgccctttccccagcctgggctgcctgtgatttttttcttttcttttcttttcttttcttttcttttcttttcttttcttttcttttcttttcttccctccctcccttccttctttctctttcttttctttctcctttctttctttttctttcttttttcttttctttctctgtctttctttttctttctctttctctctctcttatctttcttctttctccctctttcttttcttttttctctttctgtattctttcttctttctctctttctttccttctttctttctccctcccttcctgcctctttctttctctttctttctccctcttctttctttctctctctctcccctccctccctccttccttccctccttctttctttttatctctctccttccttccttccttccctccttctttctgtctttctctttcttttctctctctcccttcctccttccttccctccttctttcactctctctttcttttctctctctcttctttttaaagatagggtcttgctttattgcccaggctggagtgcagtggtgcagtcacagctcactgcagcctcaaacccctgggctgtagcaatcctcccacctcagtctcccgagtagctgggactattggtttacgggtgtgcaccatcacacctggctaatttttttatttttgtagagacaggggtctggctattttgcccaggctagtcttgaactactggactcaagagatcctcccgtgttagcctcccaaagtgccattacatgcacaagccactgcgcctggcaggcttgtgattttcatgtggagcttttcacattctgtctaacaatccgagttcagaggaaccagtatggggagcaagagtatgtggaaacgtccagcaccagtttagaggactcccactcagctagggggtgcagtggccaccccgagtggcttttctttcttttctttccctccttccctccctccctccctcctttctttctttctttctttctttttctttctttctttctcttttcttttctttctttttgagacagagtctcactctctcttccagcagtggcacaatctcggctcactgcaacccccgcctcccgggttcaagcaattctgctgtctcagcctcccaagtagctgggattacaggcacctgccaccacgcctgtataatttttgtatttttagtagagatggggtttcaccatgtcggccaggctggtctcgaactcctgacctcaggtgatccacctgccacggcctcccaaagtgctgggattacaggcgtgagccaccgttcccagcctctatttttttaaaattgacaaataataattgtatatgttacatatttatggggtaccatgtgatgttttgatatctgtttacattgtagaattactaagtcatgccaatttaaaagctatcacctcacatacttatcattgttttatggttaaaaatatctacatttttggcaattttgaaatgtccagtgcactattacttattatagcaaccattgtgtccaatacataactaaagcttatttctcctaagtgaaattttgtagtttgatcaacatctccctacagagttggaaacacctggaatgagcttatagtgttcgaaggatagtcttcaaagaattggttgggcgcggtggctcacgcctgtaatcccagcactttgggaggccaagatgggtggatcccgaggtcaggagttcaagaccagcctggccaacgtggtgaaaccccatctctactaaaaatacaaaaattagctgggcgtgatgacgggcgcctgtaatcccagctactcaggaggctgaggcagagaattgcttgaacccgggaggcggaggttgcagtgagctgagttctcaccattgcacttcagcctggacaacagagtgagactctgtctcaaaaaaaaaaaaaaaaaaaaaccaccaaagaacacaggtcagcatgtttatttaacccattagtgagggaacagcaggattataaagccaaaacatgtatagtcactgaaataagaaggcagtgttagctgtgaggctgcttaatgtcccataggacaataaaactgtaatctttggggatgatttttttcttttttttttcggcaaggagagataggatctcactctgttacccaggctggtctcgaatgcctgggctcaagcaatcctcccgcctcagcctcccaaagtgctgggattacaggcatgagcctccatgcccagctgagagtatcttttctctgagatgaaaataatttgtagcatatctgtctgtaagttaactctaatttccttgagtctagttcctaatagaaatagtaaaatcggccaggcgtagtgggtcatgcctataatcccagcactttgggaggccaaggtgggcagatcacttgaggtcaggagttcaagaccagactggccaacatgctgaaacccagtctctactaaaaatacaaaaattatccaggcatggttgtgggtgcctgtaatcccagctactcaggaggctgaggcaggagaattgcttgaacctgggacacagagtttacagtgagcggagatggcaccgctgtacttcagcctggacaacagagcaagactcggtttcaaaaaaaaaaaaaaaaagtaatagtaaaatcaattacaggtacatttaactagtgcaggttgataaactatctggcccatcacttgcttttataaataaagttttattggacctagccatgcctcttcatgtacatatgtctgtggctgctatcatgccatcgtggcagagttgagtagtttcaaccaacaccatatgtcctgcaaagcctcaagtatttgcttgtggccctttacagaaaaagttgaccaactcctgtgctgacaaatgaaatagctcagataggcctgtcagctagggctccaacacaggattgcaaagtctcgcagcctctggccttgtttgcaatggttggataatttttcttcccattgtctaggccggaaggacttatgtgtttgagaggtttgtgttaggccattgatgacgcctcttttgaatgaaagggctgaccctctgaagtggctccagcccaggaaacaagccccttcctcttgtgtgtgtgtttccttgccagagtgctggaactccgtgggtcctggatcattgttgtctgccttgtatattgcttccttcaattgaatttcagccctcaggttcccacagacagatcagtgttaatgatgttgataattatgataattatagataccctctgtagttaatttctatcaagcctaaaaatgtctctatcaaagaatctgatgtgttactgacgtcatcctgtttatttcttgcaacagccttaagaaggaaggaagggactcttattaacaatcccccctccctttttttttttttttttttttttgagatagagtctcgctctgtcacctaggctggagttcagtggcacaatcttgactcactgcaaactcctcttgcgttcaagcgattctactgcctcagcctcccgagtagctgggattataggcaagcaccaccacacccgactaatttttgtatttttagtagagacgggtttcaccatgttggtcaggctggtcgtcttgaactcctgacctcaagtggtccacccacctcagcctctcaaagtgctgggattacaagcatcagccactgtgcttagccctattagaacttcctaatattcttgttttttttttttttttggacggagtctcactctgtcagccagcctggagtgcagtggatctcagctcactgcaacctccacctcccaggttcaagtgattcttgtgcctcagccttctgagtagctgagtagctgggattacaggcgcccaccaccacgcccagctaatttctgtatttttagtagagtcggggttttaccatgttggccaggctggtcttgaactcctgacctcaaataatccacccacctcagcctcccaaagtgctgggattataggtgtgagcccccgcgcccagccccaagataattttcaagagtgatccatgccataaggaaaatgtaatgagataatgtgttagcttatgaatggagcaggaagggcgacttctgctggggaagtcagggaagatctgtgtaaggacctgaaggatgcaaaggagcaagtcacaaggggacaagggaccagggtgctccacccagaacagcttgtgcaaggtcctaaggtagggctgagcctgggtgtgtgtgggtgggaggtgcagaaaggaggccagcctgggagaagaatttagcaagactggcagggattagaccccccaaggcctgtagggagttggcttttattctgtatgcctgaactgtctcgtctgggagacggtagtcatctgtggctagtaaacattggaattgtgtcaggcacagtggctcatacttgtaatctcagcactttgggaggctgaggtgggaggatcgcttgagccaggagttcgagaccagcctgggcaacatagtgagaccccatttctacaaaaaattaaacacttagctgggcgtggtggcgcatgtccattattccagctacccaagaggccgaggtgggaggatcacctgagcccaggagattgaggctgcagtgaactgtcactgtgtcactgtaccccagaacctaagtgacagagccagaccccatcacacacccaaaaaagaaatcgttacacattttatccatatgacaaaatatcacaagtaccccataaatgtgtaaaatattctgtatcaatgtaaaactttttaaaaattttaaactgaaattaaaatgaaatgcagttaaaagttttgttccttggtaaaaattggagccctggtacactgttggtgggaatgtaaaatactgcagctaggctgggcacagtggctcacacctgtaattccagtactttggggggccagggtgagtggatcacttgaggtcaggagttcgagaccagcctggccaacacggtgaaaccccgtctctactaaaaatacaaaaaaattagcggggtgtggtggtgggcacctgtaatcccagctactcgaggctgaggcaggagaattccttgaacccaggaggtggaggttgcagtgagccgagatcgagtcactgcactccagcctgagtgacagagtgagactccatctcaaaataaattttttaaaaaagaataaatcctatattattccacttatatgaggttcctagagtcatcagagtcacagagacagaaagtaaaatgggatgtcgggcgcagtggctcacacctgtaatccctgcactttgggaggctgaggcaggaggatcacgaggttaggagttcaagaccagcccggccaacatggtgaaaccccatctctactaaaaatacaaaaattagctgggtgtggtggtgggcgtctgtaatcccagctactctggaggctgaggcaggagaatcacttgaacccgggaggcagaggttacagtgagctgagatcgcgccactgcaccccagcctgggcaacaaagcaagactccatctcaaaaaataaaaataaaaaaaaagaaaagaaaaagaaagtaaaatggcaggtgccaggagttggggaggaggatgagtgtgactgtttcatgggggcagagtttcagtttggttaaggtgagaaagttctggagatgggtggtggtgatggttgcatagccacataaaagtatttaataccactgaactatacatttaaacatgattacaatggtgaattttatgctatgtgtattttaccacaattaaaaaaaaaattggatttcctagttgcactaagcacattcagaagccacaggggagaagtggctactatgttggatggcccagatagagaacatttccgtcatcgcagaaatttcgaccagatggtgctgttcatatatggatgtagcttctggggccacttctgttccctgagtttggccggtgggatccactgtgctgagaatcacagtctggggatttggggtgaagaacactccccaactttctttcttattttttgttttgtttcattttttgttttgagacagagtctccctctgtcaccaaggctggagtgcagtggcatgatctcggctccctgcaacctcccctcccaggttcaagcgattctcctgcctcagcctcctgagtagctgggattacagacgcccaccaccacacccggctaattgtttgtatcatcagtagagatggggtttcaccatgttggccaggctggtctgaaactcctgacctcaggtgatccgcccaccttggcctcccaaagtgctaggattacaggcatgagccaccacaaccagccttttttttttccttccttccttccttttctctctctctttgtctctctctctcttttttttttttttttttgacagaattttgcacttgttgcccaggctggagtatagtggcacgatcatggctcactgcagcctccacctcccagattcaagtgattctcgtgcctcagcctcctgagcagctgggattacaggcatgcaccagcacacctagctaatttttgtatttttagtagagacagggtttcaccatgttgaccaggctggtctcaaactcctgacctcaggtgatccacccgcctcgacctcccaaattgctaggattacaggcgtgagccaccacaccgagccacatttgcatgtttaagtaactaacatgtctcctccattagaccttgtgctcccaaaggcaggatctgcagccacttttttccccacagtggccacagtatctagattagtgcaagcaaatgtctgttgaagcaatcagtggtttgggggcaagttacttaacctccctgtacctcagtttccccatttgtaaaacaaaaaaataaaggagctaacagtgtatctacttcacatgtggggtgcagcagcatgctggagttggcttgctggagccagtggtgaaattttcaggcaatttgtgagccatttgttaaacatagatattcataaaaattacataaacctacagttaaacaaattacattaaaaacaaaagtttttaaattaacaaagctttttaaaagtaacaaatactcaaaactcaccacctcctaatatcatacgatgttttcctattatttgtgctgttgaggttatttactacttttgtgtcaatagtagatacattttgtgtatacttataaatactacttagaggaatgctactgtgtatcttttgtcagcttatgtttagtaacttcatgttggtggcctgaaatccaccactggtaggaatatttacaccatggaaatcggcaaatgctatataaatctgggcctccctgggcccctccctcaggcagctgttaaacatttacaagctcaccaatggtttggaggcttaaaccagttaatagatgtgtctgacatgtgggtaatgatgtagacgtgccgcttttactgttagtgtttggttggctttcactgtctgatccagaattgctgcatatgcagacaggaattggacaaagccatttatttatttatttatttatttatttatttatttatttatttccctctctctctctctctctctccagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaagtgagttctggatgtgggtctggggggcagccgagaggagaaggaacgtggggttggttgtgacgatgccgcttgttaaaactgtgtgcaaacccagggttaattggctatgagtgaggtctctgctctcagatgctacttttgcaccctgttttggtcctgggcttgggagtgggagttgactacctttttctctaaaggaccagatagtatatacttctggcattgtgcccaccattctttttttttttttttgagatggagtcttgccgcaagactcccaagctggagtgcagtggcacgaacctggctcactgcaacctctgcctcctgggttcaagcgattttcctgcctcagcctcccaagcagctgggactgcaggtgcctgccaccatgcccggctaatttttgtatttttaatagagacagggtttcgccatgttggtcaggctggtctcgaactcccaacctcaggtggtccacctgccttggcctctcaaagtgctgtgattgcaggtgtgagccaccgcacccagtctggcattgtggacctcagttctaagctttctgtggttggcttcagaacaagaaaatataataaggacagagtccttggttttccctaaaatcctccacgtggcctgtcctcactgatgtagcttcatcattgtcacataaaggatataccaaggtctttcgtgtcttccctgacctgtagcctggtggtgtgccaagattagcccagaacatactgtctccaggaggaagagactcgcttctgcattattctcagggctttgctgttctctgaaggacagtataatcaaaccatttcctgccgtttgggtgagaaatagcagggttttctctcttcgacagagtcagatttcctacgcacatcgcagactttctgttcgtactgtgagcttcttccatgagctattttggggccgtaactgagttgcaaaaatctgtttcctggtttttgtattgaggttttatgttttgttttaaaacacacacacacacacacacacacacacacacacaccacaaaacaacacaaaaacaaatcagaaacagacacacatcaagaggccttgagctgacctgcttacgtaaagtatcttcctcttcagacttgagaattagccaagcgagagtgttggggtgggaaattgtatttccctgggtggagagggcgggaaggaaaacaagctgtaatttcagttcttatgactctttctttgagtgtttgtgaaacctgcaagtacaatatgttttgttttgctcgttgttgataaaaacctaccaaaaaaaccttttggctttattgaccaaaagggtctataaatcaccttttcataccagacagacttttgttttaggtttttttttttttttttggccagtgtattcccaagattgaggaaatgaccatattccttttgattcatttctttctttttaaaatcacaattgaaataaaaaaaatgggttaatatcttctggcaagatgtttgtttaaaagacattggccttaaataaaaggcatttttccctcaccttaacaatggcctgagaaatatagcaacctcctttgattttctcactgatgatgcgggagatgctaaaacagaaaccctgagaaattgaccgcacatccttggtatctgggacctttcctgaacggaagaaaacaaaggagaggggggtgcattgtcaccgtattttattgcgtaggtttaaaaaaattaatatttttatttctgaagcttttaattaattaatttatttattttgagacagagcctcactctgtcacccaggctggagtgcagtggcatgatctcagctcactgcaacctctgccttccaggttcaagccattctcctgcctcagcctcccaagtagctgggattacaggtgtgaggcagcaagcctggccaatttttttttgtttgtgcttttgtttttttgagatggagtttcattcttgttgcccagactgaagtgcaatggtgcgatcttggctcactgcaactcagcctcccgggttcaagtgattctcctgccttagcctctaagtagctgggattacagacatctgtcaccatacccagctaaatttttcttgtatttttagtagagaccgggtttcatcatgttggccaggctggtcttgaactcctgacctcaagtgatccacccacctcggcctcccaaagtgctgggattacaggcatgagccaccgcacctggcctgaagcttttctttttatcttatgaaagacttaatcgtactgtggcattttctaatgtggtttgatatcaaatagggccagatgttttcttccattctggtggcttatctgggaaggagttcttgatgttttcagagcagagttctgggaacccatgttaaaaggccttggccaggcacagtggcttatgcctgtaatcccagcactttgggaggccgaagtggacggatcatctgagggcaggagttcaaggtcagcctggccaccacggtgaaaccccgtctttactaaaaatacaaaaacaaaaaaaaaattagctgggcatggtgatgcatacctgttatcccagctactcgggaggctgaggcatgagaattgcttgaacccaggaggcagaggttgcagtgagctgagatcacgccattgcacgttagcccccaggcaagtgtgacaagagtgaaactgcatctccaaaaaaaaaaaaaaaaaggtctcaccatctactgtcgttccaaagtacctgctgggatgtaatagcacagtgctgcttcctgagatgagaaggaccagatatttgtgatgaataaattttcaatgcgtatggggtatccactgggaaggggagaattacctaaaatccttgattcttcttggcctctctcacttcttcctattaagctgaggtctcaaatttgtctacacctccatctatttcaccatcatgtctggtctgacccagtccccttgaacaatctctttgctcctgcttccattctagtgacactggtaaaaagtggccacctgggccaggcgcggtggctcacgcctataaccccagcactttgggaggccgaggtgggtggatcacctgaggtcaggagttcgagaccagcctgaccaacatggtgaaaccccatctctactaaaaatacaaaaattagccaggcgtgggattacagtgggcgcctgtaatcccagctactcgggaggctgagacagcagaattgcttgaacccgggaggtggaggtcgcagtgagccgagagtgtgccactgcactgcagtctcggtgacagagtgagactctgtctcaaaagaaaaaataaaagtggtcatctgatcatatgccatgtccttccctaaaaccctccggtggcttcccaagaccaatggacagaatccaaactcctcatcgggagggctcggccagttctcattctcatttcattccggtgccccctggccgtggtggtcgttaccgcaggagcttttcctgcaacttgctacatccgctttcctctgtgcctttcaattagctgttccctcttcctataatgcttgtccctgcatttgagaatgatccactttttcccctcgtcatctagatggcagcttaaaagtcacctccttggcaaatccttcccgtctgagtcaatcatccgtgcactctctgtcacatcatttagttttaactcttcgatttgtcactagctgatatttttgtcttttttttttttttttgagacaaggtcttggtctgtcacccaggctagagtgcagtggcacccacatggctcactgtggtctcaaccccctgggctcaagagatcctcctgccacagcctcctgagtagctgggactatataggcacacaccaccacacctggctaaaaaaaaattctgtagtgttgggggtcttgctatattccccaggctcgtcttgaactcctgggtttaagtgatcctcccaccttggcttcccaaagtgctgagattacagggcctgagccactgtacctagcctttgttgtcaatttattcactctccccaaccagatgataagctttgtgagtgtatcagctagctcttgttgcgtaacaaaaccacctcagtgcttagtggcttaaaacactcctttaggagctctgatgatttcatgtgttgactgaaggtttgtctggcctgggcctgtttagctacggctgatggtttaggggagcctcttgtgtctttgatggtcagtgggggtctctctccataagtctcttaccccagcagccaggaagggcagacctcaatgttcaagtgcttttcaagcctcagcttgtatcacgtttgcaaatattccattggccaaagcaagccatatggccaagcccagattcaacaggtgggaacatagactccacttcttggtgggagaggctgcaaagaactcatggtcatttataatttcccactgggaaagcatattatctgctttgttcactcatgtataccggcagctgagaacgggggttggccaagggccagatagtaaatattttcagctctcagggccatatggtctctgttggagctacttaactctgcctttgcagcgtgaaagcagggttagacgatgtactaaccaataaatgtggccatattccaataggatattatttgcaaaaacaggtggcctactggatttggctcccagcccactgtttgccaactccaggcttagagcattgcctgccacataataagaatagaggcaataaaagaagtcaaacatttggtcagtattttgtttctgcctcagctgttctgccactacctgggtgtacttgcaacaccgttctgacaccatcctcctccaaagttagcatcagacgccacaagtttaaggctcagccctccatgagatttcccttgcttcagacactggcagcatcttggggatcccccagccacccacacttctgactaactggctctaaattgggggattcccacaaactgtttgggtttcataatttactagaaggaactcacagaatgaaaataaacctggccaggtgtggtggctcatgcctgtaatcccagcactttgggaggccatggtgggaggctcacttgagcccagaggttcgagaccagcctggacaacatagtgagatcccatctctacaaaaatttaaaaacattagccaggtgagggggtgcatgcctgtagtcccaggtacttgaggggcttaagcaggaggatcgcttgagcccaggagttcgaggctgcagtgagctaagattgtgccagtgcaccccagcccgggtggcagagcaagatcttgtctcaaatttaaaaaccctgctatacaattacagttttattataaaggatacacatacggcaagatctgggagagttctagatgcagaatttccatattgcctcctcgtggcaacagcatgtatcaccctcttgacatactggtgtgtccaccagctgggaagtactactgagcttcagcgtccagagtttttgtttgtttgtttgtttgttttgagacggagtctcactctgtcacccaggctggagtgcagtggctcaatctcagctcactgcaacctccacatcccaggttcaaacaattctcctgcctcagccccccgagtagctgggactacaggcatgcaccatcacgcacggctaatttttgtatttttagtagagacagggtttcaccatgttggccaggctggtctcaaactcctgacttcgtgattcacctgcctcagcctcccaaagtgctaggattacaggcgtgaggcactgcacccggcccagtatccagagttttaattggagtctcattccttaggcgtgattgattgaaatcattgaccatgtgattcaacactgccatttccagccccctcatctccctggaggtcctaaaagccccaaccctctgatcacagggttgttctttctggtgaccgccccccaccctcatgttatctaggcacccccccccccacaagtcaccccgacattcctaacactcctaacaaaagcattcctgtgactcagaaagttccaagggtttttgaagctctgtgccaagaaccgggatgaagaccagatacatactttatgatcctacagtcacaaaaatcactctgaagagttgaatacccaggagtgtgagaacaacagcagcagcaacaaggatgccaccaataaaaaatgacccttgtagcaacggataaaattgcgttctgtgtgcgaagtgcttttgtggtatgcttcattgagttcctcatcacaagctgtggcgttggtggtgttattttcagatgaagaaatggagactgtaacagttgggaatcttgtggtttcatgcaccagaaccccaactcaaattggcttaactggccgggcacggttgctcacacctgtaatcccagcactttgggaggccgaggcgggtggatcacctgaggttgggagttcgagaccagcctgaccaaaatggagaaaccctgtttctactaaaaaaaaaaaaaaaaaaaaaaaatacaaaattagatggggcatggtggtgcatgcctgtaatcccagctactcgggaggctgaggcaggagaatcacttgaacctgggaggcggagcttgcagtgagccgagatcgtgccattgtactccagcctgggcaacaagagtgagactccatcttaaaaaaaacaaaaacaaaaacaaaacaaaaaaaccattgacttaaccaagattaaaggagtttgttggtacccataaccaaaaagttcagggagttggttcaggtatagctgtatcaagaagcttaagcgatgtacctgatcagtctccttcatctttattttcctctttgttggttttgttatcaggcagcttctccctcacccttcaccccatgctagcaagatggcaaaacccttagatactccagaaggaagacaatttccccttccagcatgttctagcaaaaccctcactgcactgacttaagttctgtacccaccacctctgagcccccacaggaatagaaggtggtgctcagcttggcttggatcttgtgcccatcctggatctagaagggctttggcaaccaagaactgatctcagagaccccgtgttggggaggactggttcccaaaggactcctgggggctgtgagtttgatggcatcaggctgcaggctggcaaaaccaaaggctgcccaagtcacttgccattaaacatggggtcatgttacagccgtagttgcatcacatcccacacagaacagcaaatgtcctgtctccttggagtagcaggttgaattctgccacgttggggtaactgtcagttctgccacatcaggcccatcatctcaaggtaacggcacattcttattaccacatgcattagtccatttctgcactgctataaagaatacatggaactgggtaatttataaagaaaagaggtttaattggctgacagttctgcaggctgtacgggaagcatagcagcttctgcttctggggagacctcaggaaacttacaatcgtggcggaaagcaaaggggaggtaggcacatcttacatgactgaaggaagagagaaagggggaaggtgctacatagttttgtttgtttgttttgagacagattctcactctgtcacccaggctgggctgcagtggcacaatctcggctcactgcagcctccacctcctgagttcaagcaattctcatgcctcagcctccccagtagctgggattacaggtgggcaccaccacacctggttaatttttgtatttttagtagagacggggtttcaccatgttggccaggctggtctcgaactcctggcctgaagtgatccgctcgccttggcctcccaaagtgccggaattacaggcatgagccaccatgcccggctggtgctacatacttttaaacaaccagatctcgtgagaactcactcactatacactgccaaggggtatggtgccagaccattcatgagaactccgcccaccatgatccagtcatctcccaccaggccccacctcccacattggggattacaatttgacatgagatttgggtggggacacagatccaaaacatatcgccacgataatgctatgagtcccattgctgtcacgcacagggtagatcatggtcctgcctccatgggatatggtgtgaatcccatcactgtggggtccagcaggagtcctgtcccatcactttggggtaaaatatgagtcttgtcactttggggtaaaagcaagaggacctgcaaccatagggtaatggcataattctctcacttaaggcagtggttcttttctggggacaatctggcatcctccctccccaggggacttttggcaatgttgggagactttttttttttttgagatggagtctgactgtgtctcccagctggagtgcagtggtgctatctcggctcactgcaacctctgcctcccaggttcaagcgattctcctacctcagcctcctgagtagctgagattataggcacgtgccaccacacccagctaatttttgtatttttagtagagacagggtttcaccatgttggccaggctggtcttgaactcctgacctcaggtgatctgcccgcctcggactcccaaagtgctgggattacaggcgtgagccactttgcctggcctggaggacatttttaattgccacaacttgtgggagggatgctactggcagctcgtgagtggagcctagggatgccgctcaatatcctccaatgcataggacgccacccccactaccacagtggagaattacttggccccaaatgtgaacaatgctgaggtcagaagaccttgccgtagcatgatggacttatgccatcacttgagaccctgcatagtgtgctgtcttcccaggctgatcttgaactcccaggctcaagcaaccctccctccttggcctctcaaagtgcaggaatgacaggcaggagccaccacgcccggctccagaatctacatttttaacaatcaagcgatatgtcctattgcagatcggcagactgtgttttcagaaatatcatctcaggcagaaagggccgggtgcagtggctcacacctgtaatcccagcactttgggaggccgaggcgggtggatcacttgaggtcaggagtttgagaccagcctggccaacatggtaaaaccccgtctctactcaaaaatacaaaaattagccaggcacggtggcgggcacctataatcccagctactgtggaggctgaggcaggagaatctcttgaacccagaaggcagaggttgcagtgagctgagatcgcaccactgcactccagcctgggcaacagagcgagactctgtcacacaaacacacacacacacacaaagaaataccatatcaggcagaaagatgcctgagatgtctgaaggaccttggataccgtgacacccccctcccctttctctttctctctctctctgctccgtccttagcttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcagtgagtgtctctgtgtgggcgtcgggggtgcctgttgggctccatgtccctctgagctgtgagcggggaagaaaagcagtgcagaccctgctgcgtgctcctacagcacttttaggatggtcgttcagtggctcccccatggatagaaccatgctgggagtctgcctcaaaacctgaaatgaacagctcagtcttggccttactaaccttgagattctcattttctactttgggagttggggcatcaggaatctgcatttacatttatttttatttttatttttatttttagagatggggtcttgctccattgcccaggctggagtacagtggggcaactctagctcactgtagcctcaaactcttgggctcatgcagtcctcctacctcagcctcccaagtagctgggagtacaggcaggtgtcactgtgccgggctaattttttttttttttaatttttttccagggccaggttctcactatgttgcccaggctggtctcaaactcctgggctcgagcaatcttcctgcctcagcctctcaaagtgcagggattacaggcatgagccaccccacctggctttggaatcgtcgtttttaacaatcaagcaatatgccctattgcagaactgcaggctgtgttttcagaaataaatctcagggccgggtgcagtggctcatgcctgtaatcccaacagtttgggaggccgaggcaggtggatcacgtgaggtgagaagtttaagaccagcctggccaacatggtgaaaccctgtctctactaaaaatacaaaaaaattagccaggcttggtggtgcgtgcctgtaatcccagctacgcaggaggctgaggcaggagaatcgtttgaactcaggaagtggaggttgcaatgagctgggatcgcgccactgcactctagcctgggcgacagagtgagactccatctcaaaaaaaaaaaaaaaaaaaaaaaaagccaggcgctgtggctcatgcctgtaatcccagcactttgggaggctgaggtgggcggatcacttgaggtcagaagtttgagaccagccaacatggtgaaaccttgtctctcctaaaaatacaaaaattagctgggcacggtggcacatgcctgtagtcctagctacttgggaggctgaggcaggagaatcacttgaacctgggaggcagaggttgcagtgagccgagatcacaccactgcactccagcctgggccatagaccaagactccatttcaaaaaaaaagaaaagaaataccatgtcaggcaaaaaggcattcctttgtttatttctttagcgaacatgtactgaatactcacagtgagtaagggaaagtccttaccttgatggatttttgcgcataagtaaatcgacagatattgtaaggtcaggttgtggtctgtgctgtgaagggaagtgcagcagggtaataggtggaatggaaatgggcaacttttccctataaagggctctttcatgaatatattcagcctggcaggccgggcagtctctgccgtaaccactcaactctgccgttgtaatatgaaaacagccatagacccatgtcagctagcaggcatggctttgttccaataaaactttatttacaaaacaggtagaatttggccagtgggctgtcatttgtcaacctctaaaatggagactaacaggggttgctatttttttttttttttgtagttttagtagagacagggtttcaccatgttggccagggtggtcttgaactcctgacctcaagtgatccacctgcctcgccctcccaaggtgctggtattacaggcatgagccaccagcaccaagctgggggttgctattttagagaagtctctggtatgggaaaggagggtttgagatgatgatggaacaagccaaggagatatatggtggaataatattctgagcaacagacgcagccagtgccaaggtcctggggcagaagtatgcttgacccatttaaggaatgctaaggacttcagattgtgttctaagcatgatgagttttgagctgggtatgtccagtcatttgcagcctgagggttatcttctcaccatggagaatcatgagaagattgaaatatgtctatagaaacccactggatattctctcctttccttagacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggtacgtgggcctgattgtgtgtatggcctgagtgctaactaggaagttcgtgtattagaacaacttaaggatttttttggccaggtgtggtggctgatgcctgtaatcccagcattttaggaggccaacgtgggtgaatcacttgaggcggggagttcaagaccagcctggccaacatggtgaaaccctgtctctactaaaagtacaaaaattagccaagtgtgatagtgcatgcctgtaatcccagctacttgggaggctgaggcaggagaatagcttgaacctgggaggcagaggttgcagtgagccaagatcacactactgcactccagcctgggtgacagagtgagactctgtccaaaaaaaaaaaaagaaaagaaaaggaaaaacttaaggattttttaaaaatcaaataaaaacaaataaaaaacaaataaaagtatatctggcaaaacctcgggaaaaaagaacttggaatgtgcctaaaggtccatccagccaaaaattgtaaaagcttttttatagtcattcttgagaaacaaaagtgggagcagcccaaccttggtgcccatcctccaagggtacaggctggaatttttgctaaatttgctgtttgggctgcattgtgagtagagtttggcatgcataaaatgaacattccctcttagtcccggttgtccatcctaatttctgggatggactccatctcagtatattccagtatattccaaccttctccttgaggtcctagaaactctattagcaaaacagcagaaactcaaactagctagatcaagattgactcataggcaggaggtctgtggaagacccagattctttccatctttgtgctcctcatggtcacaagatggctgcctcagccccagcctcacatctgtagaacagacagcaaatggggaaagggacaaaaggacatgttaatcaacatgagctggtaagtgacttgagaaggtggtctaaacaatatagtttagactatattatctgtactccagcctaggcaccagagtgagaatccatctcaataaaacaaacaaacaaacaaacaaaaaccttcaatggctcctttctccttattaaggatggccacatgttcttggtcttggtctggcatgcaatatactagagggtctggtccattgcaactacagctatttcctgtcacctattggccaaaacaggctactttgctcttccctgaactcagcttaggtgcctctgtgttatcagtatttcccctatttgcagaaattggtttctgcaaaacctattcctcagtccatcacagactcaccacccctcttcaagactgagctgagcctccttcctggccatgaaaacttcctcaacttcctctgttatccacattcaacaaatatgtgttgagtatgtgccaagcaagtggagaggattaggcacgtagcactgaacaagatcaactccgagcatggccacaccatcttggagttgtagaagaccagccgttgaatgactagatgtgtgtgttttttccataggaactactccttctatgccttggacaaccagaacctaaggcagctctgggactggagcaaacacaacctcaccatcactcaggggaaactcttcttccactataaccccaaactctgcttgtcagaaatccacaagatggaagaagtttcaggaaccaaggggcgccaggagagaaacgacattgccctgaagaccaatggggaccaggcatcctgtaagtcactggtccccaacctttttggcatgagggaccggtgtagtggaagatggtttttccatggactggtggtgggtggggatggtttcagcatgattcaagtgcattacatttactatgcactttattcctattatgattacattgtaatatataatgaaagaattgtacaactcaccatcatgtagaatcaatgggaaccctgagcttgtgttcctgcaactagatggtcccagctgggggtgatgggagacagtgacagatcatcaggcattagattttcataaggagtgtgcagtctaggtacctcatgtacacagttcacaatagggttcacacccctgtgagaatctaatgccgccgctaatctgacaggaggcagaactcaggtggtcatgcaagcgatggggagtgactgtaaatacagatgaagcttcacttgctcacctatcactcacctcctgctgtacagccctgttcgtaacaggccatggataagtactggtctgtggcccaggggctggggacccctgctgtaagtggtccacaaaccagataatgtggctgtcctctctcatccatcacagtcacccccagggggtattacttccctctaacaactcactgtgtgataggctttcttactgagggcagattctgcacatttattaatattatcactatgcttactgtgccatatagtaccggatacgggatgaagtcatacaagcactgaatgaatggatgaatgaatgatggatgaatggatgacaccttcttatatgtgtatcaggctgatgctgaagacttcaaagttgagtaaaatacctatgtcagtctgcatctcctgggaagtgactgccaagttgaagttaggagtgcagaaaatgtattgagggtaatattcataaaatatgaaacagaggaagagcttcttttttttttttttttttttttgggacagagtcttgctctgtcacccagggctggagtgcagtggcgtgatcttgcctcactgcaacctccttcccctgggttcaggtaattatctcgcctcagcctccagaatagctgggattacaggcacatgccaccaagcccggctaatttttttttttgtatttttagtagagacagggttttgccatgttggccagggtggtcttgaactcctgacctcaggtgatcctcccgcctcggcctcccaaagtgctgagattacaggtgtgagtcaccacgctcagccatgaagagccttttgacaatagcgtgtgtctgacctctgtgaacagagagcgggaaggagggaggatagggctgggagagtctcagatggtgatgcatccctgagtcttggccaaacccagaaagagatcaaggccacggttgtctgcagggaagttctgcattgcaaagggacggccaggcatctaccaagctcagtcataggtgggggctgtccagggagagtcaggttttggctggaatgctacagcaggtcctgcagtttctgcagctgcaggctgcctgctgactgcacttccctgacagattctaaacagtgagctgccaagggcttctgggataccttcatggggagttagttacttatgtcaaaatgtagtgcaagggctgggcatggtggctcacgcctggaatcccagcactctgggaggccgaggcaggcagatcacttgaggtcaggagttcgagaccagcctggccaatgtggtgaaactccatctctactaaaaaaaaaaaatacaaaaactagctggacgtggtggtgggtgcctgtaatcccagctacttgagaggctgaggcatgagaattgcttaaacccggtaggtggactgcactccagccttggtgacagagcaagactgtctcaaaaaaaatgtagtgcaaggagagagagcgaggttggggtgaggtttaggagagggtttgtcttctaggcagagagaattacttagatgcgtctctccgatgtctaatgatctgcagggtctctaaactcacttggcataggtttatttgcactggagttgcacctccttccaggtcagtcttacaagtccatatgcgagacaacgttgtgtcaggacaaacatcacccttggaaatcccttcctccaataactattggccggttgtccttcttgcgcgggtacagactgcgcttattcagttgactgtctggctgagtcaagtcattggcttacgtgagtgtgagtggccaagttgcaaaactggctcttacctttgaatcttcccccattcatactcagccaggcacatggggaggagacccttaagggaatagcagcgtcacctctgccttctcacggtccctccaggaagtgtgggggtcccaggctttggtctgaaactacactgaaatagctcatttttgccttttgttttaacttttccaggtgaaaatgagttacttaaattttcttacattcggacatcttttgacaagatcttgctgagatgggagccgtactggccccccgacttccgagacctcttggggttcatgctgttctacaaagaggcgtaagtagaagagttagagagacgctgaggaggcgagggctggctggctctgtgcttgctacgtttgtgctccaatctgcccctcttgggttcctgtctatctccctcctcctcctggaataaatatcttaggttcctttttacaatctcaccagtcgatggcatgcaaagtcaatagtgtctgcttttatcaaatgcctaaaatggaagcagacagctttcccatagaagcccggactggccagtttcctggggcaatattctattttgccttgcctgtgtatgtctcatcagacatccttagtagtcaggagctcagtctactaagtggatgttatcaaatgtattgcttatctatttttcttttttatccccaattttttttttttttttgagacagagtcttgctctgttgcccagggtacagtgcagtggcagatcttggctcactgcaacctctgcctcccgggttcaagcagttctcctgcctcagtctcttgagtagctgagattatgggcatacaccatcacacgtagctaatttgtgtatttttgatagagacgggttttgccatgttggccaggctggtctcaaactcctgacctcaggtgatctgcccaccttggcctcccaaagtgctgggattacaggcatgagccaccgcacctgaccagtagtaatattaataatagttctagccctcaagatttaccttgtgccttgctgagcactgacacacagtctaatcttatcagtaacttgtgagggagctcctgctattactattattacagattgagtatccctaatctgaaaatctgaaatttataatgctccaaaatccaaagctttttgtgggccgacttgatactcaaaggagatgcttattggagcatttcagatttcagatttttagattagagatgctgaaccagtacaatgcaaattaactagtaaaatgcaaatatttcaaaaccccaaaatatccaaaatccaaaacacttctggtcccaagcatttatttatttatttatttatttatgtttttgaaacagagtctccctttgtcgcccaggctggagtgcagtggtgcgatctcagctgatgctacctctgcctcccgggttcaagcaattctcctgcctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgtggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaattcgtatgtgaatcagacctcttgcttttaataggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggactggagtgcaatggcatgatctcggctcactgcaacctccgcctcccaggttcaagtaattctcccacctcagcctcctgagtagctgggactacaggcatgcaccactatacccagctaatttttgtatttcttgtagagacagaacgttgctgtgttacccaggctggtcttgaacccctggcctcaagtgatcctcctgcctcggcctcccaaagtcctgggattagaagtgtgagccaccttgcccagtcagttattggcttttaaaggagctgggtattgaggcttatagtttcagacgaggcagtagcaacaagccacttgatgggaatatttatatttttcatcctattatgaaaaattgtcaaatattcacaacacagaacaaaaccccatagttagccgcctcccagcttcagcctttggtcatttttgtttcatctcgacgcctgttccctcttcccacttgttacttctttttgttttgttgtttgttttggcctggagtatttcacagcaatttaattatgtttgtttgtttgagatggagtctcactctgtcacccaggctggagtgcagtggcgccatctggactcactgcaacctccacctcccaggttcaagtgattctcctgcctcagcctcccaagttgctgggattacagcacacttggctaatttttgttttgttttgttttgttttttgagacagagtctcactctgtcactgaggctggagtgcagtggtgtgatctcagctcactgtaacctccccgtcccagttcaagtgattctcctgcctcagtctcccaagtagctgcaactacaggcgtgccaccacgcccagctaatttttgtatttttagtagagatgggatttcaccatgttggccaggatggtctcaatctcttgacctgcaatctgcccaccttggcctcccaaagtgctgggattacaggcataagccaccatgccagccttttttttttttttttttttttttgagatggagtttcgctcttgttgcctaggctggagtgcaatggccctatctcagctcactgcaacctctgcctcccgggttcaagcgattctcctgcctcagcctcccgagtaactgggattacatgcatgcaccaccacgattggcgaattttttttttttttttttttttgtagagacaaggtttctccatgttggtcaggctggtctcgaactccgagcctcaggtgatccgcctgcctcggcttcccaaagtgctgggattacaggcatgagccaccgcgcccagccatttttgtatttttaatagagatggggcttcaccatgttggccaggctgctctggaactcctgacctcaaatgatccgcccaccttggcctcccaaagtgctgggattacaggcatgagccactgggcccggcctaattatatttttgtaaaacctaagtgcttctcttatagcagtagttcccaaaggaggttaactgctctgccagggaacagctgccaatcaatgtctggagacatttttggttgttacagctgtggagatgaaaccactggcatttcgtgggcggaagccagagaggctgttccatgtcctgcaacacacaggatgcaccctccttcatgacaaagaattatccagtcctaaaagccaatagtactaagggtgagaaaccccgtcctgtaggctcaaattcaagcttttttttttttttttttttttttaacggagtttcactcttgtctctcaggctggagttcaatggcgcattctcagctcactgcaacctctgcccaggttcaagattctcctgcctcagcctcccaggaagctgagattacaggcgcccaccaccatgtccagctaattttttttttttttttttttttttagtagagatagggtttcaccatgttggccaggtgtagtctcgaactcctgatctcaggtgattcagatgattcgcccacctcggccttctaaagtgctgggattacaggcatgagccactgtgcctggcctcgaattcaaactttataaatcaaccctatcttcttcagttaatccccgctcattcatcctgtatcttttagtgacaccaaaagacttacagttttcagaaacttctagctcccaggtgtttggactccctccccatccccagctccctcggccacctccgttactttgggttttttgggttttgtttggttggttggtggtggttttttttttcttttttgttttgttttgttttgagacggactcttgctctgtcacccaggctggagtgcagtggcgcaatctcggctcactgcaagctccgcctcccaggttcacgccattctcctgcctcagcctcccaagtagctgggactacaggcgcccaccaccacacctggctaattttttgtatttttagtagagacggggtttcactgtgttaaccaggatggtctcgatctcctgacctcgtgatccgcctgccttggccgcccaaaatgctgggatgggtgccctcatgatgtctttaacttgtgtgtcccccgccatcctcccaccagctttctttgcacactgtttctcatgatggacccatttcctttctccctgacagacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaaggtgagtgcaggcagctgtgctaggatcggtggggtttgcacacgtgtgtctgatgcactttgcttcacctctagggaagcagctatctcttcctgtgtctcagtgtcggaaggcacacacacacacactccattctatctcatatgaaaacacacatacatgtttttatctatttatttatttattttattttttatttatttacttttttgagatggagtttcactcttgttgcccaggctggagtgcaatgacgcgaccttggctcatcgcaacctccacctctcgggttcaagtgattctcctgcatcagcctcccgagtagctgggattacaggcacgcgccaccacgcccggctaatttggtatttttagtagggacggggtttctccatgttggtcagcctggtctcaaactcccgacctcaggtgacctcaggtgatccacccaccttggcctcccaaagtgctgggattacaggcatgagccaccacacccggcctattttttttttttttttgagacagggtcttactctgttgcccaggctggagtgcagtggcatgatctctgctcactgcaacctccacctcccaggctcaagcaatcctcttgcctcagcctcatgagttgctggaacaccacaattgtctgcaggtgtgcaccagcatgcccaggtaatttttttttttttttttttttttgagacagggtctcactctgtcacccaggctggagtgcagtggcatgatctcggctcattgcaacttctgcctcccaggcgcaagcgattctcctgcctcaggctcctgagtagctgggactacaggcgcctgccaccacacccggctaatttttgtatttttagtagagatggggtttcaccatgttggccaggctggtcttgaactcctgacctcaaatgatccacccgcctcggcctcccaaagtgctgtgattacaggcatgagccaccacgcctggccctggctaatttttaaacttctttttgtagagatggagtctccttatattgcccaggctggtctcaaactcctggcttcaagcaattcacccccctcagcctcccaaagcgctgggattacaggcgtgagccactatgaccggctcatacatacacatttttaaacatcgtaacacaagcacgcactgaagacttgtgtcaaaaccagatttttcccatgtcttggcaccatttccctctgggattttctcctcttgtctctccttctttctccctccctgccttccttgttctcttcatccctcctcacactgatggggatgcagctgtgttaacccacgcaagacttctgtgcaaagctagaaacacaactaatggttattgacaaagtcagggaaggattttggccccactgagatcctttagttgtaaggatcgaaggcagcaagaattggttatctcatatcccccaccccatactttcaattaaaaatgtctgccaggcttggcgctcatgcctgtaatcccagcacattgggaggccaaggtgggaggatcactggaggccgggagtttgagaccagcctgggcaacatagcaagatcccatctctaaaaaaatttaaaaaaatggtggtgtacacctgtagtcccagttacttgggaggcccaggcgggaggatctcttgagcccaggagttcaagtctgcagtgagctatgattattccagtgcactccagcctgggtgacagagcgagaccctgtctctatatatataaaaaaaattatacaaaattaaaaaaaaaaggcattaagtgcattcacaatgttgtgcaatcattttattgtataaaaattataaataaaatttataaataattatataaataattttattataaaacttaatgacaaatttttcttaatcttgtttacttaatagacctccatccatctgaaggaaaatggaataatatttaaagtctcaaactagtgtgtatacattagtttaaaattattattattattattttctttttttttttttttgacacggagtctcactccgtcacccaggctggagtgcagtggcttgatcttggctcactgcaacctccgcctgctgggttcaagcgattcttgtgccttagcctcctgaatagctgggattacaggtgctgccactacaccggctaatttttgtatttttagtagagacggggtttcaccatgttggccagggtggtcttgaattcctgacctcaaatgatccacccgtctcagcctcccaaagtgctgggattacaggcgtgagccaccgcgcccagcctaaaattattttaacattgggtttttttagaacccaccaaactggagaagcatctgtcacttttttctttttctttttcttcttcttttttaagatggggtctcactctgttgtccaggctggagtgcagtggcacaatcatagctcactgcaggcttgaactcctgggctcaaacgatcttcccgcctcagcctcctgagtagctggactacacaggactacaggcctgagacactatacctggctaattatttaaaataattttttaggccgggcacagtggctcatgcctgtaatcccagcactttgggaggccgaggcgggtggatcaccaggggtcaggagtttgagaccaccctggccaatatggcaaaaccccgtctctactcaaaatacaaaaattagccaggcgtgggcctgtaatcccagctactcaggaggctgaggcagaagaatcgcttgaacccgggaggtggaggttgcaatgagccgagcttgcaccattgcactccagcctgggtaacaaaagcaaaactccatctaagaaaaataataataataaaaataataataattttttagaggtggggatcttgatatgttgcccagggtggtctcgaactcctgaccacaagcgatcctcctgcctcagcctcccaaagtgctggtattacagacctgagccactgcgctgggcccatttccttctttagttttggtttccttgtgcatcttgatgtatttttcttgagatattttctgttagtgatatcctcggtccatgaccctggaggagaaggccagggggccactggcgaggtgtggctgaggccaggagctcaacatttgctcttggctctggccctgacctgctgaagggctttggctaagttcccaagcaagtcaccgtctgcctcctttttgggagaaggggcgggaggacagatgatctctgggagctgtcccagctctaagctcatatgctatatgtatgtgtgtgacatcatccccgcctgagccgagggttgcaaacgtgatttatctgctctgatgctttatataactccagggcgagtccagtcatcagctccgctgtaagctgttggccctgcattcaagtaaccagaaccacccgtgagagctgccaccagtaatgtcactcgaagcttccttttttttttttttaattccgaaagtctaaatctgtaattaccaagggaccatttaaacatggttttatttgtaattgtcacaaagttaatatcattaaaaggaaactcactaaggacaaattctgtgtgatttcactcctaggaggtccctagagtcctcagattcatagagacagaaagtagaatggggagtgccagggactgcggaggggacgggttgaggacagagtttcagtttgggaagatgagaaagttccggagatgatggtggtgatgattgcacaacattgtgaatgcacttaataccacagaactgcacacttaaaatggttgagatttaccgggcacagtggctcacgcctgtaatcccagcacactgggaggccgaggtggggtggatcactttgaggccaggagttcgagaccagcctgggcaacatggtgaaaccccgtctctactaaaaatacaaaaattagttgggtgtggtggtgggtgcctgtaatcccagctactcaggaggctgaggcaggagaatcgcttgaatctgggaggcagaggttgcagtgagccgagatcacgccattgcactccagcctggcaacagagcaagactccaccaaaaacaaaacaaaacaaaaattgagatggtaaattggtatattttatgtgatgcttatttttccacaatttcaaacacacacacacacaaataaataagcttacaaacccttcctgttaatatcactagtgtatatgttgttaccacggtaaaatatacatcacatacaatttattattataaccatgtttaagagcacagttgagctgcattaagtgcattgccgtggttgtgcggccattaccaccatcatctccagaactttctcatcttctcaaactgaaactctgtccccatgaaacactcactccccttctccttcccccagccccagcacccaccatcctcctttctgtctctgtgaatctgattctagagacttcattatgctcatttttcttttcttttctttttatttttttgagacggagtctcgctctgtcacccaggctggagttcagtggcgtgatctcggctcactgcaagctccgcctcccgggttcacgccattctcctgcgtcagcctcccgagtagctgggactacaggcgcccgccaccacgcccggctaattttttgtattttttagtagagacggggtttcaccatgttagccaggatggtctcgatctcctgacctcgtgatctgcccaccttggcctcccaacgtgctgggattacaggcgtgagtcaccgcgcctggcccattatgcttcatttttctaatctcaggaaaaccacagtgtaccatgtttcatgcagtggattctaggaagaggtagcaggtatcaggaatgatacctgtgcctgaacaaatatcccttcctctccaaataataataataataataataataataataataataataataataccaggagcttcccttattcaggcagttctacatttttttttccatctgtaatgctgtaactagctcccatcagagttaacccaggcagggtattctatgtctatttataaacttaagaagtattttccagtctctcataggcttttaaagctgtgtaaatacttgggtttccgagtggatactcaccattcacaggaaggtacttgatacacgatttagagcttattgtctatcctcgaggcattaaggggaggagagaaaatggaatttcctttgctcagcagtcaccaggcaccaagcagagtggcagcaggggaggtggctctccagggactgttgcagattttgcttgtaaagagctgtgtccgtccatctcagtggctgtaccagaggcataactgtgcttgcaccgtgggtcacaagaaccctgggatttgacttcggggcttaagacatgaccagctgcggtacttaagtattgtaggctgggtgcgatggctcatgcctgtaatcccagcactttgggaggccaaggcgggcagatcgttcgagctcaggagtttgagatcagcctggccaacacagcaaaactctgtctctaccaaaaaaaaaaaaaaaaaatacaaaaatcggctgggcgcagtggctcacgcctgtaatcccagcactttgggaggccaaggcgggtggatcacctgaggtcgggagatcaagaccagcctggccaacatggcaaaaccccgtctctaataaaaatacaaaaaaaatgccaggcgcagtggctcaagcctataatcccagcactttgggaggctgaggcgggtggaccacctgaggtcaggagttcagaccagcctggccaacatggccaaaccccgtctctactaaaaatacaaaattagccgggcatggtggtgcacgcctgtagtcccagctacttgggaggctgaggcaggagaatggcgtgaacccgggaggcagagcttgcagtgagccgagatagcgccactgcagtccggcctgggcaacaagagcgagactccatcccaaaaaaacaaaaacaaaaaacaaacaaacaaacaaaaaattagccaggtgtgatggtgcatgcctgtaatcccagttacggggagtggagctgagacaggagaatcgcttgaacccaggaggcagaggttgcagtgagccaagattgcgccactgcactgcagcctgggcgacagagcaagaccccatctcaaaaaaaaaaaaaaaaaaaaaaaagagagaaatagtattgtattttgtatttttaggactgctacctttataagctactggtgttcttcttcatttattaatttttaaattcccttttctatgcatgtttgaaaagttccttcctctatctcctctcatgcctttaggtcagggtttctctgtcttggtgttttttctgtctggcgttggatcattctctggggtgggactgtcccgagcacttcagggtgctcagcagcatctctggtcttcacccattccatgctccaggaggacgccccagccaggtcctgacacctaaaaatatctccagatgttgcccaatgtccctagtaggagacaaaatcaccccctgggtgagaaccattcactgatcaagtctgatttctggactcatgaatggaccccttagaattccatgtggaggcccagtgtggtgacccaggcctgtaattccagcactttgggaggccgaggtgggcagatcacatgaggtcaggagttccagaccagcctggccaacatgatgaaactctgtctctgctaaaaatacaaaacattagccagggtggtggcaggcgcctgtaatcccagctacttgagaggctgaggcaggagactcacttgaatccaggaggcggaggctgcagtgagccaagatcacgccactgcactccagcctgggcgacagagcaagactgtctcaaaaaaaaaaaaaaaaaaaaaaaaaaaagaattccatatggcattctactctgccctcccatcttatttgtgtggttgattaattgattgattgatattttcatgcagctgtgacctggctccttctcctcctccttcttctccttcttctttctttttcttcttcttcaacatgatttcactctgttgcccaggctggagtgcagtggccccatctcagctcactgcagcctcgacttcccaggctcaagcaatcctcctacctcagcctcctgagtagctgggattacaggcgcacaccaccatgcctggctaatttttgtattttttggtagagacggagtttcatcttgttggccaggcttatcttgaactcctgggctcaagtgatccttccccctcagcctcccaaagttctggtattacaggcaagagccactgtacctggccccctttatctttttctaaccccctcccaccattctctctctcacccccttccagctatattggtttccagagatttttttttttttttttgagagatggaatgcttcctctgtcacccaggctggagtgcagtggcgcaatcttggctcaatgcaacctccgccttccaggttcaagtgattctcctgcctcagcctcccaagtagctgggactacaggcatgtgccaccacgtgcagctgatttttggattttttagtagagacagcgtttcactatatgttggccaggctggtctcgaactcctgacctcaagtgatcctcctgcctcggcttcccaaagtgctgggattacaggagagggccaccacgcctggccagacgttttttaatgtgccaagaaaattcctgtcctggggcctttctgctgggtttctgctatgtctgaattgctttacaccacgatatgtggatggtgctttcctttgctgaattcaggatgtctcagtggtgactttctttgagaccccttcatgaaaatggcacccgcagacacccactgttcttttaccccaacatctgacctgtgactgtgtatttatgagtttattgtagactgtaagtccactgaagacagaagcattgtctggttaccttataatcttcagtcctgtgattatggtgtcgggcagttgttgcctttttttgagacagagtctcgctgttgtcgcctaggctggagtgcaatggctcaatctcggctcactgcaacctctgcttcccgggttcaaacaatcctcctgcctcagcctcctgagtagctgggattacaggcacccaccaccacgcccggctaacttttgtattttgagtagagacggggtttcgccatgttggctaggatggtccggacctcctgacctcaggtgatctgcccgcctcggcctcccaaagtgctgggattacaggagtgagccaccgcgcccagccacctggcagtttctattaggttggtgcaaaagtaattgtgggccgggtgcagtggctcacgcctgtaatcccagcactttgggaggccaaggcgggcagatcacgaggtcaggagatcgagaccatcctggctaacacaatgaaaccccatctctactaaaaatacaacaaattagccgggcgtggcagcggccgcctgtagtcccagctactcaggaggctgaggcaggagaatgccatgaacccaagcggtggagcttgcagtgagccaagatcgcgccactgcactccagcctgggtaacagaacgagactccatctcaaaaaaaaaaaaaaaaaaaagtaattgtggttttttgccattacttttaatagcaaaagctgcaattacttatgcactaaactaataaaacatgttgacatgcacttctcagatgacactctagatacagatattttatttatttatttattatttttttgagacggagtctcgctctgtcacccaggctggagtgcagtggtgccatctcagctcactgcaacctccacctcccaggttcaagcgattctcctgcctcgacctcctgagtagctgggattacaggcatgcgccactacacctggctaatttttgtatttttagtaaagacggggtttcaccatgttggccaggctggtctcgaactcctgacctcaggtggtctgcctacctcagcctcccaaagtgctgggattacaggtgtgagctgcctggcctatttttattggttattttactttatttttagtagagacagggtttcaccacattgcccaggctggtcttgaactcctgggctcacgtgatcctcacacctcggcctccgaaagtgccaggattaagggtgtgagccactgtgctcggctatatttttaatcttttgagacagggttctactctgtcacccaggctgaagtgtaggggtgcaatcatagctcactgcagcctcgaactcctgggctcaagcgatcctctcacctgagcctcccaagtagctgggaccacaggcgtgaaccatagtgtctggcttttttccaaagcggagctcaaatctaggctctgtctcagctcagcctctctgagaaggcccccttcactgtgtgtgtgtgtggtgcgtgtgtggtgtgtgtgtggtgtgtggcgtgggtgtggtggtgtgtgtgatttgtgtggtgtgtggtgtgtgtgaagtgtgtatgtggtgtgtgtgtggtgcgtgtatggtgtgtgtggggtgtgtggtgtgtggtctgtggtgtgtggcgtgggtgtgtgtggtgtgtgtgtgatttgtgtggtgtgtgtgcggtgtgtggtgtggtgtgtgaggtgtgcatgtagtgtgtgtgtggtgcgtgtatggtgtgtgtgtggtgcgtgtgtgtggtgtgtggtgtgtgtggtgtgtgtgtggttgtgtgtttgtggtgtgtgtatgtgtggtgtgttgtgtggtgtgtgtggtgtgtggtgtgtgtgtgtggttgtgtgtttgtggtgtgtgtatgtgtggtgtgttgtgtgatgtgtgtggtgtgtgtgtgtgggggggtgtgtggtgtgtgtgtgtgtggtgtgtgtgtgtggtgtgtgtgtgtgtggggtgtgtgtgtgtgtgtatgtgtgttcagccgcagagacttgagccccccttttctgtttctttctccagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccaggtcaggacttggcgctgggctctcttagtgggtgccaattggcttggtgttggtggaaggtcattacttagggaccgagaggtagtgggacccagagacggcagaagggtgggtggagtctgaatggagccctttcctgggtggaggaagagatcttgcagtttcgaaatttcgaggggaattttatcaggaagagcaaataatcgcacaaaaggggaaaaatggacaaaactcagcatttgcctttcttacctctcctgagctggtctccacgtgagttccaaaacaaactccgttagacgattaacatttttttttttctctctctctcttttttttttttttttgacagagtctcactctatcgtccaggctggagtgcggtggtgcgatttcagctcaccctttccgggttcgagtgattcttgtgcctcagcctcccaagtagctgggactacaggtgcgcagcaccacgcccagctaatttttatatttttagtagagacggggttttgccatgttggctaggctggtctctaacccctgacctcaggtgatctgcctgcctcggcctcccagagtgctgggattataggtgtgagccaccgtgcctggccgtgattattgaggctttagctgagcgcagtggtgtaagcctgtggtcccagctagttgggaagccgaggtggtagggttgcttgaggccagcctgggcaacataatgagaccccatcgctaccaaaaaaaaaaaaaaacagtttaaaaattagtcaggcatggtaatgcatgtctgaactcctagcccatggggaggctgagaaagaaggatcacaagaggccaggagatggaggctacgataagcgatgatggcgccactgcgctccagcctgggtgacagagtgagaccctgtctctaaaaaaaaattaaaagtatctgttcagatgtttaccaatgctattcatccgagcagacttttctcccagaaccaccagtgtgtaagaatcctcttttttttttttcttttctttttctttttttgttgcatgtttcccctatgaccctgagtccaaaagaatgttcagggggacagccaaggcttcaaagtggttactgtttcacctgttacaaacaaaatgttggctaggcacagtggctcactcgtgtaatcccagcactttgggaggccgaagtgggagaatcagttgaggccaaaggtggagaccagcctgagcaacagagtgagaccctatctctactaaaaaaggaaaaaaaaaaaaaaaatagccagacatgttggtgcatgccttgtagtcccagctactccggaggctgaggcgggagaattgctggagcacaggagttggaggctgctgtgagctatgatggcaccattgcactccagcctgggcaacagagcaagaccctgtctcaaaaaggaaggaagggaaaaaaagaaagaaagaaaggaatggagggagggagggaaagaggaaggaaggaagagagaaagaaaaagaaagaaagaaagaaagaaagaaagaaagaaagaaagaaagaaagagaaagaaagaaaggaaagagagaaagaaaggacagagaaaggaagggggcaagggagggagagaggagggaaggaaggaaggaaaaaaggaaaagaaagaaaagaaagagaaagaaaatgaaaaaaagaaggaaggaaagagaaagaaagcaaatgaaggaaggaaagagggaaaaagagagaaagaaagtaaaagaggaaagaaggaaggaaggagagagagggagagagaaaagagaaagagaaaagaaaaggagaaagaggaaagaaaccagaaagagagagagaaagaagaaagaagggaaagaaaagaaaaattctgccagacttggagaagtggctgagtcagttgtgatgtccacatgtagtcacgtttgacatcccagggccacctcagcaggccgtctctggggagaattttctctgatttcttccccttcccttgctggacccctgcacctgctggggaagatgtagctcactccgtctagcaagtgatgggagcgagtggtccagggtcaaagccagggtgcccttactcggacacatgtggcctccaagtgtcagagcccagtggtctgtctaatgaagttccctctgtcctcaaaggcgttggttttgtttccacagaaaaacctcttcaggcactggtgccgaggaccctaggtatgactcacctgtgcgacccctggtgcctgctccgcgcagggccggcggcgtgccaggcagatgcctcggagaacccaggggtttctgtggctttttgcatgcggcgggcagctgtgctggagagcagatgcttcaccaattcagaaatccaatgccttcactctgaaatgaaatctgggcatgaatgtggggagaaaccttcactaacacactcttgctaaaacatagaatcatgggagtgcttcctgggtaccccctccctgccttctgtttgcagccactgtttgctcactaaacatctctgcacctcccgcgtgcatttgcagaggtgggtgggggtccccggagtctgagctccccgcggctgggtgccccgacccagcagctcctacaccatgaatggaggttgatctggaaacagaatattttcatgaaagggcgacagggtatgaacaaaagaacaccgtgtcgctcactgaattccacggaggagagtcagggatctcttccttccttccttccttccttccttccttccttccttccttccttccttctttctttttttccttctttctttctttccttctttcttttcttttctttattccctccctctctccctccgtccgtccctccctcccttccttctttccttcttcttttttttttggatggaatttcactcttgttgcccaggctagagtgcagtggtgcgatctcggctctccacaacctccacctcccgggttcaagcaattctcctgcctcagcctcctgagtagctgggattacaggcatgcgccaccacgcccggctaatttttgtacttttagtagagacagggtttctccatgttggtcaggctggtctcgatctcccgacctcaggcgatccgcccgcctcggcctcccaaagtgctggaattacaggcgtgagccaccgcccctggccagggacgtttcttttcaacttgagtcttaagagaatgaagcagtatggtcctgggagagagaaaaagcttggagaacttgggagaaaggcaaggagatgtttacctgtcgtggcttttgggaggaacaggaggtgagactaaagaggcaagttgggaccacttggagagattttcttcctttagcagagtgtttatttatttattttttcccaggcacctgtgtggcctgatctgccctctagtggccatttgcaatactaactgtagccaagaagggtctaaaaatgtacgggcttggtccaaagcagatctcaatctcagtcctgctattaataatattcgggtggctcacgcctgtaatcccagcactttgggaggccgaggcgggcggatcatgagatcagaagatcgagaccatcctggctaacacggtgaaaccccgtcactactaaaaatacaagaaattagctgggcgtggtgacgcagctaccccaggcggggcaatcacttgaggccaggagttcgagaccagcctgaccaagatggtgaaaccccgttactacaagaaacataaaaattagccgggcgtggtgacacacgcctgtagtcccagctactcgggaggctgaggcaggagaatggcgtgaacctgggacgcggagcttgcagtgagccaagatcgtgccactgcactccagcctgggccacagagcgagactccgtctcaaaaaaaataaaaataaaataatatttggggccacagctggacttggtagctcacgcctgtaatcccaacactttgagaggcccaggcggggcaatcacttgaggccaggagttcgagaccagcctgaccaagatggtgaaaccccgttactacaagaaatataaaaattagccgggcatggtgacacacgcctgtagtcccagctacttgggaggccgaggcaggagaatcacttgatttctggaggcggaggttgcggtgagccgagatctcgccactgcattccagcctgggtgacagagcgagactctgtctcaaaaaaaaaaaaaaaaaagaataaatacataatactaataataataataaataatatttggggtcagattattctagggcactgtccaacaacactgagaagcatccctggcttccactcatctgatgccagtagtgtgtcttccccctaaagtagtaataaccaaaaatatcttcagacattgctaaatatccccctgggtgatggggtcagaaggacccttggttgagatgaccaggttagtgtgggattgctggataataaaatgctgcctaggccaggtgctgtggctcatgcctgatgcctgtaatcccagcactttgggaggcccaggcaggcagatcacctgaggtcaagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccagaaattggaagttacagtgagccaagatcacaccactgcactccagcctgggcaacagagcaagactctgtctcaaaaaaaaaaatcagttgatgctttgtcttttgccacttcatggtctttttggttataatctttttggtatataaactcatttggcctgtttgatgagcccattttacatctctggttgttgagataccaatttctcagtagttactcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcacttcttggtggttaaaagttaaacacttacaggctgggcgcagtgactcacacctgtaatcgcagcactttgggaggcccaggcaggcggatcacctgaggtcaggagtttgagaccagcctggccaatatggtgaaaccccttctctactaaaaatacaaaaattagccagatgtggtaacgtgcgcctgtagtcccagctactcaggagactgaggcagaagaatcacttgaacctgggaggtggaggttgcagtgagccgagatcacgccactgccctccagcctgggcaacagagcgagactctgtctaaaaaaaaaaaaagttaaaaagttaaacacttacatatctatcgggccaaagcagaaatggaaacttccattgaagtccttttggaaaataatgaaaatgtgaatatcacataccttaacttgtagaatattgtcaaagcttggctttgatgttacttagcagacttaaatggattgataaattaagaaataaactttaaactataaaactataaatgtgttaggaagggaaaagcaataacagctaagcctatggtaaacataatcaaagggaaaacacaaaccagaaggaaagaagatgacataaaactagcgtctgaagaaaattttaatgtgttaagttctttggacaatggtgcacttgctaaatttgaaagtttcagtaaggtgggaaaatttaacttgtctaaatggattcaaaaagaagcagaaaaattaagtggttatgaaccttggaaaaagatatgtgtcaaataatttcctcaaaaaagtcccttggcccagagagttttatagacacgttctttcaaattgtgagagagcaactatttcctataatagaaaaactattttagggcacagaaatctataaaagttatcccagttcattttatgaaatgaacataacacccttaaagaacttgacaaagaggttgagcatggtggctcatgcctgtaatcccagtactttgggaggctgaggtggggggcggatcacaaggtcaagagattgagaacattctggtcaacatggtgaaacactgtctctactaacaatacaaaaattagccagacatggtggcacacgcctgtaatcccagctacttgggaggctgagccaggagaatcgcttgaacctgggaggcagaggttgcagtgaaccgaggttgcgccattgcacactccagcctggcaacagagcaaaactctgtctcaaaaaaaaaaaaaaaaaaaaaagaacttgacaaagatactgcactgaacaaaagccacaggccaagctaatatgtgatgttagattcaaatgtcccaaataaaacactgcactggcaatattgtttatctccaaaatgcaaggatggtttaagatcagaagatttgataacatcatctagttcatcaagaggtgcaataaggaagatcatatctgtttcaataaccttaatttaaaattcctaacttagagaaaggggaggaaaaaaagaggcttcataaaactcataatagaatatttcttctacaagataaatattacctaggttaaaccaacagccaagctaacatcattcttaaaattattcttagcagagttaggaacaaaacaaggaagccccatctcatcattactaattaacatttctctgggcatccagccaatgtaataagacaagaaacagaaatcagagttgtaaagaatggaatgtgggaaataaagtcattgctatttgcagagcgtctagctcaagggtaggcaaactatggcccatgggctagctgcctgtttttgtaaatgaactcttattggaatgcaaccccacccacttgtttacacatcatgtagggctgctttaagctacaatgacagagtagttgtgacagaggtcatttggcttgcaaaacccaaaatatttattatctagccctttacgggaaaattttgttgacccctcttctagtgtgtcattgaaaacccaggaaagccaattatgaaactttttaaatgagttagagtttgggaaagtaggtacatagaaataagcaaaaagactgtagatacacaagcaataattagaatataaaataagggaaaagatccctttcaaaattgccgtaaaaccttagcacaactcataataaccccatctagaatgacttataaaggaacacgttttaaagtgttactgatatattaaattgtacaaataaacatgaaagcctgtttcaaatcatttaaagaaagcttactggcaaatggaaaagagtaagttgtatagcacgatacataaaaggttaatatccttaatgaataaacaacacaggagtaaggaaaacacaagaaattcatggaaaaacagacaaaagacaaggaggggacaattctttggagaatcacagagaaccaataaaggaaaaatgaagtcacactcagtaatataaagatccgcaaataacgtagtcgagtgatagcatatttttaatctcttgggttaaagatctagacaaacaaacatagaaagaaaaaaaaaaactattaaggcttaggggttgctgagattgtcctggaatgcagtctcatggcctgctggtgcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagcaaaaaaaaaaaaaaagagccatgtgcggtggctcatgcctgtaatcctggcactttgggaggctgaggtgggcagatcacctgaggtcaggagtttgagaccagcctggccaacatggcgaaactccgtctctactaaaaatacaaaaattagctgggcatggtggcggactcctgtaatcccagctactcaggaggctgaggcaggagaatcgcatgaactcaggaggcggaggttgcagtgagccaagatcacgccgtcgcactccagcctgggcgacaagagtgaaactctgtctcaaaataaataaataaataaggaggatggttaagtgagtgacgactcacgtagcaaatggaatattttacagtcattcatcgttttccaagttttctgcagggaacacatgctacttttgtagatgatggaggaaaaccctaatattaaaaaggaaaagtcccaaaattctctcctaaaatgttatgttgaaaggaaaatatttagtaaatgcttccaatataataagtagacaaagtttacttataaaacaggcttgatcctcatcatgttcacacataatatttacagggaaaaaattgtccaaaggaagcagtgggctgtggatttatgagtgatttatattttcttttcttttttttttttttgagacagagtctcactctgtcgcccaggctggagtgcagtgacacgatctcagctcactgcaacctccgcctcccgggttcaagcaattctcttgcctcagcctcctgagtagctgggattaaagctgtgcaccatcaggctcggctaatttttgtatttttagtagagacggggtttccccatgttggccagactggtcttgaactcctaacctcaggttatctgcccgccttggcctcccaaagtactgggattataggcatgagccacctcgcccagcctacattttcttctttatccttttttctttgtattttaaaatttgttagctatcaacctttgttgtttaatatgtcttcttaagggatggggagaagtgtgccaattgcatagatgtttcttggagttaatcttcctgacctgagtgatgtgattccttttctaagaattgcagcttaatcactcaaattatacaggtgccctaagcagcaataagaaggaaaagatgtattttttcctatttaaactgatgatgtcgatcagtagcttgggccaatgagcaaatgccatttggcagggcttcctgaaaagctagactcttacgtgcttttggtgtcttatttttgtcactgaccctggctggcctatttatctgcaaaatgaaaaacctgaaatcgagcatgtcgaggggaatatcggtgtgtgtctaccattgacggtcttagaagcactcatccctcacgaggtgggcctgctctaatccttcagatgctcacaagggtatattgaaagctgctctgagtggtcattcctggcagtctgtattgtaatccatgttccccattgctgcaccctcctgcgctctgatctttcttcttaatcaagccttttattctccagtgtcacttttttaaaaaaaatgatggtgatggtgtcatcatacatgtcctactgtcgttccaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaaggtagggctgctgctccggggtccgagtgtcatgggtgggacatcaaggctgaccaaggacagattctccaccctctaagcagtgcatatctgtattttaccttattggccttcatttttgtttgagacggagccttgctctgtcgcccaggctggagtacagtggtgcgacctcagctcactccagcctctgccacctatgtcaagtgattccctgcttcagcctcccaagtagctgggactacaggtgtctgccaccacgcccagctaatttttgtatttttagtagagatggggtttcaccatattgcccaggctggtcttgaactcctgggctcaagtgatccacccacatcggcctctcaaagtgctgggattacaggcatgagcaccgaacctggccttttttttttttttttttttttttgagatgaagtcttgctctgtcgcccaggctggagtacaatggcgcaatcttggctcactgcaatctccgcctccctggttcaagcaattctcctgcctcagcctcctgagtagctgggactacatgcgtgtgccaccacacctgtattttcagtagagatggttccaccatgttgcccaggctggtctccaatgcctgagctcaagtggtccgccaaccttgagctcccaaagtgctgggattacaggcatgagccaccatgccaggtcatattttaaaattatgagtcataggcaatcattatgtaaactttagaaaatacaccactgcactcccgcctgggtgacagagcaagactctgtctcaaaaaaaaaaaaaagttatacgcagaaagtaacccatttaatcttcctaacaatcttgtgggatgagttttagatgtccgttctctgacgaggaaaatgggttgtgggaaaatgacgtcaccagcccaaggttgcaccatggacaggtggcagaagtgggatctcatccaagagttacatccctgcctctcacttcctctccttacagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggtaaggcccttgactcttgggcatgcccctgcacacttcagcatgccccttcagagttgcacttggtacctccttcctctgctgaaattttgattccagtgcttctctcatcaggtactgtgctattagtacttaaagccttgatacctgacttcgcaggaagatgggtcagaaatgccaatctaccagcttgttacttttcttagtttctcacattgctttccagctgtgtcctctaagttgaatgatgtctgcctcccaccacaacaggagactcatttcactttagaaggagttatttgagtcttaaaaccttataaattgctgggtacagtggctcacacctgtaatccaagcactttgggaggccgaggcaggcagatcacttgaggccaggagtttgagaccagcctggccaacatggtgaaaccccatctctacaaaaatacaaaaattagccaggcgtggtggtgggtgcctgtaatcccagctactcaggaggccaaggtgggaagctgaggcaggagaatcacttgaagccaggaggtggaggttgcagtgagcagagattgcaccattgcgctccagcctgggtgacagagtgagactctgtctcaaaaacagcaacaacaaaaaccttataagttactttcattagatgcttccattgagccagacaccatgcaaggtgctgggtgagtgcagagatgcacaagacatagaatccaagacaaataacccaaaagaacccaaacagttgctaagctcttcccagggctcactgtatgtcccaaacacattcagcacgttacacagagtatctcattgatcacattttattacctctaggaaattttgagaggccccattatttttatggacagctaggcaaaaaaaaaaaaagggccgttaattctaattttatttttttcgtagaatatagatcctgagtactgttaagtgtttgtaaaatgcattgcttgtaagatgcattccaatttcagaaatgccaaaatgcaaaaataatatacctcttgggactgaggaagtacaatacgtcctcacattatcccagtgagctgggtactgaggcttccagagtttaagttgctgcacaaaacctggaagaatagaatcatgatccaaatgcatgactgatatttcaatccagaaactgccaaattttttttaccataaaggtctggatagtaaacatgtttgactccgtggccagatgatttctgttacaactactcaattccaccattctactgagaaagctgccatgggtgatatgtaaatgaatggatgtggttgtgtaccaataaaactttatttacaaaaacacgtggtggaccaggtttagttggtgggccagagtttgccaacaactaacagagattacagcaaaatgtctgatttcctggaactttgagagggagtcctcctataaccaggtggacctccctctacccctcctgggaccacatctactcttggcaaccaaagattttggctttgacaataatttacaattgagatctaattctaaattattgtggcttgtgggccaaatctggcttgcagagcattgtaaagaatgtgcaacagggttgaggtcaggagttcaagaccagcctggccaacatggcgaaactccgtctctgctaaaaatacagaaattagctggacgtaatggtgggcgcctataatcccagctgctcctcgggatgctgaagcagggagaattgcttgaacccgggacgcaaaggttgcagtgagccaagatcgtgccactgcactccagcctgggcgacagaacaagactctgtctcaaaaaaaaaaaaaaaaaaaagaatacgcaacagagactatatgtggcccttcacagcttcacagaaaaagtaaactttcaaaaatagaaagtgtccttactgaacttgtcattctgggcctattttggggccctgtttgctaaatgaatggcttgatttgccttttttaacattcatttttaaaataaaattgctaaatgaatggcttgatttgccttttttaatattcatttttaaaataaaattccttatcatacagagctcagctagtttttaattggcagaaacgtgcatatgcctctaatccatattcatgagttactttcctctgccttttgatgtctctgtccacaatagcctttggaattatgatttgtagttgctagatagaatttaatctcatgattggggtatcatttatttttggggatttggattgcctctggtttttaccatgttaggtaatactaattttatctggaaaccattttagctttttggattgacagctttagttattgtttcagtcagttcttgctgcgtaacaaactgcccccaaaggtactggtttaaaacaaaggacatttattctttctctcaattctgcaggttcactgggtgattcctttgtcctgggccagtttggctggggctggatggcctcattcacatggctggggcctcagctgggggcacttggagctttgtcctcatgtgttctctcactgcccagtgagctagcccaggcaaggaaggacatgccccatatacaaacacttcttaggactctgtttgcatcacatttgctagtgtccctttggcaaagtgagcccatggctaagcccagaatgaggaagtacaatacatcctctgagtatctcagtgagctggatactgaggcttccagagtctcatagacacagaaagtcatgattccctgggggccataattgcaaagtttattaatatattatcctatatgtattaatcctgtaggtcctaaggaaataattcaaatttggggcagggaacaaagctctatgcataagattttcatcagtagcaaaatatgcaaaccactaagatgtccatccattggagaatggacacatggaagacggtgcatccatagaattggtggatgaagagccattgaaaatgatgtttgggggccaagcatggtggctcatgcctgtaattccagtgactcaggaagctgaggtgggaggattgcttgaggccaggagtttgagcctgggcaacacagccagaccccatctctgcaaaaaaaaaatttcaaaattagctaggtgtggtggtctatgcctgtagtcccatctacttgggaggctgaggagagaattgcttgagctcaggagctccaggttatagtgggctgtgactcactcactacactgcagactgggtgacagagcaagaagactctgtctccaaaaaaataagataaaatgtttgggatgacctttgttcagtgtaatgtagaagttaaaattacatgctctggagtttagttcgtttgtgttgttatcccccagcagttaagaatccccctgtatctgctgggtgcagtggctcacgcctgtaatcccagcactttgggaggctgaggcgggtggatcatgaggtcaggagatcgagaccatcctggctaacacggtgaaaccccgtctctactaaaaatacaaaaaaattagccgggcatggtggcgggcgcctgtagtcccaactacttgggaggctgaggcaggagaatggcgtgaacccaggaggtggagcttgcagtgagccgagatcacgccactgcactccagcctgggcgacagagtgagactccatctcaaaaaaaaaaaaaaagaaaaagaaaaaagaagaaaaaggaatccccctgtatccagactagcttatgatagaggaaaagcttcttagctcccagagttgaacaactgaagagcttctcacatggctggatccaggattcctttgggtcggttgcatcttttttttttttttttttttttttttgagatggagtctcactcactctgtcatcctgtcatccgggctggagtgcagtggtgcagtctcagctcactgcaacctctgcctccctgtttaagcgattctcctgcctcagcctcctgagtagctgggattacaggcacccacgaccacacccagctaatatttgtatttttaatggagacgaggtttcaccatgttggcctggctggtctcgagctcttaacctcaggtaatccacccaccttggcatcccaaagtgctgggattacaggcgtgagccaccatgcctagcctgggtcagttgcatcttaacggctcctggcagtgagcccagtagcccctggttgtccaccggtggttgtagtggttccaaacctcatttctttgcagtgccaaacccagaggaagacagagtgcatcccagcattcccagctagactgaggtcatgtgacatccagtgcccaatcatgtgaccagaggaatgctgtatgctgattggcttgggcatgagggattttttttttttttttaatttagaaacagctttattgagctgtaacttacataccataatattcactcccaccacatgctagagagaattttgtaaatggagtaaaattacactccaacagtataaattgtgcacataaaaataaagttttaggccaggagcagtggctcacgcctgtaatcctagtaccttcagaggccatggtgggtggatcacctgaggtcagggttcaagaccagcctggccagcatggtgaaacttcgtatctactaaaaatacaaaaattagccgggcgtggtggtgcacgcctgtaatcccaactactcgggaggctaagacaagagaatcacttgaacccgggaggcagaggttgcagtgattccgagatcacaccactgcactccagcctgggtgacagagtgagacaccatctcaatatatatatatatatatatgtaaataaataaataaagttttacatcactttttttcttgatcaaagcaatgctaggtaattaaggacattgttggcaataacagaaatgtgtctatgaaaaggttcttaagaaggtgactgtaacctcacattctcctttcattttctcccccatctctgcttctctctagggtgaacacagttggtctgggtgggattggggttgtgctgtgtggggcagaggctgttggggattcgtgatgggaattcctaatagtgacccttgggtcccaggaacaggagacacgggccagtcaaaggcatgggaagaagctaggagaagttaggattcgagttaaatccagtgccaacagggtgaccagttgtctaggtttagccaggactgagggctccctgggatgtgagattttcaatgtccacactcagaaagttctgggcaaatggggacaagttggacacagaagcagaaaaaaaatcaaggagggtctgcagtggaaacgggcattgttcactctgcagaatctgtattcttgctgtcaacaatgccccgaacttcctctggaatctgctcctcacccttgagtggctctcacctcccactctcaaccccagcctggtaccagggcaaaacacaaaactcagccccaaattagccatgacaaaaatgcaaatcaagaccacgatgcaataccacttcatgcccacgagcgtggcaaaaaacaaacagacggacaataacaagtgtcggtgaggatgaggagaaatcggaaccctcatacattgctggtgggaacataaaatggcacagctgctttaggaaagagtttggcatttctttcattctttcttttttttttttgagatggagtctatctctgtagcccaggctacggtgcattggtacgatcttggctcactgcaacctccgcttcctgggttcaagtgattctcctccctcagcctcttgagtatctgggactacaggaacccacgacctcgcccggctaatttttgtcttttagtagagacgaggtttcaccatgttggtcaggctggtctcaaactcctgacctcgtgatctgcccgcctcggccttccaaagtgctgggattataggcgtgaaccaccgtgcccagctggtggaaggtattttttttttcttttgctagtttcataaacaaagccacctctagctatttaattgcattttcagtatctcccgttaaaaaaattttttttttcagagacagagtcatggtgtgtcacccaggcccgccatccgccaccatgcccagataatttttttttttttttcaaacagagtcttgctttgttgcccaggctggagtctcgctttgtggcacacgcctataatcccagttactcaggaggctgaggcaggagaatcgcttgaactcgggaggcggaggtcgcagtgagccaagatcatgccactgcactccagcctgggtgacaagagcgaaactccgtctccaaaaaaaaaaaaaaaaaaaaaaaaaaagaagatgcatttcccctttgtcctggatagcagctaccttgggtttctatatttgcttatttgtccctctctactcggtgactcattccacttggaagaaactttggactggagttccctgcccccacccctgccaccagactgatttgttttcttgctgttattgtcacacgataagcatggggttgttggctttttttttttttttttttttaacatttctttctcttctccactctccacccccctcctaaatgttccagcccggttctctgcatgcactattagcttggaactgtgtcgaaaacttttcagagttttgggctcgatgcttgcaggtttcatggtcttattcccaagagcctcctgtctcttctcataagttctggaattatctctagttacgtgcttatcacagggtatgtttcccactttgcaaatctccatttgggtggatcccaactgttttatttatttatttattattttattttatgtgtttatttttgaggcaaagtataccacattttctttttctttttgagacagtcttgctctgttgcccaggctggagtgcagtgtcacgatctcgactcactacaaactctgcctcccgggttcaagtgattctcctgcctcagcctctcgagtagctgggattacaggcgcacaccaccacaactggctaatttttgtatttttagtggagacggggtttcaccatgttggcaaggatggtctcaatctcttgacctcgtgatctgcccgccttggcccctgaaagtgctggaattacaggcatgagccaccgtgcccgggcttcaactgtttttataatgattaaaaaaaaaaaaatcgaaaggcagcaccgtggcaaagaaagagcttttttatttgtccttagacattaagcacatttatccatttggttctgatgtgacagaggctgggagttgcagggaaaggcaggaaatctggcataggccctgcagatccttcatttccactcttttctaattttgctggatacatggcaaaaatattctgcagtggtcttaaggagaagttctagagccagacagttctctttttttagtttctttctttttatttatttattttttttgagatggagtcttgctctgtcacccaggctggacttaagtggcgcgatctcggctcactacaagctccgcctcccgggttcacgccattctcctgcctcagcctcccaagtagctgtagagccagacagttctgagttcaagagctggccctgccactttgcagctatgagatctcggacaaaccatataatctcttaaaccaggggtcagtcagtaagctatatcccataggctaaatgtggcctgctgcctgatttctaatgatttgtgagctaggagtcacttttgcattttatttatttatgtatttatttttgagatggagtcttgctctgtcacccaggctggagtgcagtggcacaatcttggctcactgcaacctccacctcctgggttcaagtaattctcctgtctcaccctccaagtagctgggattacaggcgtgtgccgccatgcccagctaatttttgtattttgggtagaggtgggggtttcaccatcttgaccaggctggtctcgaactcctgacctcaggtgatccgcccacctcggcctcccaaagtattgggattacaggcatgagccaccacgccctgcccacttttgcattttaaaatgattaaaggaaaaacaaggagagacgtgaaccaaagggtgcaaagtttcagatgggaggaatacgttctaggaatccactgctctgtagatgaatggtgactatagctaataacacatattgcaaaatggctagaagaatagattttaaatgttctcacaacaaagaaataagtacatgaagtgatgaggatttaattagcttgttttaatcattccacaatttatactgtaacataactttacactgtaccccatacgtgtacacaactattatttttatttttgtttatttattttagagacagggtctagctctgtcacccaggctggagtacggtggagccttcatagctcactgcacccttgacctcctgggctcaagtgattcttccgccttagcctcctgagtagctgggactacaggtgcgaaccatcgtgcccggctaattgttctattttctgtggaaatggggtctggctatgttgcccaggttggtctctaactcctgggctccagcaatcctcccttcacggcctcccatagggctgggattacaggcacgagccactgtgcctgacctataatactgttgtcaattaaaaataaaacaaatgatttttagaaagataatattatggaaattaatattaatagaaaatagataatagggctgggagctgtggctcacgcctgtaatctcagcactttgggaggccgaggtgggcggatcacttgaggtcaggagtttgagaccagcctggccaacatggtaaaaccctgtctttactgaaaatacaaaattaggcaggcgcggtggtgagcgcctgtaatcccagctactcgggaggctgaggcaggagaatcacttgaacccgggaggcagaggttgcagtgagccgagattaagccattgcgctccagcctgggcaacaagagtgaaactccgtctggaaaaaaaaaaaaaaggaaaagaaaagaaaccatcagggtttaatgctcagcttctggcttaggaagtctggctcttaccgataatgataacctctgcatatatctttatccatagcactatggttataaaattctgcaattctcaaagtcgcttatgtgtcttagtctgtgctttgctgccttggcgtcatttctgagcaggatcctggctgtgagctccctgcgaggggtggacactcccagatgtgcaaagctcagccaccctccttctcctcctctcttcctcccaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactattgtaagtctccatggcagcctcagctgactggggctgtgcttagcactgagcatggtgggacattgcaggggatgacttggagaggccgcaggtgctggccctggccttgactctcaggcctatcagctgctgcggtgcttgccctctttgatcctgcactttttttttttttgagatggaggcttgctttggagtgcactggcacaatctcagctcactgtagcctccgcctcccgggttcaagtgattctcccacctcagcctcacagtagctgggactacaggtgcccaccaccacgcccggctaattcttgtatttttagtagagatggcatttcaccatgttggccaggctggtctcaaactcctgacctcaagtgatccacccgcctcggcctcccaaagtgctggaattacaggcatgagccaccatgcctggcctgatcctgcacttaaaaaaaaaaaaaaaagtttcagaggtacctgtgcagttcattatataagtaaattgtggctgggcacggtggctcacacctgtaatcccagcactttgggaggccgaggcgggcagatcacaaggtcaggagatcgagaccatcctggccaacatggtgaaaccccatctctactaaaaatacaaaaataaattagccaggcatggtggcgggcgcctgtagtcccagctactcaggaggctgaggcaggagcctcaggaacccgggaagcagagcttgcagtgaaccgagatcgtgccactgcactccagcctgggcaacacagtgagactctgtctcaaaaaataaaataaaataagtaaattgggtgttgttgggggtttgctgtacagataattttgtcacccatgtaatcagcatagtacctgataggtcgttttttgatcctttccctcttctcacccaccactctcaagtaggcacctgtgttagtctgtacttacactgcaataaagaaatacctggccgggcacagtggctcacacctgtaatcccagcactttgggaggccgaggtgggcggatcacttgaggtcaggagttcgagaccagcctgaccaacatggtgaaaccccatctctacccaaaaatacaaaaattagctgggcatagtggtgtgcacccgcagtcccagctactcaggaggctgaggcaggagaatcacttgaacccgggaggcggaggttgcagtgagccgacatcacgccactgcactccagcctgggtgacagagtgagactctgtctcaaaaaataaaaaagaaagaaagagtgaaagagagagagaagaaaaagaaaaagaaagaaaaggaaagaaagagagaaaaagagagataaaagaaagaaaaagaaagaagagaagagagagaggaagaggaagaggtctgagactgggactcagtaatttataaagaaaagaggtttaattggctcccagttctgcaggcagtacaggaaccatgatgctggcatctgctcagcttctgaggaagcctcaagaaactttcaatcatggtggaaggtgaagtgggagcaaggtgttaagacggggagatggtgctacacacttcttaaacaaccagatcccatgagaacccacttattatacagtacccagtagggatgttgctaacccattagaaaccgcctccatgatccaatcacctcccacccggccactcctccaacattggggattacatttcaacaagagctttgggtggggacacagatccaaaccatagcagtcccggtgtctactgttcacttctttctgtccatgtgtggtcagtgtctcactctcacttatgggtgagaacatgaggtagttggttttctgtccctgtgttaattcagttaggataatcacctccagctccattcatgttgctgcaaagaacatgatctcattctttttcatggctgtgtagtattccatggtgtgtatgtatcacattttctttatctggcaatcctgcacttcctcatctgtacatggagataataacagaaccacttcaggaggtggagggacattttaatgacacaaatgttaagtgcctggcacctgttgctagtgtctccatctttgttactagagttttttggctagatgaggtggctcacacctgtaatcccagaactttgggaggctgaggcaacaggattgcttgaggacaggcattagagaccagcctgagcaacatagcgagactctgtctccacaaaaaaatacaaaaattagccagctatggtggtgcatgcttgtaatcccaggtacttgggaggctgagacagggggatcacttgggcccaggaatttgaggttgcggtgaactgtgattgtgccactgtactccagcctgggtgacagagtaagaccctgtctctaaaaaataaaaattaaaagaagtttacatctgtcaaaagtcatgctgggatcgggactagctatgtaatttgcaagacccagtgaacaatgaaaatgcagaactccttgctttaaaattattaagaatttggccgggcacgttggctcacgcctgtcatcccagtactttcggaggctgaggcgggaggatcacctgaggtcaggagtttgaggccagcctggccagcaaggtgaaaccctgtctctattaaaaatacaaaaattagccgggtgtggtggtgcatgcctgtagtcccagctacttgggaggctgaggcaggagaatcacttgaacccgaaaggaggaggttccagtgagccgagatcgtgccactgaactctagcctgggtgtcagagcaagactctgtcacaaaaataagtaaataaataaaaattaaaataaaatgaataagcatttcagaggggcaacagcagagcattaaactgacagaaaagggtcctgcatccactgcctgagatgtgggagggatggaaatgagcagtgatttggggcaggggtggggaagagtgtgcttccagaatactgacctctgagcccactgcctggtcccactgcacctacgggactgtttcgggactgctggaaaatcaggatgtggaagagcagcagagaggtttatggacaagggagggaaggaacagggtggcccacccattccaggagtggatgtgatttttgatgtgaactttgttggaaacacattgatatgaaacatatattttcttattctatttcagtagacgtcccgtcaaatattgcaaaaattatcatcggccccctcatctttgtctttctcttcagtgttgtgattggaagtatttatctattcctgagaaagaggtgagttcagtgagttcagtggtgtgctgggaacagttggttctctgggggaaaacatgccttgatataggtataggcatatttaagtttattatgaattttgctgatataggatgtgtaacatgcaatttacagataattgtcataatatgatatacacaactctttattgtaaattccctctagacagttgattctcacagaatgtttttattgatttttttttttgcccaaacctttatatccgaagctaacctattattgcaattgataaacaagtaaagctccaatgtgaatgttgattaatttttcaaaatttacattaaggagtaggacttgactgggcacagtggctcacacctgtaatgctagcactttgggaggccaaggcgggtgaatcacctgaggtcaggagtttgagaccagcctggccaacatggtgaaacctcgtctctactaaaaatactaaaaaattaaccgggcatggtggtgggcgcctgtaatcccagctactcaggaggctgaggcaggagaattactgaaccctggtggcggaggttgcagtgagctgaaatcgcaccattgcattctagcctgggcgacagagggagactccgtctcgggaaaaaaaaaaaaagtaggacaaaactgaaataagacatatatgttcatcagtgatatgagtgacgtctttgctgagtcagatggtaatttttaaatatcagaagaacattttgtgccacatgcaacatcacagttgcagacatgacacgcttttaagtttaatctacatgattaaacatttttctcagctgggcacggtggctcacacctgtaatcccaacactttgggaggccgaggcgggcggatcatgaggtcaggagttcgagaccagcctgaccaacatggtgaaaccccgtctctactaaaaatacaaaaattagcaaggtgtggtgatgtgcgcctgtaatcccagcttctcaggaggctgaggcaggagaatcgcttgaacccaggaggcagaggttgcagtgagccgagatcgcaccattgcactccagcctgggcaacagagtgagactttgtctcaaaaacaaaacaaaacaaaaaaatatttttctcatcactttctcaagcctggacaaacaacagaacaacaaatccagtcctgagttatagcatttgccagtttctgtaatgtaaatattcccaggatgtctaaattcaagctgtagacataatattactgagtgcagtgttagaaagagatacataatagctccccattgaatccaccctatggatacaatatggtgtataaatgatataatgtaaataacctcaactgcattgatcatatttaaatgtagtatgagagttaggaagtgatgagttttgaacatgtattgtctttgcttttaggataatttatttaattgtaagcctctataatttatattttttgttctatttggaaggcattgtacaatttaatctttaatgatgcttgtatttaacaactggctcactagtttcctgaaaatttaataattgtttctcatcagtcgggatgagctcgctctagaacagtactgggtgagtggcttttaagtgttacatggatggccataaattatttaaaaagccagccagagccctgcatggtcgtgcatatctgtagtcccagccgctcgggaggatgaggcaggaggatcacttgagaccaagagttcaagaccagcctgggcaacatagtgagaccctgtctatatgaaattttacaaattagccaggtgtggtggtgagcacctgtattcccagctattcagaaagctgaagtgggaggatctctggagcccagaaggttaagactgcagtgagctatgattataccactgccctccagccacaacagagcaagactgcaactctgaaatgtaaaaacaaaaacaaaaacaaaacaaaaaaaaaaccacccagggagggatgagtgctcccatgttgatgcacttacatacctgtctgatgggcttccattcaaaacataaaggtcccccatccctgccctagactgcatctaggattatggggattctgctggtaagggctgccatttgccttggggagtcttgtatgaaacacctttctgcagagtcccatgagaatctcaagctaacgtgcctcgttttcctcctccaggcagccagatgggccgctgggaccgctttacgcttcttcaaaccctgagtatctcagtgccagtgatggtgagtaccatcccttccctgtgggtggccagaaccctactcatcagcttcctttgccttcaccattgagtgagagtgaaggatgggttccccagggaggccaagaaaagccctcttattcatttgagcttgccaaactgcccttgctgcagaaacctcattactgtgtgcatctggacacatggtatttggcacctgcctgaatgggctcatctagccggtctgggacccttgggcagggtcgaccacttgggctgggctcagctgggcagttcttctggtcttgcctggcttcacccatgtagctacattttgctggtgtgtcagctagcactcggtagtcttagatgatttcactcacatgtctggtggtcagtaggctgggtggtcccaaggtgggggccctaagctgggggaggctgagcctcactctgtccatctagcctcttaggctccagcaggctggctcaggcttcattccatggtcctctgttggttcctagtagaaagctccagggcaagctccagggcaacagtccattccaaatctctgcttggacaattcttgttgattcccattgaccaaaataactcacaaggccatgcccagggccaaggggtggtgagatagactccaccttttcatgggaagagctccaagtatcctggctttttttttccccaacctattacaacctgtcttccatccccttggcactttgcagaaacagtagtctcaggtgggaagtagcatcattccatagcaagggtctgaaatcagacaagaaggatggggatgcaggtttgcctcaggacatattggccaggatcttggaccagttgtggctccttccttgagtctctgccatgccctctccatgggtgcagatgcctgtcctgttctcggccatatgcccagtgcccggcatgggtcctggatcacagaactcatttcatgagtgttttcgagggggtttgggtgagggcttgggtggaaggtggctgcagacccccaagggatcctccaaggatgctgtgtagataagtaagaagtagtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccggaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatattttttttttttttttttttttttttttttttttttttttttttttttcctgaaacggagtctcgctttgttgtgcaggctggagtgcagtggcacaatctcagctcactgcaagctccacctcctggattcacactattctcctgcctcagcctcccgagtagctgggactacaggcgcctgctaccacgcctggctgattgttttttttttttttttttgagatggagtctcactctgtcacccaggctggagtgcagtggcatgatctcagctcactgcaacctctgcctgctggattcaagcaattatcctgcctcagcctcccgagtagctgggactgcaggtgcctgccaccacgcccagctaatgctttttatacttttttttattagagacggggtttcaccatgctggccaggctggtcttgaactcctgacctcgtgatccacccgccttggcctcccaaagtgctgggattacaggcgtgagccaccacgcccagtgcctggctaatttttttgtattttcagtagagacggggtttcactgtgttagccaggatggtctcgatctcctgacctcatgatccgcctgccttggcctcccaaagtgctgggattacaggcgtgagccaccacgcccagcctatttttatatatttttaagacagagtctctctctgtcgcccagagtggagtgcagtggcacaatctcggctcactgcaacctctgcctcccaggttcaagcaattctcctgccgcggcctcctgagtagctgggataacaggagcccaccaccacacccagctaatttttgtatttttagtagagatggggtttcgccatgttggccaggctggtctcgaactcctgaattcaggtgatccaccggcctcagcctcccaaagtgctgggattacaggcataagccaccacccccagctgactccaaaccctttatacattaggagcaaatgctatggaaacatgaagaaagggaggaaaggagggttggacaggggtgtatttgagcaaagacttagaggacatgaggagctgggccctgtggatgtggcagggaacagagagccaggcagagggaatgattaaaatacaaaggcctggctgggtgcagtggctataatcccagcactttgggaggctgaggcaggcggatcaccagaggtcaggagttcaagaccagcctgaccaacatggagaaatcctgtctctactaaaaatacaaaaattagccgggtgtggaggcgggcacctgtaaccccagctactcgggagactgaggcaggagaattgcttgaacccgggaggcaaaggttgcagtgagccgagatcacgccactgcactctagcctgggtaacagcaagattccgtctcgaaaattaaaaaaaaaaaaatacaaaggcctatctgtctgctgtccgggcaggtatgtctgctctcctagaccagggctgagcacgctgcatccaggccacagggtgctgtgtgtgacatagacaccagggagggaggagaaccctggtgagtcgaatcacggaccctcctccaagaaccctggttgcttgctctgcaggtgcgcctcctgggagtggtgtccaagggccagcccacgctggtggtgatggagctgatggctcacggagacctgaagagctacctccgttctctgcggccagaggctgaggtaagctgcttcgggggacccagcggggtactcggtggagcacccgctcctggcctcctcggatcccagtgctgctgaaacaccaaccccgtgtttctgttttagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggaggttcgtctggctttctgctttgaaaacataacgacccaggccaggtttgatttcagaaggaagttgtctataatgagccgttaagtcttttctgataatataaaggggcaagatacttcttttttttttgtggggttttttttgttttgttttgtctttttgtttttgagacggagtcttactctgtctgttgcccaggctggagtgcagtggtgtgatctcagctcactgcaacctccacctcccaggttcaagtgattcacctgcctcagccttccaagtagctgggactacaggtgtgcgccaccatgcctggctaatttttgtatttttagtggagatggggtttcatccatgttggccaggatagtcttgatctcctgacctcgtgatcctcctgcctcggcctcccaaagtgctgggattacaggcgtgagccactgcaccggctttttttttttttcttttttctgacatggagtcttgctctgtcgcccaggctggagtgcagtgacaggatctcggctcactgaacctccacctcttgggttcaagcgattctcctgcctcagcctcctgagtagctaggattacaggcgtgcgccaccacacccagctactttttgtatttttagtagagacggagtttcactgtgttggccaagatggtctcaaactcctgacctcatatgatccacctgtgttggcctcccaaagcactgggattacaggcatgagccactgtgcctggctgggcaagattttggatggggaccccccaccagctgtcatttaattgcatgtattgataaactcacttacccattcacttctttaaaagatatgtttgtaggaccgggggtcccgcctgtaatctcagtgctttggaagtccaatgtgtaaagactgcttgagtccaggagtttgagaccagcctgggcaacatagtgagactccatctccttgaaaagattttttaaaaagtggggtgtggtggtgcacacctgtggtcccagctactcaggaggctggggtgggaggattgcttgagcccaggaggtggaggctgcagtgagctgtgacagcatcactgcactccagcctgggtgacagtgagacgctatttcaaaaaacaaataaaaaaggaatatagaggggaccagagcagcgtgagatgtgaggatgaggagagaggcagaaaccagacccagaaggaccttgcgtgtcacagcaagtcatctcgacattatcttacattagcaaggggcagcaggaagtgatatgattctatttatgactcaaaaagacatctcctggccaggtgcggtggctcacccctgtaatcccagcactttgggaggctgaggtgggtagattacctgagatcaggagttcgagaccagcctggtcaacacggtgaaaccctgtctctactcaaaatacaaaacattagctagacatggtggcagacagctgtaatcctagctactcaggaggctgaggcaagagaattgcttgaatcagggaggtagaggttgcagtgagccaagattgcaccactgcactccagcctggaggacagagtgaggctccatatcaaagaaaaaaaaaaagaaaaatgtagcttctttgtgatttggtaccttcttttccctccctttaaacagtagcccatcttcccccttcacttccccatgcgtaccctcagaatccattcttactggatttggccaccacccaggtgagcgcagacgtgggccaggtgaacccctcttagggctctgtgagaggtggggcagtcaaggtggcagatgctaggaccaaggctgaaggttaagagcgtgtgaaccttttgtgttgtcagactttggaatgaccagagacatctatgaaacggattactaccggaaagggggcaagggtctgctccctgtacggtggatggcaccggagtccctgaaggatggggtcttcaccacttcttctgacatgtggtgagttgtgtgtggatgggtggatggacgctgggcttgaattccaggtgctagtgagagccaagagcgggggaaggaagcctgccatcctcctggacgccccatcaaggaaaggaaggcagcgtcctgtcttaggatcttcccacggctactcttatgtcctgactaatcctgtaggcattgtgaaccccgaaaatctgagacaggtctcagttaatttaggaagtttattttgccaaggttgaggacgtgtgcccgtggcacagcctcaggtggtcctgaggacaggtgcccaaggtggtcagagcacagtttggttttatacattttagggagacatgagacatcagtcaacatatataagatgaacattggttcggtctggaaagacgagacaactcgaagtggggagggagcttccaggttgtaggtagataagagacaaatggttgcattcttttgagtttctgatgcgcctctccaaaggagccaatcagatatgcaggtatctcagtgagcagagtggggactctgaatagaatgggaagcaggtttgtccaagcagttcctagctggactttttccttgagtttagtgatttgggagccccaaattgattttcctttcacagcatttatgaactgcagcatgaattgttttattaagtggctaaccatgttctagaaaccaagagatgtgtttgtgtgtgtgtttgtgtgtgtatgtgtgtgcatatgtgtgtttgtgtgtgtttgcatgtgtgtgcgtgtgtgtgtttgggtgtgtgtgtttgtgtgtgtatatgtgtttgtgtgtttgcatatttgtgtgtgcatgtgtgcgcatgcgtgtttgtgtgtatttgcatgtgtgtgcacgtgtatgtgcgtgtgtgtttgcatgtgtgtgtttgcatgtatgtgttggcatgtgtgtttgcgtgtgtgtgtgcgtttgcgtgtgtgtgtttgcgcgcgcgcgtgtgtgtgtgtgtctaaatggcttctttgttactactatcaactgtcatcggcaggtcctttggcgtggtcctttgggaaatcaccagcttggcagaacagccttaccaaggcctgtctaatgaacaggtgttgaaatttgtcatggatggagggtatctggatcaacccgacaactgtccagagagagtgtaagtgtagaaagggtttaaggtgtgtgaggtgttcgttgaaagggtattgccctttacacgtgtgcttggttttgcctttcctatgtctacacgctcaccgtgtttgcatgctgtatgttacaggtgtgtttgtgtttgcatagcttgtctttacatgcatgcttgcatttgcatattgcattgtggtacacacacttgagttcccatatgtgctacatgtacgcttacgtttgcatattatatatttacataggtatttatgtttgcatattatatgtttctgtgtgcatcagcatatcatggcacatgtacacctcatttacatattataagcacacatgtttacatattatgtctttacctgcctgcttgtgttcacaaatcatatgattttcttgcatattgtatctttggaaggttgcacaaaacacctatagcggtagttatcttgggagaagggaactggagacctggggttgggggagagagacctgtttgcctgttaatttttttttttttttttttttttttgagacggaatcttgctctgtcacccaggctggagtgcagtggtgcgagctcggctgacttcaagctccgcctcccgggttcacaccattctcttgcctcagcctcccgagtagctaggactacaggcacccaccaccgcgcctggctaatttttttttttttttgtatttttagtagaaatggggtttcaccgtggtctcgatctcctgacctcgtgatccacccaccttggcttcccaaagtgctgggattacagccgcctgttaattctttatacacttaaaattttgtcaggtagctgggcatgggtggctcacgcctgtaatcccaagcaatttgggagaccgaggtgaacgatcacctaaggtcaggagttcaagaccagcctggccaacatggtgaaaccccgcctctattaaaaatataaaaattacccaggcgcggtcgtgggcgcctgtaatcccagctactcaggaggctgaggcaggagaattgcttgaatcggggaggcagaggttgcagtgagcagagactgcaccattgcactgcagcatgggtgacagagtgagattctgtctcaaaaacaaacacagacacacaaaaattttgtcaggcatacatattatatattcccccctccaaatatatatgcatatgtacatatatatatatttagatgaagtctcgctgtgtcacccaggctggtagagcgcagtggcacaatcacagctcactgcaaccttgaactcctggactcagcctcctggctcaacctcccaaagtgctgggattactcttgagccagttttgaaatgaggaatcccttttcaaaaccatctttcaggctggacaggatggctcatgcctggaacctcagcactttgggaggttgaggcaggaggatggcttgagcccaggagttcaaggctgcaatgagctatgattgcgccactgcactccatcctgggtgacaaagtgagaaaccctgtctcaaaaaaaaaaaaaagcggccaggcatggtggctaacacctgtaatcccagcaccttgggaggccaaggtgggtggatcatttgagcctaggagtttgaggccagcctgggcaacatagcaaaaccctgtctctgcaaaaaatacaaaaattagctaggcatggtggtgcacacctgtggtcccagctacttgggaggccaaggtgagaggattgctcgagcctaggaggcagaggctgcagtgagctatgatcatgccactgcactccagcctgggtgacagaatgagacgctgtgtccaaaataagaagaagaaaagcaaaaagaaaacaccatctctcagcacctctagcaatgctatttctgccttgacaattgtccacacacacagccagcatctgatgtgagcacatgtggtccgtgggtgtcggctgcagggacaagagtgggggtttgggaggatgcgtggcagggcccccagactcacccaggacgtgtccttctgccccgcagcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaa

SEQ ID NO: 37942 - DNA, 31893 bp, Homo sapiens; identical to SEQ ID NO: 35616

SEQ ID NO: 37943 - DNA, 95426 bp, Homo sapiens
aattcttggaagaggagaactggacgttgtgaacagagttagctggtaaatgtcctcttaaaagatccaaaaaatgagacttctagcaaagattatttgccttatgttatgggctatttgtgtagcagaaggtaagattaaaagagactcttttctgaaaactgtattatgaaacatttgctaatgatgcttttcacaggagtaataaaaatttgatttagaaaatgtgcttaagtattctgtaacttgacaattgagtggcttttgacattgttgagtttaaaaaatgtaagaaccttatttgaatggtatatctaaatattcatcataattatatttaatataaaatagaataaaatgttttaataaacatttctgaaaaactatgatctggaataatcatttcccttgtaattatcataaaatgtaatttacttttttgcttaggagtataaccaaaatgtattatgtgaaagcattaagaaggatgtgaatatacatagtcaataaaagccatcaaatcataatgattagatttatttcaaatatgattttaactcttcctaaataaaaattcatttatcatttacaactgatattgtcatgaccttagaattcttgtagacaagtattacttgtattatcagaataaaaatattatataaatttgaaacccaattgaatatacaatatttgtaacagttaagttgttcaatagagatttttttcctgtagttgtatataacatatattcttgaagagcagtcttttggagtagtgaatatgaatgtaggagtttttttctgacctcagtaagacaatttctggattcataataaaatttaattatatcactgcttcttgatagattaaaaagcttattcttggaggaggtttgctttcctagtttttgataggtaaccagttatgtgatagatatttggtaaacatttttaaactgaatgaattacatattattcataatttctaaaatcttttcacttagtaaagaaattttgattgagtgaccattacatagcctctaggaactgaagaatattagcaaataatacaaatctctgtttcagtcttccaatctagaaaataaaagcagatatattcttatagttatacactttggtaatttaaaaaatattcaaatatgtttaataccttttgaaaggttgaattattttcagttatattttctaatgttattgcttgttctttggcttgtaaactttatatgtagccactttttaaatgaagaaaacaattatttccttgtacatataaatattataattagtattttaaaatgaaacctttttgtatttacaaacagttccagaacaatgtcaatattacctattgtaaaagacatctttttctgtttctttgtgtaaatatttctgtcttttcttactaaatttatgggaatgtttctaacgtttcatacctacatactgtttgctccagttttacatagataccatttgtcatataagggagatttgttttatttctaatctttaaaatcaagaatcaatggcaagtttaataaacagtttaagttattaaaaagttgaatttgaaatattattaaaatagagtacatcaaagtatatgtgataattaaacaatagtgatttaaacatcttatttacataattgattattgctgacttgtttcacttttattttatttttcatcaatgtgtgtttaaatgtggtatcagtttctactggtgaattgaacatcggcactatatatgttatggtgaaaatgatataaatctgattatttcctaaaagataaagcacaactttgtatttaaagcaatgcttaggccagcctcataattttcataaaagcacatgtaatgcaaaagccaatggagaaaaactacatgaattttcagtggatatcagactcctaatttattccttgtttcccaaatactctctgaaactaaactagttcgagatgtccatcagttctattaatctaccatatctaaaaaatttttacttaacagagtagctttgatcatgaaaaatactcacatatatttcaatatttgcttctgtttatattttccacattgaatactgaataccaaattgagaagatagtttgaatactatcacaatctgctttattcaacagcataacattttagcattacttctgctctgttaagagtgaactttcttcaaaaaaaacactattcattactaagaaagaattatagccagcaggaataatttgtaatttcagctttctatttgttttctttttttaatatattgggtactacatagaacctttctaatgcaatatattgtctacaataacatttccaattgtgtaggaacgttaattgcctccttgttttaacagtctggctcagggggtcactgcaggctactaagaattgggtcagatttacaggacaaagtttaaaataacagtttctcaatcgtaccacctaatttcacctttttgaaatatagtatgaccaaggttttgaatatattatgaccaagcagattttttagatttagggtctaacaattgtgtactatatgaaattaggccacagcccagaaattccaagatgattaaagtgaataaattaaaactctactgaaacatgttcaagtaaatactggctgtgttgtttgggagacatgttttttaatcctggagatttagagtgcagaaacgttatttcaggtcccagaagactttatagatcagagattgatggattccattacagtcagagaaaggagaatagtggtctaaaatcctaaattgtatgtttgaatttcagtgtgataaataagaattcccctttgctcccccaaacccccatattttcagagatagtagtatgtgtatttatctatatggtgtgatttaaattgtgcgatggcccaattggcttcaatatctcatctcctcctaaaatactttacgtgttgatattaatattactataatttcaaccaatctgtcatttacatggaatgacaaatacactgaatacatattttaggatagttaaatttagtattattcataatttactttgaattattatcatctgacaacttccctgaaacaatttcagtgggcgggggagggtagaaatggatgttgatgaggataagaatagaacaaagtgattctggaagatggggttttcccaggtaggacagatctgctggttgaagtgctatagtgagtgctataagagaaggggtagagaaaatgcccacagaaatggcacgagcctgagacgtctgccaaggcaagctttgcttattttaaatttaggcatatcctgggaatgcatatgctactcttttgcctacatataatttaaactaaaaatgaaatatctaagtattgctaactaaaattattcttaggtagaagtaagttcccaaatataagttcaaaagcagattggtaaatgttcttcatgtgtggcctttggtttctaagatctgagccagtctacattgacccacttttatttgcttaatcctcgattgtttattctgcagtcttttgccacttttcattcttcccagttatgccttctcctcctccccacacacaccatcccccacctgcctaggcctttgagattctgccacccaatctatcccgtgctcagttaactaacgtgtactttacccatttcttcacaaaaccatagtacatggaaaggggatgatgtaattgacaaaaaagtattgcattttagcttaaaattataaggagtcataaaaagatagctcagaggaaataaagtaactgaacatcaaaaaatgaaacaataaaaaggaaagaaaaaacatttgacagaacacttttatttcttctgacattttaacttagccaagtttttcataaaccttgttaactggaaatgtaatagatagaaaagtgattattcttccaggccgggcatggtggctcacacctgtaatcccaacactttgggaggcccaggtgggtggatcaccatgtcaggagttcgagaccagcctgaccaaaatggtgaaaccccatctctactaaaaatacaaaaattagccaggcgtggtggcgcgtgcctgtaatctcagctactcaggaggctgaggcaggagaattgcttgaatcagggaggcggaggttgcagtgagctgagatcatgccattgcccttcagcttgggcgacagagggagattccatctcaaaaagaaaaaaaaaaaaaagaaagaaagaaagaaagaaaaggaaaaagcaatattctttcagaaactcctgaactgtaacataaatttaagcttaggacacataggtcagatgtacaatggaattacaaatgttagagtttcctgggttcttgcaacagagttttaagtgcactaaacagttatcaccttgtcttctcttatattttctagtcactactgtctactacgctttttccacaggctgtccataatctacagatataatggaaaggcttccagatagtttcattgttactcatctgttctttcgctcattcatttttccatcactttaacttccacaagtactacttagtaatacttggtacaatgtgtgttgcgtttttttttttttttctctattttcagggtcctaattgtactgtctctttgtggctgagttcgttttttgtgactggaacaataactggcattagaaattagctattcaaatacacatttcaagaaagttgtggaatttcaacccatgttctgatagtatcttgttttatctctaattatgacatacttgttattctatccaacttcatgtgactatcgtctattctcctatctgctttttatggttctggaattttcttcttgctcttttcactgttaagttgtttgtttgtttgtttgtttgttttgagacaggatctcgctttgttgcctgaggctggagtgcccacgctggagtgcagtggtgcgatcatagttcactgcagcttccaacacctgggctcaagcaatcctcctgcctcagcctcccacacctagctaaatttttttcttttcttttttctttttctttctcaaatgcctattaagtgtgacataatctctattctgctttgtctctagagtttgtttctttaaacaattctttactctgtttacaaaggtatatatgttacttctgaaatgatctttattctcatgttatttataaaataatttgaatatttcttattttgaaaagctaattagatcatatcgtatatatgcatatagaattgacccttgaccaatatgtgcttgaacttcaggggtctgcttactatgtgaatttgtttcaactaaacctgggtcaaaaatacagtattggtgggttgcaaaacttaagcataggaaaaactgacttttcgtacatgcggtttccagagagccaaatgtagaatttaagtatgtgcagattttggcctgtgtgggagtcctggaatatatatcccctgtgtataccaaagccaaaggattattgaataaatagtattactatagatcagtgagaagataagaaagaaatttaatgcaaaatacctatttttgctatttctgttttgttcatttgctttatttttttccaaattgattttgtaactttgctttataatatattctgatacctactaagtttagaagtaggctatttaaaaaataatatctactgttttttatgcacaaaataattttagaaaaatagaataattgaacaaagagaccaactttagtctaccaaaacaatctagcacaaatttgattaaggatttcccaaatatataattttatcatgatttatttcatttgaataaaaacacttttcaactaacagttaaaagatatattgacattgaaaataagtaattagttctatgtttgtatgtcaataataagtaattagcttggtgtttgtatgtcaataatgcccccttaaaatttgaaagtgaaaaaattaggtaaattaagattattaaaatattaagtaatattgatttttagctttgaccaaaattatataactattttcctcaaattatagtaaaaacattcctactctttaccagtagttaaacgtattcacactcttaattcatgggctaaaaaaaaacttgattttgtttagtattattcttacttttttgagacagggaatcactttgtcacccaggctgcagcgtactggtgcaatcatggctcactgcagcctcgacctcctgggctcaagcagtcctcccacctaagcatcccaagtagcagggattacagccaccttgctcaggtaattttttttttttttttttttttgagatggagtcttgctctgtcgcccaggctggagtgcagtgtcgctatctcggctcactgcaagctccgcctcccgggttcacgccattctcctgcctcagcctcccgagtagctgggactacaggcacccaccaccaagcccggctatttttttgtatttgtagtagagacggagtttcaccgtgttagtgttagtcaggatggtctggatctcctgacctcgtgatctggtgatctgccggccttggcctcccaaagtgctgggattacaggcatgagccaccgcgcccggcctgctcaggtaatttttaaaattttttgtagagacagggtttcaccacgttgcccaggctggtcttgaactcctggggtctattgatcctcttgacttggcatgtcaaagtgctgggattataagcatgacccactgcatccagactaaaactaattttaaattgtaaaataaagccaaatgaattaaagcttcaccaatgtagtgttttgtaaacaaaattaactggcaattaaatgacttgtaaacgtaagatgaagtattcattgtttaaactcaaatacttagatatgatggcttagtctactcattaatctagaatgagaaaaatgagatggctatttcttttagttttaagataaatcacatctcaaaaaaatgtttctgtgcctttcaatttgtatgcatcctatttaataagcccgttgtacatacatgctgagagtttgactacttgggccaaaataaccgtttgttgtctacttgaaggtggttcaactgagcttgaacattcgattgttagtcaattcaggcaaataaaagttatgtcacaagatatacctaattattattagaactcagtgcagtgaatcattaccttaaatacttttgctatggcatgagttgataatgatgtaggacagcaagcccccaaattgggtcttagcctgggaaggttcttggttttgtccagtaaagaattcaagggtgagcctgtggtgttaaacagcaatttttgttgaagtggcagtgtatagcagcctcagaggcacctctccttgctaagcagggctacccataggcagtgtgcccacagtagcagctcagaggcagttctgcactcatatttatatgcacttttaattatatggaaattaagaggtagttaatgctgaaattgccaggaggaggatggtaacttccggttgttgggtcattgctgtggaaagggcctgtaacttctgggtgttgccatggtaatggtaaactgtcatagcacactggtctgtgtgtcttacagggaggggcttccactcagacctgttttggataatcctcaatttggtccagtgtccaagtcccatctcctatctcaataatactcaatacaataatggttagaacaaaagcagacaggaaagtgtatctgaagtgagaagacctagacattaatgaaaattcttccacgaactatgaaaaacattgttcttcaattgtggggagcttacattttgatgtggggagatagatagaaaacctaatgaacaaaaatagttatagcattgtgaaaaattttgtgaaggaggtaaagtagggcctaagagaaaatagagatggggatggtagtatgtagagacattaggtgggcttggtcttggggactagaatgagtggatcactttgaggacagaacatttgagtagaggcctgaaagatgagacaaagccagtcatcagaaatctgtcgtaaaattattctaagaggaggaaataacccgtgtaaaggatctaaggaaaaaataagtttgaaatgctcaacaaaatataaacaaataaatcagcgtgactttgcacagtaaatacatgggagatttaacatgatgagatccgagaaagtggcaagagccagataaggggttcccaaaccaaggaaaggagttagcaatgctggataagtaaaaagtgaagtcatagaagaattttaatcacaggaatgacatgaccagatttgcaagaatcacttgtcactctgtgaatagactgaagtaacaggagagtagaggactggaggctagttagcaggcaagtttcatgaccaaagtgacagatgatgatctgaactaagattttgaagatggtagtaggagcaagggaaaatagaacaggggcggtcatatctttttcttacaagcagaatcaaaagatgccatttaacactgatggaaaaagcaccagaattttaagtactatttgaagagaaaaggtaatcaatatgataattctttatatatagtaaacatattcacagagtaaatattgtgagaagttggtaggaagattttgtggaagagatgtatccttgttttctacatctggttgttaaaagcaatgaactatatttggaaatcaagaattaggggcacaaacgtatcacctggaaatataataataaccagaagggaaagcatttacttctcactaggaagtgagcgggctaaactttttttgtgttaatggattactttacttatttattttttccaataacctgaacatcatcaaatggatctaaattttgaaagtgaaaaacaaacatatcagcttgtaattaatcagttttccttttgtgcggaaggggccggggattgtgttgttatgatagagtattagcaccatctagtggagtagaatatgtttacttaaattataaacatcgaaatagtgcaatgtggaatcacatattatatgagttcactaatacaaatttgcaaaaaggtcaagggaaaattagtgcccataaaaactttcacattattttgtaaaatataattttatatggtgttttctttcttatgaaatattgcaaaatgttttcatatggatttgttccaccatgttaatgggcacttctaaaacttttttctttgggctgctacaacaaaatattattaactgcctagcttataaacaacaggaatgtatttcttacacttctgaatgctagaaagtctaacagcaagatagtaccagcagattcagtgtttggtgaggtctgctctctggttcatagacagtgccttttggctgtgtcctccaatgatgaaagggacaaggcagctctgtggtgcctcttctataaaggcacacatcccaaatcatgacagctccaccttcacgacctaatcacttcccagtgtccccacctcctaatactatcacattggtaattaggtttaaacatataaattgggggttgtggggaggttgcatgtattcagagcatagcatatgccttcttaacttactaaagtctaataataatttatcactcaggattcaatgcgggaagcttaagtagaagtagaagattacctatctatcagtcaattaattgattgacataccaatctcctatctacctacttaaaaagaggttttgttttgtttgttttgttttgttttgttttttaaataaattgcctcaaggaattgtgagcatgagataagcaagtctgaaatccacagggcaggtagtcagaaaaggaagattacagacaggatggaactcacaggaaaggaagctgctttccacagaattccctctctttttcagaggagcctcagccctatgtttcagacctttcaaatgatttgatctggcctatctagattacctagaatgatcagcttgtttaaagtcaactgattgggagtgtatctggcaacatattttctcaccaacatttagattagtttgactcaataactgggaatgctgacttaagcaagatgacttattaagaaaactgtcacagctcattaatacctttctgtttttctggacactgtgaagaacttaaaagacattaattttattaatccttctcacagtttacctactattgtcatgtgttttatgtatatgggtgtatacacatacatgtttgtatttaaaaccatgtaaggtaatatttttattattttatagtcagtattcatttatatttacttgaacatttaccattttctttgtttttcatttcttctttcatcctaagaccttatatttaggatcagtttcagttttctgaaatatatcttttttctctccttaatgtgtatttatagtggcaaattctctcaaattttattaatcagcccgggcacggtggctcactcctgcaatcccagcattttgggaggctaaggtgagtggattgcttgagcccaggagtttgagaccagcctgggcaaaacggcaaaacctcgtctctacaaaaaatacaaaaattagctgagagaggtagtttgtgactgtagtcacagctacttggggggctgaggcaggggaccacttgagcccagggggtcagggtcgcagcgagctaaaatcacaccactgcactccagcctgggcaatagagatcttgtcaaaaaataaaataaaataaattttatgaatcaaaactttattctcaaaaaattatttctgtatatagaattctatatagatagttatttcttcctgaaaatggaagtgattaatacctggtggcgtctgctattgctattgagaagtctttgtaaatctaaccattactgcttttaaattaatatttttctctaacaaggttaagatattttctctttggttttctgcatattccttatgatgcatataggtgtgtttttttactgcttggaattttttaattcttggatatattaattggtatgttccattcattttttaaaattctcttccaacattgctctggcttttctatcctcattgactcttagctcatcttgtgtattttccacacatgtgtgtctccatgttgcatcctgtattatttcttttgacctgccctcctgtccacgaattctttttacaactgtgttatctgctattaagctgtccattgatgattaaaatgggttttttcatttttagaaattatatttggttctttttaaaatctgctactactttgttataatttctttcctcagatatcattagtcaaacttttctcttacatttaaacaacagaattagtattgttgattatagtctgtatatatttattccaatatcaaatatctattttgttccttatgaagtttatggtaactaggtgctttttctcccgtataatgtctttgacatttgtaataataatttggtgcttaagaaaaaaatcttcctcatattaaagttacaacttatcttttctgggtggctagaagaactttcagtgtgagactaccttaagccaaatttgtgctttaaaattccttggtgctctaagcaattcaaagctgggttcctgtaagaagagtgtggtttacttccagttctcccttatcctgtgggtgaattcatttaggtttccaactttgaattttgttgctttagcctaataaggctatcaaaaagcaagcttgtgtcttccccaaatggtgaatgcccacagtgcagaaaaaaattggctgcctgttttcctttctgggttctgattataccaagatatgttatggtaattctttactgtctcgtcagctttctaaatgcctctatgaaagtatttatttcaaaacatatgttttcctgtttttttccccttttgtgacagggtctcaccctgtctctcggctggagtgcggtgacatgatcatagctcactgcatccttaaactcctgggctcaagagaccctcctgtcccagcctctcacatagctgggacaacaagtgtgtgccaccatgggtaactaatttgtttctttaattttttgtagagatgggatcttgctatattgcccagggtggtctcagactcctgggctcaaggggattctcccacctcagcctcccaaaatgttgggattacaggtgtgagccaccatggctggccacctggttttattgtgaaggtgtcctaagtgataagattaatctgaaataatgaatcccaaggcactcaaattttttgtgaaatagccagacaataaatattttagacttcgtgagccataatgtctcgctactcagctcttctattgtaacataaaaggagtcatagacaatatataactatatgagcatagctgtgttctactaaaattttatttacaaaacaagcagcgattggatttggcccacaggttagttttctggcccctgacctaatgtatctcactataacagaaaatatatactgactttccttcttactattataaattttatgcacataattaaatattacccaaaccacaatttttaattcagatgggtgtagcataatttgacaattttcataaatattctaattatatccattattaaaaatgctggaataaacactctgtacctaaatatttcacaaaatctttaattattatttgttacttttaaaaaattgaaattatttgtcaacttacgtatgagtacttttaagattctttattgctaagttgctttttagtgaagtaatagtcatttatatttcagttttatttaataataatatttatattacctaattttccagcaaaattgattatcatctcctttacatttttgtgttaaaattggtcaaaaaataattttcttttaatttttatctcttttaattattggtaatggtcacgttaatgcctgttcttaagtaaatgatctatcctactctaacatttttctttagatagtgtttagtgcttttgttactgcaagaagtgtttgtgttaagaataatttttcagttaaattttctccacattttgtatatatgattttttcacaaatataatttttaattaacaaagttttaatgtgtatatgttctgtttgcaaattgctttatgcattaagccttccttttttgatatttattcatactttttaataaatatatttataaaataaatataattatagatagatggcactaagataatagtaagttaaaatgacatatcatcatatatagcagataattaaaaaattataaaagaatgaaacatatatgtatttattttaaatttgtttaaacctaactctttagtctacctggcatttgtgtgcatgtgtctgtgcaaataaagtaaggattcaaatttatcccatttcatttccagtgggttttattttttatttattattattatatttttttgagacagagctttgctcttgttgcccaggctggagtgcaatggcgtgatcttgggttactgcaatctccgcctctcaggttcaagagattctcctgcctcacgcccccacgtagctgggattacaggcatgtgccacaacagttggctaattttgtatttttagtagagacggggtttcgacatgtttgtcgggctagtctcgaactcctgacctcaggtgatccacccatctcagcctcccaaagtgctgggaatataggcgtgagccaccgcacccggccccagtggattttaattgcaagcctgccagagtgagtttcaatttgaggtagtccaagtttacacagtacgatagacttacccattgccaaggttacttggcttgaaggaaaatacagaataaggataaaggcagtatgcacaagaacagcttgatggagatttcaggcactgaaactcagcttctaatatcttaacccccaccaggataattttgctgatgaaggatgaaagttgatgccagtataggtcacatccatgcccggtaacaacagaattgggtatccttagtttaaatactttagttgtcaccttgaacttggagggtgatttatgtgatcatcactattatttgctgttttctattttctttagatttcatttaatgttttactagtttcttgaattagaaatttggataattgatttccaacagttttttatttctaattcattcgagttatatttttttctctctaatcagtgcttcagcatcagcccacaaattttaacatatatttccattattgtttatttcaaatcatattctcatttatattatatttttctttaactcatgagttatttataagtgttgcttgccaagtgcggtggctcacgcctgtaatctcagcactttgggaggccgaggtgggcggatcacttttgggaggccgaggtcaggagattgagaccatcctggctaacacggtgaaacaccgtttctactaaaaatacaagaaaaaaaaacccaaaaaatagccgggcatggtggcgggcacctgtagttccagctactcagatggctgaggcaggagaatggcgtgaacccaggagtggaggttgtggtgagctgagattgggcactccagcatgggggacagagcgagactccgtctcaaaaaaaaaaaaaaaaaaaaagggttgcttaacttcaaaaattttgtgaattttccacttattttctgttagcaatgtctagtggtcagggagtatacttagagtggctttaattttttgagattggtagagatttgcttggaatgaatatgcatcttgcaattgttgaagacagtgttttattaatataaaaaacttaatttggttaataatgttgcttatatcttgtatatccttatttttctatttcttttctattggatattggaaacagtgtgcttaaatctcaaactatgatggtggattgcttacttcttttatttctgttatattttgaagatgtattaatagttttatgcaaagaggcatgctggtaaatgtaaaacaaccaactattttttaaaaggaaagggaacaaccatgatttgtaaaatttgctgagtttcatggtgtaaattctcacaatatggtcaatttcaagttaccaacgtgtcatcaggagacattgtattagcaaaagatgtgtataattggctcctatgagtcagtatgagccagctccagcaaacattgttcagacacatttgcaattattacatctttctgttaaagtagcctttttattaatatgaaatgactctctttttatctaataatactttctaactaaaattatcatttgcttgatattaatacattaatatcattcttactttggttgatacttttctagcatattggtttttatcatttactctcaatttatatgtacaattttattaaaagtaatcatcatatatttgagttttcttttatgcttttatccagtcagacaatctttgtatgtttagtatggtgatgaatccatttatatttaatgtaattactgatacagttcagtttaagtctagcatattgctacttacttttgcctcaatttttctctcttcttttcctgccttctcttattttaatcaaatagtcttgactatctcattacatcatgtattctagttattttatgtatctcaatattattggtttagtggctaacttagcaattacaacaaaacatgcttaaattattacaatttattctaaattaatatttttaccacatcaagactatggggaaaacatcacaacacttttattttctttaccttttcctgacacttttgctactattgtttcatattatactcttgaatttattaaaaacactattaaacatggtctattgatttaaacagtcaaggctcttttttatttgagtaaaatatacatagcatagggtttatcatgtttcaatagcttttttatttactcttctatttattttcttcagttctgcttattcctttttgtacttctttgcttatattttagatcagtttccttcagcccagagaacttttttagtatttttctatagttgagtctgctcttgttgaattctttctgcttttgtttgcttaagaatgtgtttctatttgctttcatttttgaagtatattttcaccatttatagagttctctgctgacttttaattttcagcactttagtaatgctaagacatatatattcagacttcagtatttacttccacagacttggctgttatttttactattctcctggaaaaaaaatgtttcctctgtctgtgatatggtttggctctgtgtccccacccaaatctcatcttaaattataatctccataatcatcacatgtcaagggaggaactcagtgggaggtgactggatcatgggggttgtttgtcccatgctgttctcatgatagtgagtgagttcttatgagatttaatggtttaagcatctggcatttccccaacttgcacttctctctcctgctaccatatgaagaagatcctctcttcttcttcaccttccactatgattgtaagtttcctgaagcctccccaaccatgtgaaagtatgaatcagtttaaacttctttttttatgaactacccagtctcaggtaattctttatagcagtgcaaaatggactaatacagtaaattggtaccaaggtagtagggcactattataaagatacctcaaaatgtggaagtgactttggaactgggtaatgggcagaggttggaacagtttggaggtctcaaaagaagacaggaagatgtgggaaagcttggaacttcctagagacttgttgaatgctttagaccaaaatgctgatagtgatctggaatatgaagtccaggctgaggtggtctcagatggggacaaggaacttattgggagctggatcaaagatcactctaactgtgttttagcaaagagattggcaacattttgccccttccctagagatctgtggaactttgaactttgagaaagttggtctgaaattggaacttatgtttaaaagggaagcagagcataaaagtttggaaaatttgcagcctgatgatgcaatagaaataaaacccgaattttcttgggaaaaatgcaagcccactggagaaatctgtgtaaggaatgaggagccaaatgttaatcaccatgacaagggaaaaatgtctccagggaatgttagtgatctttaaggcagcctctcccatcacaggcctggttgcctcggaaggaaaaatggttttgcaggcctgggccccactgctgtatgcagtctcaggagttggtggcttgcatcctagctgcaccagctgcagccatgtctaaaaggggccaacatacagcttgggccattgcttcagataatgaaagccctaagccttggcagcttccacatggtgttggtcctgtgggtacacagaatacaaaacctccacctagattcagaaaatgtatataagtgcttagatgtccaggcagaggtgtgctgcaagggaggaaccctcatggagaacctctactagggcaatgagcaagggaaatgtaggattggagcccccacacagaggtcccagtggggcactacctaatggagctgtgagaagagggccacagatcctccagatcccagaatggtagattcactgacaggttgcaccttgtgcctggaaaagccacagagactcaatgccagcagtgaaagtagccagggcagggggccataccttgcaaaaccattggggcaggtctgcccaaggctgtgggagctcacctcttgcatcagtgtgacctgaatgtgagacatggaatcaaaggggactgttttggaactttgagttttaatgacttccctattggatttctgactttcatggagcctttggtccctttgttttagccaattcatcccatttgggatgggagcatttacccaatgcctgtattcccattgtatcttgaaaatgactaattttcttttgattttacaagctcatatgtggaagggacttgccttgtctcagatgagactttggacatggactttagggttaatgctgtagtgagttaagacttggggggactgttgggaaggcatgattatgttttgaaatgtgaggacatgagatttgggaaaggcaaggggcagaataatatggttaggctctgtgtccctacccaaatctcatcttaaattgtaatcaccataatccctgtgtgttgagggaaggacccagtgggacgtgcttggatcatggggcagtttctcctatgctattctcgtgatagtgaatgagttctcatgaggtttgatggttttataagcatctggcatttcccctgtttgcacttctctcttgccatcatgtgaagaggtctttccttccccttccaccatgactgtaactttcctgaggcctccccaaccatgtggaattgtgagtcaattatatctcttttctttataaattacccagtcttgagtatttcttcatagctgtgcaaaaatggactaatacaatctgcttttaagattttgcctttatctttggttttcagcagagtatcagtataggttttcttggtatacagcattttgggggtttttagaaattttgattttgtgagctgatttctttcatcaattttggaaacctttgagctattgtttcttcaaatattgcctatgttcattttcttctctattgttagaattccaattaaacatgttttataacttgactctacaccacacatttttttatactctgttttgtttgttgttgtttatacacttttgtctttctatatttccttttggttatttttacattaaacttcctctaagtttaataagtttgtattgtgctgtgtccatttgattcttaaaaccatctgacaagttgttatttctgatttttgatccaattttaagatagcacatgatttatgagtcaattttattttgaatatcttttttaaattttcatttctatattttctatagttcctttaatgttcctaaaatagctgttataaagacctaacactaattctaacatctgaatctgagtgtctagttctactgaatatttattttctctttttgttcacagttgtttttgcttttttgtgtatcttttaatttttattcaaaatcgtatttttaaacaaaaacatgtaatgacaaaagtttatataacttactctcatcaacaagattgtttgctctttcttgagccactcaaaaatttaactcagagggacctgggtaacacttttagtttgagtcagtcccatttctggtttctagtctcaaagattaaaccctcttgggtttttaaagtcaagaatctggttggtttcttctatctcaaaagactaatacacacacacacacacacacacacacacacacacacacagagtatatacatatacacatatatatacataaatataaatatgtgtatatatatatactatatatgtgtgtacatatattagacttttgagatagaagaagccaacacatatatattatgtatgtgagcatatgatatatatataataaaagccatttatatatatgtttgcttttctgctgttttgactctgttcttatatatatataatcttaaatgctcatatataaatgaaacagcagaaaagtgaacatatatataagagcttttattatatataaataatatatatatgtatacagcttttctgctgttttgacatctgctcttaaatatcatccagagtgactttcaaatatggcatgttttgatgagaatactagttgtgtatttgagtcagatccattttcttattgagactttttttctatgagacaacgggaaagtcagtcttcccgtatgaagctacctagactctagcaaagcaacctgatttggcaaagtttcagaattcttcatgctagatatagcctccttatgtttggttctttcttacctcattaccattcttccattcagactaaatagaggcctgatcttcaatccatatccagagctgacaaacataaccaggtaaaaaatggccagagaccctatatttacttgaaacaggtccttcctacttgtgttttgttcatttaatcctctttgctcccacaacttacctttgaacatacacatgcacacacaatttgttgttgttccaatttggagtagaaacattgttcttttccatcctattctatcttatttggagtgcctgtataattctgtattaacttatcatgctaatttttgtaaatataatttttctacctgtaatgcatattatacatctctttgattacttaataactggcttccctaatagaatggaaatgctttgagaacagatagtttgtttcttcattgttttttctttataacttagaatagtgctcaataaatatttcccaaattaatggaagaatagtagaatgctctccagcaattaagagtaatataacaaaatatatctattgctttgcaaagttttttaggtgtttttccacagtgaacattcttataaaattatgtagatacaaattttataaggtgaaatgtatagttacactacatgcatgaaatgtatgtttactccatagatatggggttaggagagagagagagagagagagaaatttagatagacctgtgactgtctaggcatttttaaaagcaacaattacctaaatatactgtacatttaaatagacactttatgcacttattttgtttttattgtttgtagattgcaatgaacttcctccaagaagaaatacagaaattctgacaggttcctggtctgaccaaacatatccagaaggcacccaggctatctataaatgccgccctggatatagatctcttggaaatgtaataatggtatgcaggaagggagaatgggttgctcttaatccattaaggaaatgtcagagtaagtacttaatacatttgtgaaatttatgaaaactaggtgtaaaaatacttaagatttaatattgtagcaattatgcctgaattatatcactattgccagtcaaatacaaaataatacataatcttttttttttgttttgagatggagtctggctctgtcacctaggctgcagtgcagtggcgcaattttgagatggagtctccctctatcgcctggctggagtgcagtggcgctatttcggctcactgcaacctctgcctccctggttcaagcaattctcctgcctcaacttcccgagtagctgggactataggcacgtgccaccacgcccggctaatttttgtatttttagtagagatggggtttcaccaatgctgggcaggctggtctcgaactcctggcctcgtgatccacccacctcagcctcccaaagtgctgggattacaggcgtgagccaccgtgcccagccaatacatcatcattttcaaaaaggggtggtcatcctccaaaattaaaaaagcaagcatatagtttaagttcaattatgaaataatggctttgctatgtttaattttccttacattcaatctgtcttcttatataatatcaaatatacttgttcccccactcctacataaaatatattccttgctattacatactaattcataactttttttttcgttttagaaaggccctgtggacatcctggagatactccttttggtacttttacccttacaggaggaaatgtgtttgaatatggtgtaaaagctgtgtatacatgtaatgaggggtatgtagtccatacgaaaagaggtttataattaagatagtaaataggaactctactactttatatatttttaaggttattatatttttctatgagcatttaaaaaagtaatacacaagtacctgaaagtttaactatgatggaaataattaaatctggataccatattatctccttaacattgaaaaatttaaatgaagtataacttctctgatagagtataattatgggagagtgggaaaacagtatgcacatatataagtattcacccaacaagtcttcacgacattctattttgtgcagagtatcatgggagttcaatgtgtcaggaacaataggaattgtaaccaatttatattgtatggtaactgttttgacaggttttataaaatttaaggaaagcaagactttcacctgcttataagttttacttacaactaaggttacttaatgtcccaggtctgcaaattattcttaccacatggattaaaaatactactctttcagaatcattgactctgttccttctaaccaactactgggttttcattgccaaaatcatcactgtatatcctcagtgttattttatcccccttattctctgctagatgaaaaattattttggagaaaaatttatgtatgggaaaaccaggattagatcactataatcgtatacttcataaatataaatgtaaccaaatattacaaatggaataacattattatttccccattttttccttaatttgaagcaataaaatataatagtttaaagcttagtcactggagtaagcctgcctttcaaaactctaccacttaacatttatgggtatttaaaaatatatctcttcactaccatttcctctcctacaaaacagacacattttatgtgcatcatggattggcaggaaaaataaataagacacacatctgcagcccttagaagagaccttgagatatagtagataccaaataagtataatttcttatgaatttattctctccttagtcactacctgagggaggtttttcaaatacatttttagcccttcaatcattactgctgatcttatcacacataaccaaataggttataatatcctggggctgaattttttaatttgctaccttcctcacctctgaaatatttcttttatcacaggcttgtgtcctctctttaagttcagcacttgacttggctaaggagataaaaatgtatagatctgaagcctctagcaatgattgcacattttgcacatgtcccagggaactcatattcaagtagagcattttttagattcaaagggcaggcttgatgggttactaaaattacttaagttcaacattagatggcttggatgagcagatttgactcactgggtattctcaggaaaaaatctctacgatagagatggagagatggaggcaagtgctgaaagtaaatcacacactaacaacttttggctggcactatctttattatgtagaaaccctaaggtgttcagaaaatatcagaatcatggaggacagaaatacggtctaagactggaggagagggaaacataaggttagtcgttggttactatggtatttttagcttttgttttggtgatagttcatggagcttactatattattgaatttagctaattagataattcaatgaaaaataagaatactttgtatgaaacaataatgattttgtcgtgaaccaaggattatgattattttcagtccatgcaccaagaaggagagaaagataaagggagagagaggttaagagatttttcatctatgaaaattagaggaagaagattaatgttctagagaacgttaagaaatctaagacagagtgaaggaggaggagaaggaggaaggaaaaacaaacaagaaacaagaaacaagaaaatgcatatgctgttcattttccttaatatggagtttctggacactcagaatggcatcgagtttaaaactgcatgtaaacacacattatgtcaacgttctgttattttttggttttcaggtatcaattgctaggtgagattaattaccgtgaatgtgacacagatggatggaccaatgatattcctatatgtgaaggtagacataaaatgtatttacaagtatattgaaataaatatctaagatttaaaaaaagtcttacattaaaatatcttaaagtctctattaaatatttttatttaatgtttttttttctcatacaatgtagagtgggaatctagtctttttattactacattcttggtgtttcaaaagccaaaaacgaatgcagcctgatctgatataataattgaagtattagacattaaggaatctaaaactgatttttatttccttttggattctaatgactagaaacgcatataagcatcattagctaaataaagaccagaattttgcctttattaatgaagaagaactcacccagtaaccacccaaatgcagggatctatggtaacagctgaagtggagaacgtgattgagacctcccactaagggaggttgcctgtggacttacctttactgaaaagaggaataaactaagggcgagctctgttatttctcactggtctgtaaagcaaacagtgaaaatgagaaaatgtagattctgttttcatgttttgagctaataatccaaatctctagtcattatggaaataaaagaaatcaaccagagtagtatttcctaattccacagtgagtggcaagtggagagagatacagaagaaacgtgataatcattcaaaaactgtcaactacagaaaataatggaagattttttcatctatgaaaattggaggaagaagattaatggtctagggaacatctacattgaaatcacctgggatgcttgttaaaaactaaaatctttggttactaaaaaatgacctactgaatcagtatctttggggtgagcatgcaggaagatagccctaaaatttttattttaacaagcatcctgagtcattctatagtacaataaagtttgaccacaactttagagaaattggaaaatattaagtagaatcaaaagaactactcaaattattttaaacacttaggtcgaagaggatggaaaattaacgatgatttctctattgaagttaatgtcataaagtttgcttttacatcttttaggaacacagtgttatattattctagggcataaatgaaaatgtatttaattatctcaagctttatatttcttaattatttaaaaatactagtttgttactacaaaaatacaagctagcattgaaagtagtaattttcattgtccactcccatagaaaagaatcaggaataaacattccatttgcttgtttcttagaggaaagtatctctagcaaacaggtatatcaaatgcttctaaaaataatttaagtaatttcctccaatcttatcctgaggatgattttatacatacacatatttttcacaataaacttttaaaattccattagaaaacattacatgtattttcttcagttgtgaagtgtttaccagtgacagcaccagagaatggaaaaattgtcagtagtgcaatggaaccagatcgggaataccattttggacaagcagtacggtttgtatgtaactcaggctacaagattgaaggagatgaagaaatgcattgttcagacgatggtttttggagtaaagagaaaccaaagtgtgtgggtaagatacacttactgttttagtatttttagctttttaaatgtaaatatacatttaaaacatcgttcattctaaggaatatcagcaatattaacaatagctaatgtttattgagcacttactatctgcctgtaattgagctaagttctttgcatgcatcatttcattttaactttcaaaaaactccatgatttacttactcatcactttcattttataatggaagagactggtgcaaagaagttaaatcacatgccctggattatcatggcataaagagtcaagttaggatttaaatgtaggttatctgacaccagagtccatgctttaaccataactccattgtagttgtctcttaggttgaaagagaatgctaagtatttctgctgcaagctgtaagacctctggaatagacatttgtttttattttgaaagccaaagattcattatgtatttccagagatacattagaatgacattcgtttttgaataacacttttaggaagcagacctattttatatttgtactgcaagtttactataaatgttgctgaattgaacagaatccactaaataaattgttgcctcttaaaaaaagttttatagtaaactgtaagccaggatttttttagtcataatactgccaacctgtgcatcatgaccaatcaaagattttggcttctgtgataaacatcgtggttgatttgtttagtagtaccatagttcaagttcattttaccaataattgtttggcagaagtttctggcatatttatattttaatattatctaaaatatctaaattatttttactattaaagtctgttatatcttagatacagataaaagaatttctcttcttaagaacactttgtaacaacaatagttctttatgttaaatctaatatttttattcagcatagcaaatattatgtactttagaagtacatggatggaatttacatccttacaactagattcctgtggttagtgaaaacttcctggaatggctgatgcctacgattaagtcttaaagaaaaaaaacgagattttgtagatgaaaatgagagcaaaagcataccagagttcagggaaagggaagtggaagggcagtgaggctttaaggagcatgaagcaccactgattcttgtccattgttcctaggcaccttagtctaggatgcaagtagggaacgagtcagtgataaatagaaggtgggccaatacatagtgctgaggtgctgcatgcaccatgctgaagaacgcgtcttttattcagattgatttgggaatcaatgaaggatttcaagtggagttacgatgtgtctacctgagaggtcattaagctatacacaaggaaaatggattagaaagtgggagaacagagtttgggaaactacttatgattggcacaatcccaggtaaaaatgtttgagagaagtgggtataaaaggtataaaagatgatggccattttttttttttctgaggaaatcttggctaaatagtgatgacacaaaaacaggtcagttacttttcagagatgtaatgacaatgagttaaatcaatgtctttgacaaaaagtcctgttgataattcctgtcttatcaataactagaagatgtgttattttttgcaggtcattcagtgaaaacatcacaataaaactatatttatgatcaattttatttatacagttgatgaatgttactggtcactatttatttcaagaaggctaatttatcctgaaactaaataaaatcagaagcataattttaatcagaattttaactttcttcagataaatcatttattaagcggtcaagtcaaaacagaacttttgtttggttgactgatttacctgatggaaacaacatttctgttttcatataattatgtcctggtcacagtcctttaatttgcaataaacattttggaatttaatcccttttatttagaaatttcatgcaaatccccagatgttataaatggatctcctatatctcagaagattatttataaggagaatgaacgatttcaatataaatgtaacatgggttatgaatacagtgaaagaggagatgctgtatgcactgaatctggatggcgtccgttgccttcatgtgaaggtaatgttacctttattttctggatctttataaatttatcacatattttaattaattcttttaataaatccacttattttaatcaaaagtagagtgctaatttatgtaaataaactattataaaaaacatatagcattttctgtgttcaaggttcattttgagtacacttcgtacgatacacacactctgaaaacagacataaacagggccagaaaagttcagtagcttattaagtcattggtctatcatcaaaaaccatgtctggatcagagtgaggactataatagacttcctaattctcagtaacatacaattctcaaacaagtagattgctccactaatgcccagaatttatttaaattatatgaatattttaaaatactttaaaagtaacttgtattaataccaggtgaggaaactctcaactgacaatggaattaagttgaaggaagtgaatatttttgttaacaacaggcccagtatgactcaacggtgatgatggtcctggaaaattaccaaaaaaaaaaaaaaaaacctctcaactttcattatggagggatgttacacagagccaaagagttcatctcaactgtgctctttgcccaccaaaaaatatatctggaatagagtgttctacttaacctacttcattttaaacgggaaagtttcaaactatcatggccaagaagagagaatatggacagttgtggacttttaagaaattatgccataagacgtacagtaagaagctacagctatagtgtggtgataacagttttgagatattttcaaacatttataaaataagtgggtttgcttttgatgaggtctgctgcaattagtgaaacaaggaacagtgttaccacatatggtccagaaatctaaaagggtgatactgccatactgtgagagaaagaagagttgaactcttaagagccctctgaactttaaatcccatgattcataaatacatgtttaaactgtgctttagtaatcctcttttacaaaagaatagttaattttgggttaattttatacactaaaaaaattttggtttgagcccacaagtgtctccttggaaaacatatttttcttcacaattgcgtgatctctacttttaggcactgttaagagaatattttagaaagaaattaatgaacatgagacagtaataacccacatcagatccatgtttggctaatggtgtgtggggtccaactatttgtcttcatggcattcgtagttcctaagcaaaggaagtgcatgcacaagtcctttggcattaacttctacctgaagtatattatttccagagcccctctcaaatctatagtgaatttatccatgcagtaatcaaaatgtaacttataaaccacttattttacatcaggaccttgctgtgtattgaagataaacattgcaataaaccatcattccagctttcaatgaattcaaaataagactctgggaatttagttttatttgaatatgtgactctgtagcattactacctcattgtagtcatctgattttttcgtctcttttacttcttcactttgatacctacttaaaactcttccttagcacatatttgttttcacaatgagagatccatctgtttttcccaaatgtattactgcatttctattcttgcttctcttgaacactaattgattcacacacacacacacacacacacacacccctcaaagactctacatttataaaacatttttcttttataatttttttccatttctcagtcacaagtacaagtaaaacctgaatattcaatactatgcttgcaggtcctgctttctttaggaaaagagataccaagagaaggcactgggattgggtactccttttcagaagacagttcactaataatcgatataaataaaggaggatttatcccaaattagttaagcatacactctctcaccacgttttattttattgaaatatactttacgctgattagatatagagaagtctttcttaataaaagaattccactctttgtatgccaactaatatagcataaatatgactattttcttggtacaaagcaaggatctacttgctgatataagatgaattcaaaatctatacacatcattttctctgaaatcaggtaacttcaaactctctttgttgcttctaaatctataagaagtttggaattaaataataagataatattaaagtgaaataatctacttaaattttaaatactttaattttcttcaatctggtctatggcacacacatgtcagaggactgatttaaaggtgaattgtcaaaactttggtctctgtgtccaatagggacaatctgtaacagaaagttatttatagaaacaatcaaaggtacgaagaactgctaaaggaaagctatctttgatccgaatctatctcttccctgtacagattggattttctattggttcaaagcatagagtgctaaccttgaattagtattctaacttcaaatgaccaatggttgtttccaatagtaggaaaatatggatagtctcaagtattgttttggataaaggtacaggttcgggcaatgttttaataacatgatgtatttttaaaaagattatgagtgtaggaaattaaggtttatcacaggatttatgtctactgcttgagcataatcaccagaagtctttctattcttaattaacaaaattgttccatattattttattgatttcttagttaaactcttgttttttgcatctcatagcttttgacttcaaaaattggtattaaattgagctatatcataaggaaaaataattgaagatacataaactgaactttaatgggtatatgaaaatatgatagagaagaatgaagtgacagaaaaaaagaaaaaaggaatacatttaggacttatttgaagttagtgtcaacatcaaacactgaagacatatttttacataaaatagtaaaattttaaaatagtaaagctttaaaacttgtatattaagtcacatacatattgtttctcatataattattgctaatctaaatatattatcctgttagctatagagatatattaaagcttattctgtcagaacgaagtataaacttaggagctgaatggacacagtggaagtatggtattgagaagaggaaatatataatgaataattaaaactttataaaattttatgtttgactaatatacaacttatgagaaaggaatggtggtagtatagagaagaagtagaaaaatggcaggagatgagatgtgacaagtatgcagggcccaaaaattaaaaaattaagtaaagtacaagaggagaagcaaaaaatataaagtaaaggaaaataataagatataaaagaaaagcatcacttagacaaagacaaggagaagcaggagaacataaatatataaggtaatggagaacaccaaaaagtatgtaatcaacagagtcaaatattacagagttttatctgttcagttcaataaataattaagaagtccataatatgtaccagtgactggaatatgtgaaatgcaaagcatttctgaatttggacattgggctcattggtagcttttatcagagcaatggcaacaaaatagaggtcagaaactaggtagtagtgagttaaagaataaatgtgagacgggaaagtggagacagcaattataaaatggtattttaaggattttggttttgaaggggaggagaaatgtagtacattagctaaacttgaacaaagggttgagtgaagggactgaaaattggaaaagcttccatatcaatttaagagtgtggttgataaggtaagaaagagggaaggaataaacaatggtttaaaatacaggggaaaatgaaagaattaaagctaacctgaatttgaaagcaacactttaccactgaagactaaactaaagacttaaatcagtatagatacagataatgttgaggagtgctggaaagaagtataggaaactcactactgctggtctcaattgttttgtgtgaatggagacttattatctgttgatgaagaggcaattgtttcaggtggcttgagaaaagagaggagactatggatcatttaccatgggaaatcaaatagtaaataaattgggggtatataaatggatttcaagcaatgctgaatgtttgccacagctttttagtccaaaataaaatatgactccaatagaagtggtcatatagtttttctacaatacttaaaatgcatagtattttatcttaaaacgaattttgcaaatggatccaatattgagatatagcagagttaatggaaaggagtgagaaggtgccttatagattaagatacactgggccaaaggatggcaaactataggctgcaggtaaaatacaacttgccccctttgtgtaaacaaagttttattgaaacacagccaagttcatttgtttatgtattgtttttcattacttttgtactataatggcagagttgagttgttgcagcagagacattttatctggccctttacggaaaaggttttccaaaccctctgctattttatcctattatagtaagaaaaatgtaatgcagtatctcaatgtttaagatattaagactgaagtttattttcattcatgttcactgtcaatgtagatcagaagggactttactcattgtattaattgtaagaatcaagtgacagaaacatcattttttttcatgtccttctttaatcgcggtatctttgggaaagagaacataaaaattcacacaatggcttttaaaacttctctctaaagtggaagatattacttccacttttattatagtctcctacgcaatcacatggccacagttacttcaaagaggaagggttgcgcagtcctatcaattgtccagaagaaagaaacactgaatatttgtaaacaatccttatgagaaccacagaaaccaaagaatagaaggaaagtgaaagtaagaattgaagttatatgtgatgagaacattgccagttatggaaaatcatgaagtatgggatgactttggagaagaagggattaagagcccaggaggtacaaatatgtcagatgagaatatagtgaagggaaaaataagtgatataccagaaaggatactatgatatgttcattttaatgccattttgtattatgctaaggacaaataaataacacccacttttaaatgtttatataaatgattaattttaacggatacttatttctgcattatccatatatcctttttcttttcagaaaaatcatgtgataatccttatattccaaatggtgactactcacctttaaggattaaacacagaactggagatgaaatcacgtaccagtgtagaaatggtttttatcctgcaacccggggaaatacagcaaaatgcacaagtactggctggatacctgctccgagatgtacctgtaagttccattcatatcttgacccatttcttaattctgaaatttcttttaaacacataaaaaatagggactcaataaaaccaaatatttgtcttattgtatatacaaagtaaggctgttggaagcattctttagttttcgaagttgccgaaactcatattttttgctactcaaaattaaatgtgtatgtgtgtttatgaatgtatgtttccctaattaataaattattccaatatctgaattaaaacactagataaaaataatgtcatctaacacatactatattagttatttattgcattgtaacaaaataccccaaaaacatatttacttaaaacaactaacctttattatcttacagtttctatcggtcagtaatctcaaaatggcttatataagtagttgtgaatcagactgtcttcttgtgttgcaatcaggatcatggcccaggctacagtgatcagaaggcttggctgggaaggaggatctgcttctaacattactgacacacatggctgttgtcaggaggcctcaggtccttaccacataggcctttccatgagttgataaatggcagctttctccagcactgctaatctgagaatagaggaagccacaataccatgtattagtgtgttctcacactactagaaagaactacctgagactggataatttatgaagaaaagaggttaaattgactcacagttccacagcctgtacaggaagcatggctgggaggccttaggaaacttacaatcatggtggaaggtgaaggggaggcaagcacatcttaccatggcagagcaggagagacagagagcaaaggggaaagtgctacacacttttaaacaaccaggtctcatgagaactcactcactatcatgaaaacagcaagggggagatccacctctatgatccaatcacctccctcaacattgggaattacaattcaacatgagatgtgtgtggggacacagagccaaaccatatcaattatctactcacacactgttaacttcagccatatctattctttcgaagtgagacactaagtccagcatatatccaaggggagagaaattaggcaccactatttggagggaggagtgttgaaggactccaagtcttagtcatttcctagtgttggaggtaatttccaaaaatcatcacatgtagcaaaataccactcaagtcaatagagtattttatttctgggatgctcctttacccctttttaatgttttttctatctctacaatcaaatttcttttctttctatctataagtacatagacaagaagtactacacttaaactatatattccatgaaagaaaaatatgatacaaatgattgattaatgacttcaactttaattcctggcataattccaatccctaagagaggaagctattatcagtatgaaacatttcagtgtgcataagaattatgaggaaaatatttaatgattttatggttggcttatgacaatgtagttcagcccaaatgtatctaaaccaactgagacccaactatatttggatttcaattattaatgtttgacaatgaaccatctggagttctcatggacaagatagaggagttgatgagttatatggtttatcagtttttaatttcattaaataaccatatctaattatcagacgcatgactttattctcaggcctgcttcattactcacttgtgtcattgaacagtttaatgatttaggggaagtgcagtacaaattcacaattggaatgatacagaggatgataataaggaatctgcattagggcagttcagcattcaaagagactcttatgtgctaagctgaatctaataagatgaaatttaacaatgttgactctaagatcctggacttgggtcaaataaattacagtatgaatatattagcagcagttataaaaattagtgaatatttttatcaattttaagatctgtttgagccaactttatgatggaaacaccataaatgctgtgaaaccaaaaactacatttgtagaagtgtaacaagtagaatgaagctatttgaagtccttctattctcagcgctgatgagactctctgtgggtactaatatttgcttcaaggaatcaatttgtaaaagggataaaaacagatgtaaatgtgaccaaattagagaatagctaaatagctcgagcctgtggtaatgttatatgtttttaattatgcctcctttttattccttttggaaagaaatctcggtggacaattttattttatgaccttctgggaaataccataataagatggatactcatacttgctttgaaatcaaccacaagctttgaaatctctactctaccatttaatgtgaaattcaattgaggcctttaaggcacagctcccacaaatccaagactcaagctttcccaatgcagaattattgttaaataatacatgtctcaacaaatcatgatgaaatttgtaaaatccaatggtaaatagaaaatattccaaatctttaaaaagtggtgaggaaaaatgtagaatgttacttaaaagaaataagactaagtaaatgttttaatttcaacactgggagcttcagataaatagggaaaaaaatctatcaattataagatatatggattgtaggccaagaaactatactgaaagaagtatcattcactagtctttattagagaaatacatttaagatatacaattattcagtttataatccacataataaatgtagaaactacatgaaaatttctctaatcaaatacaaaagaaaataaatcacagaatttaagaaagatggagatgtaaaagaatatttatatgtgtgtgtgtgtatgtgtgtattgaaattctttttaacctattgcataaggtttattgaaatagaaacatatttcatggaaaacattaataccattttgttattgaaagtactagataatctacaaataatcccatgaaaagagcaaattttctgaaaaatatataaacctgttaatataataaacaagatagcactcaaatgtatttgtcaaaattaatatataataactcagtaaaatgtaattatattgtaccttacttaaatatattttatgacatcaaaattatttttctctccaattaaaattagaaataaacaaaaaagttaatcaaaatcttaactatttggatatgaagaaatatttctagtctgtttctctggttaaatacagactggagaacttggcttaatgaattgtttgaggcatgaattaactatgttatttttctgcgcggtatcatcaaagaaaaatttttgtgtttctctatatttttacgttgtctgcaataaataggaaagagcctaatttatttatttacttatttatatttttcgagatggagtctcactctgtaacccatgctggagtgcaaagacacaatctcaattcactgcaacctctgcctcctgggttcaagcgattctcctgcctctgctttctaagtagctggaattacaggggcgcaccaccaggcccggctaattttttttgtatttttagtagagacggagtatcaccatgttggcccagctggtctcgaactccttacgagtgatctgcctgtctcagccttccaaagtgctgggattacaggcgtgagccactgcgcccagcccatgaattcaatctaaaacaaataaaaaccttaaatccctcaaaatactacttccttacattgaattgttctgagaagaaaatgcagggctcttgtttactgatgagaatagaaaaaaaagaaagaaagaaagaaagaaatacatgagctaagcggtaaaattggcatatttctcaaccgaaaagcttatttaattaaccagggatagggtatgtgtatttaagggaaatatattaaataggtctgtgcatttttctttctggagagccttcatacaaatttacgcatcatgtgatccacaagacataatttcatcttcattaacaaagaccttcttgttacatatctcagtcatctgagttctatcatttgttttgacctagaaaccctaatggaatgtgtaattatactaagaagagaatataattcagtgataaaaatttatctctaatatgagtgtttattacagtaaaatttctttatactttttttaaaatttttattgcaagtgaaaccttgtgattatccagacattaaacatggaggtctatatcatgagaatatgcgtagaccatactttccagtagctgtaggaaaatattactcctattactgtgatgaacattttgagactccgtcaggaagttactgggatcacattcattgcacacaagatggatggtcgccagcagtaccatgcctcagtaagtaaacctctgaactgctatatatatgtataaaactttcaaagatcgaagaaaggagagcacataagtgattacacctgtcttatgtaacagaaatagggccaagaaaagagttgttcaagcaaagtgaccaaaatagatcttttctattatgagggtttcttcttgaaaatcacaggagaaataaatatagggactttatgagaatatctatataatttatacatctattaattataaaaactaaagataagtaatattgaatattgatatttctttttgtgcaaacctttgttagtaactttagttcgtcttcagttatacattatttttggatgtttatgcaatcttatttaaatattgtaaaaataattgtaatatactattttgagcaaatttatgtttctcatttactttatttatttatcattgttatggtccttaggaaaatgttattttccttatttggaaaatggatataatcaaaatcatggaagaaagtttgtacagggtaaatctatagacgttgcctgccatcctggctacgctcttccaaaagcgcagaccacagttacatgtatggagaatggctggtctcctactcccagatgcatccgtgtcagtaagtacactactctgaaatcctagcatgttcatgtctttctaagtaacatagatgacattctaagactcatctatattaattgtggcaaaatgtttatgtcaccttgttttaccaatggacctatttagtttttggtttttcaactgtgtataaatgaatatacaaatttcttgataagtacatagtaaaataaattctcctattaatgggcattagtcaagaatacagtaaaagaatttgaacacaatacttgttggttaaatgaagtcgtattgaagcggcatcattgtctgggtaaatatctgaggttcgttatctcacaccaagaagattaaggacgtggacacacacaaggagtgagtttaggagcacaggtttaataggcaaaagaaagagaaaggagaacagcttcctctcttgtgagagagagcggcacctgaaagtgaatccctgcccctggtggagtgcactggattttataaacggtcttgaggaagcagtgtctgatttacatagggcccaaagattggttaaactaggtgtgacatttacataatatgccaggaagctggccgccccaccctaatcttattaatcaaatgggatctttgcctggccagcgccatgttgctttctccttactgtacacgtggctggcaaagagaaaggaagatgcacctgccatatgaacatgcctagtcccaggtagccttttcctattggcacaactgctggcattcaccttgcaagcttccagcttgcttgtctatgtttgcagttcgattttacaggctcctcttgttagaaaagaaaatgatttgggggctgcctttcattaaaaggaaaaaccttatcaaggactgctgtaccctcattatctgcctaaacaattttttctcaactcctatatcaatattaatatgtacattggaatcaatcatttgactcaaaataattatacaattatagtttaaaatagaaagtaaatacgatgatacccaataattcatatattcaagcagtgatatgacatttttacagtaaagctatttgactttctctagtatatgtaagtacaaatgggtattctgagatcttgtgcatattctactctagaaggtttcctacagtatttattccaacatacatttatatcaacagttacttctttttttacatgttaatgattggtgatgtcacattttaatatttacaaattgaatggctataaaatgttataacattatagtgtaaatttgcatttcttttaccactaactgggtttagaatatatattcacagtttaattggtatttaatgcttctaatctttggaaatgcagtttgattttctttatttacctttttgagagttttggtattattagttggaatcatcttaacaattctgaatataaaatctcttttaattatacgtaatgcaaatgtattctctttgtggctagtatttttctttccttttttctgcattatgaacataagttgctcattctactacataatagtcaatcttttttcatgatgaatgtttcttgtttctatttaaaggaatacttcaaaaacatagagccactatactattctttattctaaaaagttataagttaccttttcttttcatattttaaaaatattttgtgttgattttattcatgataatggctgtatttcatgtttaaatgaaatatggtaaactcaacatttccctaacaatttttatagtacctttctcaaacagtatattttttattgtatattttgtacattgtgtgtgtatacacacacacaataactattactctgagtattctgcactattagtaaacaattttttaaccagcattgcagtaaccctctattgaattttatttatttattttattttgagatagaatctcactctgtcacccaggctggagtgcaatgtcgcgatctcgcctcgctgcaacctccactccctgaattttaattaatataggtttttaataagtatggatatgacttttcaccctaatcatgacctttcacccaaatctttttgcttcatcagtctcttttttgtctcatcattcagtgtcagatgatcccattacttttatttttttcttcacagattaattgaggctaataatatgccttgattagatatgcaatttctcctgatatcaaacaactcaatcaacgtttatgcctcttggtttgattttggagctgattgtagaatcaactacttattttttctctttctttccttccttccttcctttttctttctttctttttctttttctttctttcttctttctttctttttctttctttctttccttctcttccttctttctttttctttctttcattcttttttctttcttcctttctttgtctacgtttctccttctttttcttttttctctttctttctttctctttcccttcctttctttttctttctttctttctttctctttcccttcctttctttttctttctttctttctttctttctttctttctttctttctttctttctttctttctttctttctttctttctttctctttccttctttctttcttccttccctccctcccttccctccctccctctgtcacctccctccctccctccctccctcccttccttccttccttccttccttccttccttctttccttttgtcccaagtttgtctggctcaagttattcttaagaatgttactattttactcttcatgctagaccctgtactttagtcaggttatttagctactttacggttgtcatataattaacaagtcttagcttcatcttcagattgagatatcaacgttatattttcatgtacagtcaattgtcagtgaatcacattgtttttcaatttaataaaatctaaattcctcataaccatgttgtgagaatatgcagaaaaaattaaacatacttgagtgagtacagtagatatatattggagtgtatcctttatgaatgcaaactggctgtagtttcctttaaaatagtcatttaaataaaaaatttgccagataaatcacagaatatcaatttctcttgacttgtaaaacttgaattactagtgccatctgaatgattcttctgaagatagacagagtagtctctacttacctgtgagagaaaaaagctgcactagtccctcttattcatgtgggatatgttccaggctccccagtaaatgcccgaaatgattaatagtataaaacccaagtagactatgtttttccacctgataacttggaatactactaagtgactaacaggctggtgcatacactagacgaagggaggattcatgctctgggcgggatggagctgaatggcataggatttcatcaaagactactaagtgactaacaggcaggtagtataaactgtggatgcactagacaagaaagtattcaggctctggggagaatggggctgaatggcataggatttcatcacactacccagaacacctttttttattgctaagtattattccattatatcatgtatcacggtctgttaatccattcatgtgttgaagggcatttgcattgtttttggcatttgtgaatcatgctgttaagaaaaatattcatctgcagtttttatataaacacaaatttattcctcatggatacatatctaagactgggtttgttagataaatggtgtgtgtgtgtgtgtgtgtgtgtgtgtgtgtgtgttttattattattatactttaagttctgggatatatgtgcagaacgtgcaggtttgttacataagtatacgtgtgccatggtggtttgctgcacccatcaacccgtcatctaggttgtaagccttgcatgaattagctctttgtcctgatgctctctctcccctttccccgcacaccccaacaagccccggtgtgtgatgttcccctccctatgtccatgtgttctcattgatcaactctcacttatgagtgagaatatgtggtgttttgttttctgttcctgtgttagtttgctgaagatgatggtttccagcttcgtccatgtccctgcaaaggacacgaactcattcaatttatggctgcatagtattccatggtgtatatgtgccacattttctttatccagtctatcattgatgggcatttgggttggttccaaatctttgctactgcaaatggtgctgtgataaacatatgtgtgcatgtgcctttatagtagaatgatttatattcctttgggtatatacccagtaatgggattgctgggtcaaatggtatctctggttcttgatctttgaggagttgccacactgtcttccactatggttgaactaatttacactcccaccaacagagtaaaactttcctatttctccgcatcctcgccagcacctgtggtttccagatgttttaatgatcggcattctaactggcgtgaattggtttctcattgtggttttgatttgcatttctctaatgaccagtgacaataagcttgttttcatgtatttgctgactgcataaatgtcttcttttgagaagtgtctgttcatatccttcacctactttttgatggggttgtttgtttctttcttataaatttgtttaagttccttgtagattcttgatattagacctctgtcagatggatagattgcaaaaattttctcccattctgtagattgcctattcactctgatgatagtttcttttgctgtgcagaagctctttagtttaattagatcccatttgtcaattttggcctttgttgccattgcttttggtgttttagtcatgaagtctttgcccatgcctatgtcctgaataacctactgcctaggtttttttctatggtttttatggttttaggtcttacatttaagcctttaatacatcatgagttaatttttatattaggtgtaagggaagggtccagtttcagttttctgcatatggctagccaattttccctgcaccatttattcaatagggaatcttttccctattgcttgtttttgtcaggtttgttgaagatcaaatggttgtagatgtgtggtgttatttctgaggcctctgttctgctccattggcctatatatctgttctggtacaagtaccatgttgttttggttactgtagtcttgtagtatagtttgaaatcaggtagcgtgatgcatcagctttgtgctttttgattaggattgtcttggctagatgggacctttttttggtttcatatgaaatttaaagcagttttcttagttctgtgaagaaagataatgatagctagatgggaatagcattgtatgtatcaactactttgggcaatatggccattttcatgatattgattcttcctatccatgaggatggaatatttttctatttattttggccctctcttatttccctgagcagtggtttgtagttctccttgaagagttccttcgcatcccttgtaagttgtatttctacgtattttattttctttgtggcaattgtgaatgggagttcactcatgatttggctttctgtctattactgatgtataggaatgcttgtgatttttgcatattgattttgcatcctgagactttcctgaagttacttatcagcttaaggagtttctgggttgagacagtggggttttctaaatataccatcatgtcatctgcaaaaagagacaatttgacttcctctcttcctatttgaatactccttatttctttctcttgcctgattgtctggtccaaaactcccaatactatgtccatcctagacagatcaacgagacagaaaattaacaaagatattcccaatttgaactcaactctggaccaactggacctaatagacatctacagaactctccaccagaagtcaagtgttcttcttggcactacatagcacttattctaagatcgaccatataattggaagtaaaacactccccagcaaacgcaaaagaacaaaaaccacaacaaacagtctctcagaccacagtgaaatcaaattagaaatcaggattaagaaactcattcaaaactacacaactacatggaaactgaacaacctgctactgaatgactactgagtaaatattgaaagtaaggcagaagtaaataagttccttgaaaccaatgagaagacagacacaatgtaccagaatatctgggacacagttaaagcagtctttagaggaaaatttatcgcactaaatgcccacatcagaaagtgggaaagatctaaacttgacaccctaacacctcaattaaaagaaatagagcttgatggggatggcattgaatctataaattacctttggcagcatgccatccccatcaagctaccaatgactttctttacagaattggaaaaaactactttaaagtttatatggaaccaagaaagagcccgcattgccaagtcaatcctaagacaaaagaacaaagctggaggcatcatgctacctgacttcaaactatactacaagcccacagtaaccaaaatagcatggtactggtaccaaaacagagatgcagaccaatggaacagaacagagccttcagaaataatgctacatatccacaaccatctgatctttgacaaacctgagaaaaacaagaaatgggaaaaggattccttatttaataaatggtgctgggaaaacaggctagccatatgtagaaagctgaaactggatcccttcgttacaccttatactaaaattaattcaagatggattaaagacttaaatgttagatctaaaaccataaaaaccctagaagaaaacctaggcaataccattcaggacataggcatgggcaaggacttcatgtctaaaataccaaaagcaatggcaacacaagccaaaactgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcagcatcactggtcattagagaaatgcaaatcaaaaccacaatgagataccatctcacaccagttagaatggcgatcattaaaaagtcaggaaacaacaggtgccggagaggatgtggagaaataggaacacttttacactgttggtggaactgtaaactagttcaaccattgtggaagtcattgtctagatcctcagggatctataactagaaataccatttgacctagccatcccattactgggtatatacacaaaggattataaatcatgctgctataaagacacatgtacacgtatgtttattgcggcactattcacaatagcaaagacttggaaccaacccaaatgtccaacaatgatagactggattaagaaaatgtggcacatatacaccatagaatactatgcagccataaaaaagaagagttcatgtcctttgtagggacatggatgaagctggaaaccatcattctcagcaaactatggcaatgacaaaaaaccaagcatcgcatgctctcactcataggtgggaattgaacaatgagaacacatggacacaggaaggggaacatcacacaccggggcctgttgtggggtggggggaggggggagggatagcattaggagatatacctaatgttaaatgaagagttaatgggtgcagcacaccaccatggcacatgtatacatatgtaactaacctgcacgtagtgcacatgtaccctaaaacttaaagtataataataataaaaaaagaattagagaagcaagagcaaacaaattcaaaagctagcagaagacaagaaataactaagatcagagcagacctggagatagagacatgaaaacccttcaaaaaatcaatgcacccaggagctggtttttagaaaagattaacaaagtacactactagccatactaataaagaagaaaggacagaagaatcaaatagacacaataaaaatgataaagagggtatcaccactgatcccagagaaatacaaactaccatcagagaatactataaacacctctacacaaataaagtagaaaatctggaagaaatggataaattcctggacacatacacgctcccaacactaaagcagaagaaagaagtcaaaaccctgaataggccaaacacaagttctgaaattgtggtagtaattaatagcctgccaaccaaaaatagcccaggaccagatggatttacagccaaattctaccagaggtactaagaggagttggtaccattcctttggaaactatttcaaacaatagaaaaagaaggtctcctccttaactcattttatggagccagcatcatcctgataccaaaacctggcagagacacaacagaaaaagaaaatttcagtctaatatccctgatgaacatcaatgcgaaaatcctcaataaaatactggcaaagcaaatccagcagcatatctaaaagcttattcaccatgagcaagtcgccattatctctgtgatgcaaggctgtttcaacatatacaaatcaataaatgtaatgacaaaaaacacataattaactcaatagatgcagaaaaggccttcaataaaattcaacaccccttcatggtaaaaacactcaataaactaggtattgatggaacatatctcaaaattataagagctattttttaaaaacccatagcaaatatcatactaaatatgtgttcatttttataagaaatagacaaactgttttcctgagcgatcatacattgtaccttcacatactcagtgtatgtgagatccagttgtttcgcaaccttgccagcctttgagataatgtgtttttttttccattaaattatccattctaatatgtgtgtgatggtattgcattccctagtgactaatgctgcttagcatcttctttgtacttatttaccatctatgtacctcctttggtgaacactgtctaaattttgcccactttccattgagttgtttcttccattacggaattttgagactacatgatatattgtggctacaagcccttcactgagtaaatattttgcaaatatttttcttgcatctgtagctttacttttctctctaatagtctcttttcatgagcaaaagtatgtaattttgatgttatcacatttttcatttatagattacgctctttgtgtcatctaaaatttccttgcctaaaccaaggccatatacagttctagaagttaacattttacacttagttatatgagttaatttttgtatgaggtatgaggaatatgtagagggttattattttgcatttggatgcgttactgttccagtatcacttgtttaaaagactatgttttctttattgaattgcctttgctccttttttaaattgaaaacatcctcaaaaaatttttaaaaacagttaaggaggaaaaagtaaaattcaactaggcttgtaggacaatcaatggtaatcattaggctagctttccattgacccacttccttatagctggtcactgattactagtccaggataacataatctttgtcactagaatctttgttctttttctgttctttagttaaaatttaagacaatatgagatgacaaactttccatttgagtttctcctttaggttctgcatactaacaaaactactgatgccagccattctgaaaggcttgacaagaaactcaacttagggaagaatgtactttccatatcctgatgatttcagcccccttacccgaatcaattgatgacctcaattttccagccactcccccttcaaagattcttgcccagaaagcttcagtgaaatgggtttgagtcttgagaattcttctcatgtccttgtttggtgaccttgcaattggtaaactctctgttgcaaactccactgtcttggtatattctgttgctgcacagcaggcatacaaaccttacaatcttataaaaattcatggcaagcacccagacatgatggctcacacctgtaatcccagcactttaggaggcaaaggagggcagattacttgaggtcaggagctcgagaccaggctggccaacatggtgaaaccctgtctctactagaaatacaaaagttgcccaggcatggtggcacatgcctgtaatcccagttacttgggaggctgaggctggagaatcacttgaacctgggaggcagaggttgcagtgagccaagatcgtgccactgcactccatcctgggagacagattgagattccgtctcaaaaaaaaaaaaaaagaaaagaaaaaaaaattcatggcaagccactctccttgcagtcatttacctacagtccagtgcccccatgccactggggctgacccagagagaagctcaagaagctgcttagttatgatgaactaagggccttagctggggccttctgtgttggcagggcagtgctgactttcagcacacaaccttgtctgcagcagagaaaccatttctggtctcagaagaagtctcaggtgagttttctcagagcagctggcaccccatttccttctgtgtgtgtgtgcctgttttcgtcttagaggtcttgtggcctctttgaggtcttgttgacactccctaagtctaggtaggaacttatttgaggagatctcccttcagatggaaaaagactagagggcattgcttgggagaaatggtcttggattttggaatctgaaactttatatggaaaggtcttttgtttgtctttgtcttgttatatgtatttatgtttgtggaggggatccctgaagaaattactagtggaagaaattactaactcagggaactcttcttgtttggtcagtcacattcagttagtcctgaaggagttgctagtggaatctcagcaagcctaactcagggtaatcatctgctcttcaatctttcccaggctttaccctctgaacttctgatcgaaggtcatccctctccagcttgagtggatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgcaaaccccactgtctcagtgtattgttctgttgctgtgcagcaggcatacaaatctgacaatctcgtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaacatccaaagcatatgaagaatctattctcctctgtatttgccacacagaaccctacctgagcaggcacccccaatttgctcaatattttgttgacttcagagaaacaaagaatggttttagaaaaagctaaggaaaaggctgatcttattcacactgactctcccagtaatccagtaagggcagctgctcagattgcagttcccacctctgacctgggatggaatataaacactggagatagatctaaccttgaacactatcaaaactgcattttgatcagcctctgcaagggagtgcccaagcaaaggagtctcagtaaggtccaggatggtcaagcagaagcctaatgagggttgctttggaattcttagaacaagtctttgaagctttcagagaataaatggatattgacccagaagccccagaaaatttgatgatagctaacatgatgtttatccaacaaagtgccccagatattcagagaaagttacaaaacgtagctgaggcattggacatgtttttgtctcaattagtgaagattgtttttaatgtatttactgatcacaagtttaaagagtggaaaataaaacacaaggaataatgaaaatggcaagctgacttgttatctgtggctctgaccctagtagtccctggaccacaacaagggccgtcatcagacactccatctatggtagaaccacctgggcccccaaaggccaataaaaacggacatcccattgcaggtcccaaccagtgtgcttactgcaacaggggggacactgagtggaaaatttctcatgccctacaaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttggattgtcagctagagtaagatcatttaaagcacagttttttgctgggcgcggtggctcactcctgtaatgccagcaccttgggaggctgagatgggcagatcacaaggtcaggagatcgagaccatcctggctaacacagtgaaaccccgtctctgctaaaaatacaaaaaattagtcgggcatggtggtgggcacctgtagtcccagctactcgggaggctgaggcagaagaacggcgtgaatcggggaggcagagcttgcaagtgagccaagatcatgccactgcactccagcctgggggacagagcaagactctgtcaaaaaaaaaaaaaaaaaaaaaaagacagagtttttctatacatccttgaatgtcctatccctttgttggggaaagtcttccttttttgttgttgttttgttttgttttgttttgagacagagtcttgccctatcgcccaggctggactgtggtggcacgattgtggctcactgcaacctctggctcactgaaacctccacctcacgagctaaagcaattttcctgtctcagcctcccgagtagctgggattacaggcgtgtgccaccacagccagctaatttttatatttttagtagagacagggtttcaccatgtttgcctggctcgtcttaaactcctgacatgaggtaatctgccctccttggcctcccaaagtgctgggagctgggattacaggtgtgagccactgctcccgtcctgttagggcagtactcttaaccaaactaaatgctaagattactttttctctgagatgattggacatccaggtgccttcagaccaagcatgtgctctgcaggccatattattacaactggagatccttgaaagtgcctgcacccctgaagagatactccaaaaggttagtccggaaacatgggcagatgggaggccagggaaaacaaaaactgcatctccagtacaagtcaagttttgtgcaggagtggcgctgccaaatctaaagcagcgccctttgagagaaaaggcacagcaatgcatttagcctctgctaatggccttcctgcaatacaggaagaattccttgtttctcatgtaacatacctgtcttgccaggacaaaaacatggaactgaggattattggtttgtacaggatttgagggctactaggcaaattttcaaagccatttatctggtgataactgatgcttatacattattcatgactttaaccagtgagttgtactggtgttcagtcttgaatctgaaggatgccttcatctgtattcccctgagtccagagtcccatgaagtgtttgcctttgaataggaagactctgacactaaagctaaatgatagtattgctggatgatgctccatcaaggcttcaaaaactcactaaccgtccgggggaaatacatgctaaggagttttgggacctccaattgaaaaatgagactttgcttatatatgttgacggcatattagaagccagcacaactatggcaaattgaccagaatattatactggctttacattttttttttgtctggatggggatccaaagtatccaagaaaaaaatcacaaatattgaaaaactcaattatatattttaggtttgaattttctcaggagcagagtaatctgctttcggactggagagaagctcttgtcagggtggccagactcaggacatggcagcagctgtgaggggtttttaggtatggctgaatgttgccatatttcattttcttattttgggcttatagcaaaatgtctctatgaagccctaagaccagacacttgacttctagaatggacaaggaatgtcaaaaggcctttctaaccattaagtaaaaattactaatggatctggctactgagaccccctgaactaagaaagccatttgatttgttcatacatgagagagaagggatgggtttaggagtagtaacccaagacttggggaatatcatgaggcctgtagcctacttttcaaaacagctggacattgttatgatgggttggacttcttatctctgagccactggcaccacttgtgatcttctccaggaggcagaagagttcactttgggttaacctagcactgtacacaccccatactgtgtatgctatttgttggaacagaagtggagctactgacttacctctagaagactgaataggtatcaggtcatcctcctggataatcctagtgttactttgagagctgtttctgctttaaatcctgctaaataaacctatacatgattgcatataaattactgagcaagtgtgttctattcaaccagacatgaccaaaattccctttaaaaacctggacttaaaaatattcactgaggaaagcagctttatgcaccacggacaacagaaggctgagtatgctattgtaaccctgtgacagatcctagatgcagagacactccctctgggttcatcggcacagaaggcagaacttagagtcctaatcagggcatcccaactaggtaaagactcctgagtcaccgattactctgattccaggtatgtttttattgttgtccatgctcatggggccgtttggaaagaaagcgggctcttaacctttgatgattaaaaaagaaaaacaattaagcatgctaaagaaatcttagcctgactaaaggcagtcttggtacccaagaaagtagctataatacactaccatggacatcagtggatggacaatttggtagcaagaaaaaaaaaatcactaggcagagcaggccactaaagaggtgaacagagaaaaaaatgcccaaagccttcctaatgccattaatccctgaaataaacttcagcctaaaatccctacctaatggaagaagatgtaaagagagaattcgattgagactttgactccaatcaaagaactcaaaatgagtggatatgtgacacggaagaaaaggttctggtgcccaagtatcttgtgacagatatcatcaaacacatacatgataccacacagtatggcaggcatgccacccttcaattgatccaggactatgtctttgggacacacttaaagaagactatccaaaaaataatttaaaaatacctacttggtgcccagaacaatcttaagactggtcctccacccccagtaccaaggattcaagcaagaggtgcagggctattagaggactggcaaattgattttaccgtgatgccaagggtagcaggaaattttaaatacttgcttgtatttttagatacattttcaagataaacaaaatcattccgctgcaagaccaagagaatgtctgagctaatgagagccttggtagagaagattaccctcaggtttaggtggcctgtctccatccagtgtgaccatagtgcaatttctgtagcctaggacaccatatattccaggccctcagcataatctggaatcttcatacagcctgcagactgaagtctactgaaaaaactcaaaagataaatcatactatataaaacaaaacaaattttagctaagatttgccaagaaactaacaacctggaataacattctgtccattgccctgctcagagtaagggtggtccctaaaagtgggcttaaattaagccctttaaaaattttacatgggagatcattcttccgttaccttctcagactaaggaatgccaataacatacacataaataaattagatattatcaaacatacacaatctttaggttgtactttaactactattcacgagtttgtggttccagcagattgtggtatccaactgacattctctttcatcccatccaacccagagactgggttctgctcaagaccaggaaaagtcgacatcctggggaccacttaaaacacagtgaaagaggccatgcaaagcatgactggtgacccattcctctgttcagcttgaaggacttagaccctggattcaccacagccatataaaacccgccccgccagattcttgtcctatcaagaaatgtagagaggccacttcaacttcagagactgtctcaaccctatctgaatggataagtaaatctttgatgggcctcaaatatcttttgaggaaaaatatcagataagtaactttaatgaaattagacaaaacatatgtcttcttgacaactacaatagttactttgagcataacaggaatgtttgttattataattattttatataaaaaggtgagataccttcctgtctattccctgccttactgaatgcttaagccatatatttacttggtcattataattgcctagataattacaattgctacccttatagacattacttcataattgccttggtcaatacaattgttagacttatagattttctagacattctatgccatgctaacatagtctcatgccactcattatgtggacattctaaaatttagaaatggtcactcttgttttaaaacttctaattatacctctcctgttactacagtgcctagacaggcatagcaacactgtagttcaactgtttcaaggtattgccactggaagaaacttaccagaatgatggatctgtcagtaactcccccaaactattcaaaataagcattttctgttagtcatacttgtcactgactttctggatgttccaaatatgactacctatctgcaccagcttctttccatggctactttccaggtccaagtaatagtacaccaagaaatcaccaccccatgtgtcaatctctctctgcctatcataaatggaaagtcattccattacataggccctccatggcccatggcatactgggcagacaaacgcagctaggagaagggaaataaaactaaaagtttctccttactatgccaaaaatatttacagtggggaatatcacacaaattctggggagcctgtaaaaaaagatccctagttcaattccatttgtctatattccccatgaaaaaatccatcaataaatgcacccttgagggctttacctgtgtgcccccttggtacatgtttatttgtggcataggatcagaccctcctctgttagggcaagcccactggtgtctcaataacctgtatattaagggctctcacttactgagatacttctcagtccatcctaatgacaaaatattctgcccattttcccaccgactccaaaagggactgccaggcatatatcaatatatctggtggcagagccttctaggcatcacgagtcctagctatggagtatacactcactgggacatgatcagaaacttattggcaaccacagaaataattgcaaaagaggctgctaagaacattgaggctgagaaaactcttcaaatttacttgcccagatagttcttgacaacggaactacacttgattttctcttggctttacagagaggagtctgtacagtgatcaataccacctgttgtacttatatcaatgcttctggtaaaataaaaaccaaactaaagaaaatatttcagcagtctcgctggagaccatatgtctctaccacagaccctatgtctgaatagttttttgagctttccgcctgcatactccatgttttccagtccatttttcaaggactcttgaagttcaagctcacaattctgtttatagggattataatttacatgattcaattaaatattacaataaaaccatagactgaagtactaacatgttcatccagcaccctaagctgggtataacagcttgcaggttgttacaagacggtttcattcctctaatcctgactctctctctgtgccccgtgtcagcaaaaagaagctagaatggccattgcccgattcataccatattagcttttacacctcagaattgagaagggatcaagcccggaaggaactgaaactgtccctaggaaagttatataaaattgattaagggggaaaaattcaactatgatttcaggaaaatcagcagtaatcactaaatcagctttccatttgtccaacttctctgtagctggtcattgattactaccctaggataaagaagcccttgtcacaagacattttggtccttttcctttctatagataaaatctaagacattgtgagatgataatctttctgcatgagtttctcctttaggttctgcatatgaaaaaaaaacctagcaacatactggtcaacaaggcaaaacctcattttcacaaaaaattaaaaaattagccgggcattatggcacaggtctgtagtaccagctgctcaggagatctgaggtgggaggaccacttgagcctgggaggcagaagttgcagtgagctgtgatcacgctactgaaatccagatgggcaacagagcaagatcatcttgctcaaaaacaaaacacacacacacacacaaacatacacacacagacacacagacacacacatcagctggtctaaagagcccagcaaaaagctgactcaggaaataatgcaggttccacatcctggtgacttcatcccccttaccctgaccaattgacaacccaaattttctagcccgtcaccctccatgatccccttaaggtctcttgcacatagccccttctcagaacagatctggggcttgagaatcctcccaattccttgtttggtgcccttgtgttgattaaagcctttctttgctgcaaaccctactgtctcagcgtattggtctattgctaaacagtgggcatgtgaacctgatagtcttataacaaaatagaatagaagctatttataggatcgatccatgcatgtgagtctatttctggacaccgttttctcttctattcttccacgtgtttgtcctttaaccagtatcatgagatcctttactcactgtagctttttttaagtcttaaaatttggtaatgtgagtttttcaacttctcttatcttttgaagaattgtttagctgttttagcccctttacctttccatatgactttagaatcagcatgttcgtatgtgcaaaacattgtgcttggttattcactagaactgggacacattcacagatgaatctggggagaactgatatgtaatagtattaaatttttcaatccatgaatattatatatcctttgatttagtaagatcatacagtcttaccctagttttttttattttaagcatacagatcctgtattttactagatttataactaaatattttgtatttcatccatcaacgaaaaattcaatttgtttaatagacagaatttattaatgctacctaatccttcttgagagagccatgatagtttgtggcttcagtaattttttaattcattcaagttcttgaatttattgacatggcattattcagaatattttttatttttcttttaatatatgtaaaaaccataatgatgtcatttctgtcattgctgttataagcaatttgtgttattttttctgatttagtctgtctaaaggtttctcaattatagagatctaaaataacaagcttttggtttccttgtttatatacatatttacttctttattatttcatctctgatctttattgtagtatttcttctgcttactttgagattaattttttctacttttactaatatctaatggtagaggctaaggttattgaagtggaacaccgtcattttctatcccaggtatttagtgacaccaatttatttcatactgctctagtgccattccacaacttttgatatatagtatatcaatcagtgtttggctggagtagggtgagtattccataaaagatttactgtgatttttggagggaggtgtgaagagggtattattaccaaaatgtggatttttttttaactccattctgtattttggctaagagaagcagctttggaacttctcaagtctgtacatctgtgagaccccaaggattacttgttttaatttttttttaagtttaggtttgttttgggtcaacttagttctttcaaggcttatttttaagcttttaaaaagcttaaaaaaccccagagatagtttgttcagaatattaagctgcttctgatgtctctactacgtgacctagatgttcaaacgagtctttctactctgattgattccatttaaatgtctccctgtgttgtgtgtgtgctctgggaatcctttacctttttgttctctggtagtgttcttcatctgataggtatcctttgtccattcttggggagttttgctctactctccagagtgtcaatattcagccaaataatctagggagttgctgtggaaatttgtagagccctttcactccatagtttcttcttttctcactctgtttcctgcagattctagtgaactcatcttctttgggaacactgagttttgtttcttctactcagcaagtgtggcactttctgctgaattctccttctccatgctgctgtttggaaaatttctcccagcataaagtcactttgatgatggaactcatctcattgtcactttttctctggaattaggtgcttcctgctttccaatgtctgaaaatgttattttcatctattttgttccatttccttatttgtggcaagaactctgttttacttgattattcttgcctggtcttttacctttttaaattgtctgtactgattgttttctatttggtttcttctcatatttggatttgtttcaaaatttatactcatgctggattttgtctggtttctttgttataatttattataaataataatttattttcagtttttattcttttcttttatagctatataatgataaatttccctctgaggattgttcgagtgtcatctcaccaagtttaatttaatatgtttttattatcattcaattcaaaatatttaatgtttcctcttctgattttctccttatccatgagttatttaaaaatgaagctgagttctgggaagcaacctagtaaacgacagtaatttctttttttgggttattattattattattattattatactttaagttttagggtacatgtgcacaatgtgcaggttagttacatatgtatacatgtgccatgctggtgtgctgcacccattaactcgtcatttagcattacgtatatctcctaatgctatccctcccccctccccccaccccacagcagtccccacagtgtgatgttccccttcctgtgtccacgtgttctcattgttcagttcccatctatgagtgagaacatgtggtgtttggttttttgtccttgcgatagtttactgagaatgatgatttccaatttcatccatgtccctacaaaggacatgaactcctcattttttatggctgcatagtattccatggtgtatatgtgccacattttcttaatccagtctatcattgttgaacatttgggttggttccaagtctttgctattgtgaataatgccgcaataaacatacatgtgcatgtaaccgacagtaatttctatcatcagttaacagaaacagtaacttccactctttcaagttaagttctacataatttgaggaatcatcattttggcctttcaagataaataaatctgttactgttcctcgtcttctttgaactccacatgtccatttactttgaagcacacaataagaatgacatttcaaattcttggagccaaaggctatgaaaattattttggcagattttctaagatcatcacaggatctcagatactccaattggctaaatgagatttggaattgccagaagatctacaataggcaagattaaaaagtcctaagaaataatactcattgtctattgagttctgacatgctgtagaattccaaatccattagacaaacagatttccaataatttcttagaaataattgtaagtgtcttaaatagagccttgttttaaaaagtgatgaagagtcttgatgtaatgtctttggcaactctgagcttattttccttgacttaagtatttgaatgcttatggttatccaggttttcagttacaaatgactcattattttttatatttacatattacttaaattcttataaaatgttattgatcatatgcttgtctttttcttattctcttcccttttagaaacatgttccaaatcaagtatagatattgagaatgggtttatttctgaatctcagtatacatatgccttaaaagaaaaagcgaaatatcaatgcaaactaggatatgtaacagcagatggtgaaacatcaggatcaattacatgtgggaaagatggatggtcagctcaacccacgtgcattagtaagtaatttattatgtttgtattgattatccagatgatacacaaaagtttactaactttagtctttttgtgggggctgatataatttcatttgaaaagataagaaaaaaaaacctgcaggaacaaagcagacatcaattttttttccttttcacattaattactcagatattagtctgtctttccattcaggcttttcctactctaaagcattctgtgttacagaaacaagttagggagctttatgtgtattctggtttaaactgattttgctttagctgagacctttatgactgttaatatatatctgttttataagattagacttttacatcaaattctttactcctagatacaaaagcaatgtttttattgaagatatggatgcctagtgcataacatcaaaataatttaaactctataatttgtagatttgacactgtaggatatgtctaatactgaatatcttccctcttagaaatttttcataaatatttaggtagtagagagacaaaatattcctagatggtaccaatttctgctctgttgtatgatttccctaccacactatctagatatttatgaagatttccctaccacactatctagatatttatgaaaattttctgggaacaattggttcaatttgtcttattttttgcaaaaccactcagtaatatgtgtgtgtgtgtgtgtgtgtgtgtatacgtatatatgtatatatatatatatatatatatatatatatatagagagagagagagagagagagagagagagagagagagagagagagagagatggagtcttgctctgtcgtcggccaggctggagtgcagtggcatgatcttggctcactgcaacctccattttccgttttcaagcaattctcctacctcagcctcctgaatagctgggattacaggcaccctccatcatgcctgcctaattttcgtatttttaatagagacagggttttgccatgttagccaggctggtctcgaactcttaatctcaaatgatcctcctgcctctcagtaatatatttgaagtaatatttaatatactcatgttaagtgaagtgaataaggtattcatgtatactgttttcattttttaatgtctgtgcttaatatgaggtctagtttacaaaaaatgttagtcctcataaaaaagctaattttatactaaatttttattaattattcttttaagattttcttattattaaagagaaaatgtcttgtataacataggaatttatattttcagtctttttctcctttttacatatgtctcaactacgaattagtttggactcttaatttacaaaattctgttatgattttctttaaaaaataatgtatacctgtaatggcctgttttattactagcattgtcataaatgctttagtataaatgaattaagaaaaatgtttttaaaatatattttggggcttaagcaatgaaaaaaaatgttgtgtagaaagatatactttcacttttgacaactattttacgacaacaaattctcaccagtcatagattatttttgtacggtacctatttattagtagatctaatcaataaagctttttcttcttagaatgggaaatactcagattgtttattagatgacattagaaatgacattctaaattttttatgcactagaatcttgtgatatcccagtatttatgaatgccagaactaaaaatgacttcacatggtttaagctgaatgacacattggactatgaatgccatgatggttatgaaagcaatactggaagcaccactggttccatagtgtgtggttacaatggttggtctgatttacccatatgttatggtaagtactggtttttcagaaattcattttcaaaatgaaaataaatctgttttccaattttaaaaatttgaattatatagaggaattgttaaggaatgttgattaaaatcaagatatctcctgatttgacataaactgggaaaagaagggagttttgaaaatatctctaaagtagtgcattaaattaatacttcctatgggccacctaccttccagatttgtgattataatataattgcttttgttaccctaaataaaagctttcaaattatttagaacctagcacttattaccaaaattatagttggttacaacttcctcagctaatttgtttttttaatttctactttacatcttctatcttgtgtgttaatttctgtactttctgagtgtagttctttattttctaaatttgaaaagttctgaagaccattacatgaatctcatttacgtttctcaatcagccatctatttttcagggttagaagaaggattggctctgtgggaaaacaagtatatgcagagtgttccaaggcaaagaaaaatatgtgcaaagctgtaaaaacaaaacaatatatttcaaggtggtaaagcagagtctatcctgctgaggctagatgggaggcaaggaaacaattatccagatcagctcaaggcatcatatcatttggattcattttatgactaatgaaaacccataaaagagttttaagaaaaggaatggtataatttgatttctagttttgttggattgttttcctggatgctgtactttttgtaggcaagaggcgacaccatgagtccaggtagggtgagaaagtgtggggactgagagagagtgatgataggggaggtgcagagcagaaggctgatttggaaaacatttaggtgatgaaaagtacaggtgatgttactaaatgttgggtgtgaaaaagagtgagattaagggactcacatgtttgttttcaattgttttctcacaagtatgtaggtaaatggcaataaccattttgtaaaatggtactgactggatagaatgcattttgagagggctttgcaacttttgacttggacacattatgattgagtcgccaatggaaaatcaaaactggatatgtgaagtgtggagttggatatgcatctagagaggagatatgcatttcggaatatcatcatataaatgatgacgctaaattggataagaatacagaatgaaaagagcaaagagctcaagatgaagccctgaaacattaccacatttatatataagacagaagagcaatagatagtaaagaaaatggggaaaaaaggaggacccagagaaacaggagaaaaaatctagaatgttgccatagacataaaaataaggaaattattaatgaaaaggtagtgtaacagattgcttaataagtcatcctgtctgaattctaattccactgcttgctgggcatgtatctttggccaacacagcaagtctatttgaagctttgttgactctttcttgttggtaaaatgtcacatatttacaaacagttctaatatttcaaaggattgtgttagttagcagactaaaatatttataaatatttattgccatagtgccttatataataaagtcaaagaagttgtaatttaattaccttaatatcattatcaaagtgataaatatttctaatttagttattatattctgttcagaaattgtgatggattaggtaaggtacaggccaatgacaagtgtaacaaaaatggattttaatagagtagaagagacagaccctacatagaatctgccaataaaaataatgagctagacattcaatacagactgtagacataactctttcaagattctggctttgaatctaataggaagatcagaatattgcttgaggaaagttgtgcactgaagggataattaaaagaaaaaagatggaagacaccagagcagatacagcaaaaggggagctgcaaaggctgaacacatgacttacatagttgccctgagaaaatgcgaggggaaaggactcacagctactgtggaggtattgtgctttggtggcaacaggactgcttacaaccttgtgacaggtggcaacaggactgcttacaactttgtgacaggagatgggaaggaaaatgagcagtaacgttggaaaatggtagaagctgatggattctgttttgaagtatgagacatggtcatctgagattgaatagtgtgtgggcgaaggaggaggaagagtactaggtagaatagaaaagttttgaaatagtcacagctgagaaagagaatgagtacattgtagatgaaaggcagtgtcaaaggtccagttaaatttgactcattcctgctgttgtaaacacctatcataggacaggagaaaatggtgaaaacacaagcacaggtctacttatccagagattttattctaatataagacagtggaaaactaaaaagagataagccaaatatccaagtaataaaaatatttaaaatatattttatgtatcactgtgtacagagaaatagaaaatccaataattgagatagaaaataggagggaaggaactggagatctgttttacataggaagtcatcgatgcaaagaatggttgaaagccatttgttatagtgagaagggtatgtgcaacagctgaggcagcgaagaacttgacctttttaataaaattcaaagatcataaaatctgaatcctggatttagtggaggagagagacatttgataacattggaagagtaggcatggatcataaagaggttgagttttgctctaattgagagggggaggcttaatttaagagactcataaatttcttttctgtgatgataggtaaatttaggttttatgaagccagaagcttttacaattttgaggggtcttcttcaaaaaagaacacaaaattgtgaatatattgcttcagtagtctttccaatcaccagacatgaaatgaaaacctaaaggagagaaagttggagtggcggacatagcagtagaagctgatgtagaaaatgtctttctattgcaaattgtacaaagacttaggatcatttgaacacataactaggaatttgctagtatagtacaggcctccaaacattaaacgaagaaataccagcttagtattcttttcaaatattcttctctcagccatgtaacagaaaactgcatgtggattgacagacatctgagtatatttcaagtgtcctaggaggtctcttctttgtggaaaggtttccacagaattgttattatggagcacttaagctaaataaggagtatgtatctcagagttaaaaattcatattaacatttcacatatctagtactaggacttagggttttgagttttagatgaagaaaaatatttctaattcatggagtgtccattcacattcttctctaaatcacgttttgtaagttattacctctatataaatacagcatttgaataatacccaataatcaagatcttaactttcctttttaagataatgcttttcacaatattacaacagacagaatttatataaaattagcacaaaatacgtgaacaaacacacatacaaaaaaaagaattgctatgtagaagattggtatagacttttaggagagaaatcccagtgattctcattcaagtgtgattttctcaaataatctgcaaaactcattaaaacaaacacaaaagcaaatttttgtagttattattttgtgacattacttttaagaatagttttaaatctaattttgtaattgtattttaataattgaggttatgatgtaattaattttctttttagtatgattctaatttatgaattctagcttgtacttttctaagttagcaagaaaggaggattctgaataagaaaaataatattttggataatatttagtaatgttgctgatttttaaaaattataaacatgtaagagataattttacacatttcttatctgaatcagaataattatcaaatttattaaacattgatataaatagtacatataacaaaaattgttatatgttaacataaatattcaggatacctagaatttgcctttccatgtgaacttgaaaatttatcttggtttgttttctttatttgtaatatattaattatgtgttttttatattttttttaacttaaaatatattagaaatgctattttgggttctttttccttgattacattaaacaaaaataccaattttaattaatttcttagtgcatatatcttcactaataaatctttgatgagaatttacctttttgtgatgtatatgtcagtcatcaagaattataaacatgatgagaccagaaatcatttgaggttgtttagtttcagttaaataaagttatcattgactctgcaatgacagatattataccatcattattctcgggatcctccccagttctattataaatttaacttcttaagatatttccatggtgttttatgatgtgttcttttatttttaaaattttaatttctatgttttatatgtttagatggtccaaatgcagttttgttgcatggatatattgcatagtggtgaagtctgtacttttagtgtattcatcacccaaatactgaacattgcacccattaggtaatttcttattcctcaccctcctgctatcctgccacatttctgagtctccaatgtctgttactcagcactctctgtccatatgtacgcattatttagctctcacttataagtgacaatatgtgggattttactttctgaatctgaattattttacctaaaataatggcctttagttttatacatgttgcttctgaaggcatgattttattctttttttttctttttattttttgttttggctgagtagtattctatggcatatatctataccacatattctttatccaatcatctgttggtggacaattagtttgattccatattattgctactgtgagtagtgaggctataaacatatgagtctgggtatcattttgatatgataattgatttcctttgggtagatacacagtagtgggattgctgggtgaaatggtagttctgtttttagttctttgggaaatgtccattctgttttccatagaggttgtactaatttacattcccaccaacagcgtataagcattcttctttctcctcactgtcaccaacatttattattttttgactatttgacagtggccactgtgtctaatgtaagatgataactcatttttttaattcgcatttctctgatgattactgatattgagtttttatttcatatttcttggtcattttcatgtcttcttttgcaaaatatctcttcatatcctttgtccactttttcatgggattattatttttttttcttgttgtgttgtttcagttctttgcagattctggatattagccctttttcagattcatagtttgcaaatattttcttccattctgaggttgtctgtttactctgtttattatttcctttgctgtgaagaaaatttttagtttaattcacaatcacccagaagcaggtcatttaattttcatgtatatggatagttttgaaaattctttatgatattgatttatagttatatttcaccaagttctgataagatacttgatattatttctaacctttaaaattttgggaacttgctttgtagctgtagcctagcatatggtctattttggagaatgttccatgcacaggtgagaaaaacatatattctgaggttgttgggtggaatgtcgttaaaatgtctgttaggtccatttgttctacagtccaatttaagtatgaggtttctttgtttatttttttgtccctgcaatctgtctagtatagtcattgggggtgtggaggttgcttgccctcattatattgctgtttatctttctacttagctctagtagcatttcatttatgaatctgagtgctgaggttttgagtgcatatatatttagaattgttatatcttcttgcttcctttatcattgtgtaatgaacttcttgtcttttttttcttgttgatttgaaatctttttttatatataaatataactataccaaatgctttttgtttctgttgttcaaaatatctgtctccatacctttaccatgagtttgtataggtttctctaagttaggtgggtttcttttgagcagcatgtggttggtttctgttttccatatttggtccacaaatctatatcttttaagtggaacatttaatctatttatgttaaaagttaatattgtcatgtgaggttttgttcttgtcattatgttagttgttacctagctggtttgtagtcccaactgtgtaattttttaataagacctgtgagttttgtacttttgcatgtctttatgatagtgagtattgaccatctatttccatgttcaggactccctggatcatttcttgtggggtgaattcctaaagtggatttctagtggtgatgaacttccttagtattagcttgtttgggaaagactttatatattcttcatttatgaagtttagtttagcaaaatacaaaatatatctctaatatatgttttttcaataaatatgaactaatctttctttaagaaccctgaaaataggacaccaatatcttctggcttgtacagtttctgctgagaagtccactgttagtcttacgagatttccgttatagttgattagatgcttttctcttgctgattttataatttttcccgttcacattgactttagatagcctgatgactatatgtttgtagaagttcatctcgcaatgcatcttcctggtgttatctgagcctcttgtataaggatttctatgtctctagcaagagggcaagaggagataaattttcctcaaaaaggtttttttagctttttcttctccctcaagaatatctataactcttaagttttctcattttttagaacgtcatttttctcaaaacctttgctcattaaaaaatgttatttgctctttatttttgtctgacagggttaattggaaagacctgtcttcaagctctgagagcaagtttttctgcttgatgtaatctgtaattaaatctttcaactatattttgtaattcttcaatgaatttttaatttccataagttctatttgttttttaaaaaatatttttagtacatttttcattcatatcctgagttttttttctaatttctttgtgttgcttttcaactttctcttggactccatttagctactttaaaataaatattttaaattctttggtatttcaaagattttattttggttaggacttattgctgaagagttagtgtgatcctttgcgagtgttgtaatacgctgttttaaatcatacttccagaaatgtttcagtggtttcttctcatccagatgaactatcccttcttatttttaagtccagtttccaacagacaggattttttttttccctttgagaatatgactacgatgtatgttgtatagggctatttggtttaggttctgggttctttcagtggtaaagactctgtttgagtaccttggttagagataacttttgtatgatggctttcttaattgctggttgtagtagttatgtactgggtgtatgacgaggcttactgcctcctgaagggctggtatggaggactacgcagaaaactaaccttgttctgcatcatgccctagtgtcagcattttgcactgggctgtgcagttcaacattcaggacagtaggtggcacggacaggtaagagccagctgcagcagaggcagatgagcctatgcttgtcactgtttatgggagactctctgttgccccaaggaatggactgatctgtgaaaggtacagtggtctgaggagctggggacaaagcgggatagatctgtaccactaagctcacccttggatgctccaaggatgagcacaagcaccagccctgacaggggtgtcaggggaagaccctggggagatacccgtagcttgtctttcttgcaagcctggcttcattgggcacatgaccagtggagttgtagccaccccctaatacccctacaatgtccgtcctctggtgtgtctacaccagtctcctttgcgagtgaccacagctatgaacacagaattggatccacgggacatgttcccctctctacatccgtgcccaagcgctgggaccattgggctcctgggatggatctatactcctcccttgcagagccaaacaccgcgtctgcgtgtctgctggaagtggcgtagtcattttcagcccacaagcaggttgctcttgcacacaggaaagtgaatgctacagtcttctttgccacaaggggtgttcctttgttgcactttccattaggaatagcctccctggtggttaaactattgggaatgctgtaactcctttgggtccagccagctatgggtgactgccacatccaagcaggtgacagggaatatttgtgcggctctggtgttatggggacagagggctgaggttcctgggtaggaaacagtccccacatgagtgcactgcaggcatgaaacctaccactgcagctcaggcccaaggggaaggcagatgaccctattcaactagtagtttggtgtaatgccctcaagaagttcccaaatctccactcacaccagtgtgtgtgttcacgaagacagaagagctctctgatggcttggatccacacggtgagctgcagggagcccagaagactcctacctacactttctatgaggtcccacagggtcctagtcaacctttgtcaggctcttgcttctgtctttttccatgctttggcttctctccatggtttctctatgacgctcctgcaccctctcttaaatatttttcaagttatgatcatttacctgtaactttggttcttctttctgaggagaacttgtgtccaaactccttagtcagtcatcttgttttcaaaaagccccaattctggtctatatgcacttttcttttttaatatgagagagtaatttcatgttttgagtaaaaaaagtaatattaaatttcattaatgtcagtgattaaaactagattcattgtaaataagttgaatttacaaattaatttttagaacagatatatttcaataccataacatttataataaagttccatttcaatttagacagcatataaaacataatatgtagcattctttacagggaaaaggatttatctgatgcccctctgtatgacccaatatcaacctcactttattgtggcatatgtaaaattaactttggcaatgattaattatatattctcatgaaattattttacctttttcaagaaagagaatgcgaacttcctaaaatagatgtacacttagttcctgatcgcaagaaagaccagtataaagttggagaggtgttgaaattctcctgcaaaccaggatttacaatagttggacctaattccgttcagtgctaccactttggattgtctcctgacctcccaatatgtaaaggtgaatgcttatcttacaattgctgaaataagaattagaactttgaataccaacttttttcttattaattttgtttgggctcccattgcctgtaatctaatgaattaagtcaaatatttgcctgtgaaggacatgtattgagtactgaatacctgagattcagtcacttaagttaatctccactgtttcttgaacgatgtgctggaagtattcccagacacacaggtgttgtcggtcttagtctactttaggtttatgtttctataaaggaataactgagtctggatgatttgtaaaaatgttttatttggctcactatactcatgactataaaattcaagatcgggcatctgcattcagtgagagccacagaatgctggtagaaagggaagaggagccactgtgtccagagaacacatgatgagagaggaagcaagagagagagcagggcagtgacaggctctttttaagaaccagctcttccaggagctaatagagtgagaactcaccctgagagggggcattcatctgttcatgagagatccatacccatgatccaaacatctcccattagaccccacctgaaacactggggatgaagtttcaacatggggttggaggtgacaaacatttaaaccatactagtggctgacaatggagggatttctttgttaattttcattttgcttgaaatgtcaacatccattctggacattttatatagtgtgggctgcaacttaagtttcaccgggtgtgtctaaacaatatttaagcagcttatattcaattcagttgcttgtattgattagtcaaactttatgttgatcaaatgcttgcctcagttatgatatttttccaaaatgttatgataaaatgtttccatgaaatgtaaaaattaacatgattttcataaccacatttgctaattggttttcttgcatctttaagatatctagaagtctgagcatattttaacattttaatataccttcaatatgacaatttagtataagtaatacaatatgaacaccattcttgattgtttaggatgctataataagttacataatgaagaatacatgaataaaagaagaaaatctttccattttactgaatttttatattgtaaaacagacaatttaaccattatttacatagtatttctactatagagcaagtacaatcatgtggtccacctcctgaactcctcaatgggaatgttaaggaaaaaacgaaagaagaatatggacacagtgaagtggtggaatattattgcaatcctagatttctaatgaagggacctaataaaattcaatgtgttgatggagagtggacaactttaccagtgtgtattggtaatgtataaaatattaatatttaaacttgtcaaaacttttgtattttgtatctaaaacacatacatcatgttttcacaataaactttttttgtaaaatttacatagtggaggagagtacctgtggagatatacctgaacttgaacatggctgggcccagctttcttcccctccttattactatggagattcagtggaattcaattgctcagaatcatttacaatgattggacacagatcaattacgtgtattcatggagtatggacccaacttccccagtgtgtgggtgagaatacccttcttaaatcaacatttaacaaagtttaatatttttattgtaacaacaataattgcaactatatttttgaaatttacagatatgcctcaacatttccagtcttcaatatgagaccaatcttttgcatattgcttataattcaatatgtgtctagaaagaaaaaataaagctagtaatataattttatgaatctttctgcgtctgataacagtattgtttatatttaaaagtgtgaagcaacattttacttacaaaaattgtcatgtgaggccagggtggttgctcacgcctataacctcaacacttcaggaggccaaggcaagaagattgcttgaggccaggaggtagacactagtgtgggcaatatagcaaaagcccatctctataaaaaaaattttgtaattagttaaggtgtggtggtgcatgcctgtaatccagctacttgggaggctgaggaggaatgattgcttaaggccaggaattcgagattgcagtgagctctattgtgcattccagcctgggcaacagagtaagactctttctttaaaaaacaaaaatattaaaaaattatcatatgattaaatatgagtactaattactgagaaattataacagttttatataaaatataaatattattgttattgtatggtattcctttttaggcactgagaagcaaagaaacaaagttgacaaaatacctacttactactctcccataggattcttttctctcttaaagcttccaaaagtgataatttttcagtttgttccatatcagccaaaataagtgaatgtgctgcagggttggtgggccacaggccctctacatcagtggtatagctgagtggcatgaggtagtcagggactgagtcaggacgtaaatctcattgacggacttcacactgtaaatctcatgtcttgatcagcaagaaggcaaggtgattcacttacagtgtgacttgagatgtacaatctttaaaatcattttgcctctttgatgactaaccgggaggatcttggggaccctcattcacttttctctaaactgagatttttcctaaagttttcctgggtcctgaattctaagagtcctaatgtccaatcatacttatttatccaatgaaatatccaatgatattttgtatttcccaaagaataaaatgtcttctgataggtatctctaacatttcagcgacagaatacagggcttatattttgacataatagcattttgatgcaatgtgatcaggaataacttggttggtgaaatttataatgattaagtcataattttaccatgctaatactatttactttataactatttttatgtaatagttggtttgattcctatcatttgaattttcataaaaatatatttattttatagcaatagataaacttaagaagtgcaaatcatcaaatttaattatacttgaggaacatttaaaaaacaagaaggaattcgatcataattctaacataaggtacagatgtagaggaaaagaaggatggatacacacagtctgcataaatggaagatgggatccagaagtgaactgctcaagtaagctcttattttgttttcagaaatgtattctatttctcatttggaaaagtaataggtatgtgtgtcttttaaaaactttagctatttattattacaaatgctactgaataaggcaggtaaactagaaactaatgaaaacactgttcctaatattaactgtgccctgtgaattagttacctttagtataaacacacacacacacacacgcacacacacacacacacacacacacataaaccaggcactacatgtcatcattactgttggaggaccagtgcttctcattccttttcttgtcaacaaatgttcctgtgcctatacctctgtctatgccaataactactatgtatctgtttgtatatgtctgtatgcatgtatgtatgtatctatatctatttctgttgattcatttatttaatctatctctctgtctattcatctacctgttcatctacctaatcatctatttatctattaatttattgttcatctatcttgaaaagttagtcatattgacacatacagtttcacttgaatagtgtaggttttattccagtcttctcatattttatatctgtattttgctatccaattgtgggtttccttgcctcactaacttcaatatttttaccaatgtctgccagtctaggatatacagaaagcattgacaaccaatacaaaaactaatctgctatcaacatttcaatatgtttagagtccttaaagaagcaaataatatatatatgcagtgaagtgtacatgttctacagttttttcttgaagttttatagttttagccattctatatagatttattaaaatgatcgtatagttatcgtcctttctgttaatgggatgcatcacctttactaatttgcctatgttaaacgacctttacatttcttggattaaacccatttgatcatagtgaatgatctttttaatgtgctgtaggatttgttttcctagtatagtgttgaggggttttgtacctatgttcatcaggggattttgcctgtagttttctttttgcgttgtgtccttgtctggttttggttccagagtaatgttgggccactagaatgagttagaaaaatgatctcctcatcaaatttttggagtcgttttagaagaattggtattagtcctttctaaaatgttgttataattcagcaatgaagccatcaggtcttggattttctttgatgggaaacattttattactgacttaatctgttgcctcatgattactctgttcagattttctatttcctctgaattaatcgtcgtaggctgtgtgtctagaaatttatccatttcttctaggttatccaatttgttggcatataattgctaataacggtctctcattatactttgtatttttttgatatcagttgtaatatcacccttttcatctccgatcttgtgtttctttaagccgtatctctcttttttagttattctggttaaagctttgtcaatttttgattatctaaaaaaaaactattttcattgatattttgtactgctttgggggctctattttacttacttttactctgatctttatgatttccatccttctactaattttggaattgactagtttgttcatgtttttctgcttctttgaggtgtactactagactgtttatttgagttctttccactttcttgatataggcaattattcctaaaaacatccatcttagaactacttttgctgcatcccataagttttgctacgttttgtttccattctcctttactgaaaatatttttaaatttatttaaaatggtttgaccctatgattgtttcagagcatattgtctaattttcacctaatttaaaattttccatagttcctcctattattgatttctcatttcatacctttgttgtcagaaaagtgacttgatatgatttcagtcttcttgaatttgataagacttgttttgtggcctaacatataacatattctggggaatattctgtgcgcatttgagaagaatatgtgtttttttgttatgtggaatgttctttatatgtctgtccaatctatttggtataaattattgtttaagtttaatgtttccttattgatattctgtctggatgatctgtctcaacgttgaaagtaaaatattgatatcccctactattactgtgttgcagtccacatctccattcagattcctaaatgtttcctttatatatttagttgctttgatgttgggtgcatatataggtttataatagttgtattatcttgacaaattgaccccactatcattatataataactttctttgtacctttatacaatttttcccttgtctattttgtctgaaatgagtataactacccctgttctcttttagtttttatttttataggtttttttccatgccttcactgcaatctgtgaatttacgttacagtgaagtaagtcaattgtaagcagtttataattggatattaatttttgatttatttagtcattctatgccttttgattatagaatatattccatttccatttaaagtaattttagataggtaaggatttatagtggtaatttgttaattgtgttctggttgtttttaaaattctttgtttctttcttgcttgctttattcatggtttgatgactttctgtagccatatgcttaggattttttcttttaatcttttgtgtatctattagatgttttgcttttggctatccttaggcttgcatagcataccttataaaaggctatttgaagttgtagttatccttaggcttgcataacatatcttataacaggtattttaagctgataggaactgaattttgattacatataaaatatctaaattttactctgctcctcccatgttttctatttgatcacatgctttgcatctttcaataattcgtatctcttaacaaagtttgtagcttcagctgttcttaccacttttgccttttaacctttatgctagctgtatttacccatcactattacagtattagagtgtttgaatttcatattgtgcttacttttactagtaagttttatactttaacatcttcatgttactaattagcatcctcttctttcaccttcaagaactccctttaacatttcttgtaaggcaggaaagtgtccttatgctctctcagctttttttcaatctcagaaagcctttatcactcctttgtttttaagacagaatagtggaatctagaattattccttggcagttgttttctttcagaattttgagtatatcattccacttccttatggcctgcaaggtttctgttgagtaatccactgatagtcttgtggaaattccattttatgtaaccattcacttttcattggcttttttcaatacttggtctataacttttgataatttgattgtgttatgtcttaaagtgactatctttcattaaacttatttgatttcctttgagatttctgggtgtgggtttctatttctttcccagttgttgaaagttttctgtcattatttttttgaatatattttctgtatcgttgtgtttctttctgtttttaacatggtgataatgcatacgttattccacatggtagtattccatctggatcttaagctatcttcacttttatttatttatgtgtttattttggttctcagatttggtgattttcagtaatttgacttcaagttcactaattccttcttctccttcatctagtctgctgatgaatacctctttaaaacttttccgttcagttatagtattctcaaatttgtgatttttgtttggtattttaaaaatactttctacctctttgttgaagtagttaatttgtttttgcattgctctcttggtctcagtgagtatctttatgaccattattttgaattctttcttgagtaaaacacctatatccacttccctcaggtcaatttctggagactcatcttgttcttttgtttggagttatgatatcttgtttctttattttctttaactcacagtgtttctatgcaatagataagacaatggcctttctcagtcttatcagactggcttcatataggagaaagacctcactaatttttccagccagagattttcatgtgcctctcaagtctttgtgcggactgctgtctcttattttttgtggccccctggaggttagaatgtgccacatcttttcaggacctgggaccaacaagttaggagccaggaggtctagatgtagctgaaaatattgaagacttggctgtgtatttacttacttctattttcatagtgaaagtgaatgtgcgtgtttatctcccactctctctctgtattacaccaagtaaagaatctgtggctaatacctgtactaatattcaggctgcatgctctgatcctgaagaggtatctgcttgaaatgagtccattgtattaccagctttttgtattctgtgatgtagggcctttcaggaatgcagatctctatcatctcccagtgtgagtttgttaaggagacgatctcttgagttggagctatagaagtgatgacctttgaatgcatggctaaacttggtccaggaagaatggataaatctgaatttatcattggggcgagactcatgaagtgccaaactttggctttggctgcgggaagattattttttgtttgcgtcattagataccctgtgcaagctcgatagaggccagttcattaagtagccagtggaagtatgtgccctaagccctttcgacagagaaatggaaattgaactttctctttccttttctgcactgctccaatttggcatagcgcctggagtttttacatagcattttaagaccatctatttgctttacgatctatggagactggtatttttctaatatctgctgtgacagttaagagttttaagaggagtccttttggaggtaactgtaaaggttgtagcacttgatggatgacacaaacctttttgaggataaacaggggagctgcattttaaaaaccttttctctgcactgctcttgggcaatgaagctcctggaagtgcttacacacccatataaaacgccatttcttttttcagtggtctagatagactctggatatattttgtgccctctactcccagaactaagagctttagaatacagtccctgaatgaaagttgtaaaagttagggcactcaagtttgtgtggacaaacttgttctaagagtgattaatgtacctggatgtatcactggggtgagccacgggaaccggctagagaagtgcctgatgcaagttcattagaatccagactgcaagttttttagaattcagacctctaagtagccacaggaagaatatatcataaaacttctcgggagaaacaggggactgttttttcagccccttctctgaactgctattaaggaatgaagtttctggaagctcttcagcacttgtatcataccaccatttttcctgtgatctagagagactctcatgtgtttaatctcctctgcttccaaaattagtgaattaaaggccaaaacacaggatgctttatgtgagatccaaaaacttctccacaaggagaaactgggtttttgagattccttttctaattgtgtggtgcagtgaacaaggctggggtccatgctccattgtgttgcaacttttcttacttgttcaatgtgaatgttgtctttgttgcctgttaagtaggagtccctttactggtctttcattttctttcaggaggagttcatttatgaatagatgtttttttaggacattcttgggtggaagaagagtcaggagcttccacttctgccattttgctgacatcactccctgcctagctctttattttacccccaggaaactagagtattgcaggtatcgttaagtgctcctacacaagcaagagagaaacctgtactttaggatgctcccccaaaagctaggatgatagatgcttagttcactcttatctttcctctctgagggagaagcagtcaaaatatattggtctctgtttactttagggggttgcaggaggctttgaactggtttcttgatttctcataaagggaattgtttccagtatcgtcattgaatcagtgtgcctgtggggggaagggagagtggtggcttcctatactggcatcgtgctgatgtcactgccctctttcatcctcaatattgatcattttttaaatcttgatcattgtttttactttgtcctcaattttattaatattttcaaaaaccaattgtaatgcctttaaattttctccatttgctctgtattttttagttttattatgttttactgattttagctttgctaattttctcccttctctgtgtttctttgtccgttttctcttcttcactgattttactgttttcttccttctgatgacttcagttttaatttcacttttctcaatcttagggtgaaaaatgaaaacatggtcataaactatcatactttgaaaatataaaactttaaagctctattcttttaagcactgctttagctgtgtcccagaatgttacacacgtgtgtgtgtgtatgttctatgtgtcgggagacagagagagagagttcatttttatttgatttgaaatattttctcatttgtcttgtggtttgtctgttgatgattaattatatggaagtttattgtttaatttcaaaatatttgtttttttctagataagtgatttttgctggtttctaatttaattctcttgtgaaagaatactgggaaaatttcaatattttgaaacactcagttttttaattgctcagcacatagtctaccttgctaacggttctatttacaaataaaaatatgcatacacactaaatgtagaattaggctatactgggtcacaatgttcttcaaatttatttgccatgtcacaaaatgttaaataatctctttcttaattgtttactatcagcaaatactttaaattaaataataatgattgtggtacacattaaaatcaatgggatacagctgaaacagagatgtatttagcattataacatgcatcagaaaaaacaaataaaaaaataaaagcaacaggtactacaatctagaaggtagacaggaatgtacacccaacaaaaatagaaggaaagaatcattcaagcataaatagttgaccattaatcttaagaaaaataaattgatgagaatgttaaaaacatgtcaaaatattgaaaaacagaaataagcaaaatacttttgataaatatgaaatactttatcataagcgaaaaaagaaaactcgacattatcaataacctttaatgaagttttgttcatccaaacgtctccctgaattgataacaaaatgtcagacacttaaaatcattgccatgatttcctatagtacgattacataaagctttaggtgaagtagagcatacactatgataggagaaaggaaaatcaagggattatagaatgctcccagatgcttctaaactcccccgtcagtcaaacaggacatgcttcattttcatattatgaaaaaatgagatatttctgatgtatcgcagtttaacaggagcttagctgtgagtttacaaaggtgtctttatatgtgattatacaactaaagccaggctgtgcaatgcattaaactgggtgcataacatccatttaaatatccctaaacagtacaggtaagctagtaaataaaagctctaggggagtttcaagttttaaatagcacactataaatcactagtgattatatttaatgcttatattggtcaagtgtcagtaccaaattgattattaactacatataattctacttctggctaatcagattccattggcagaaaatttgtgagtgttttaatccaatcctgatacatttgattatagatatcaatttttatttaatgcatgtaattaagagtgtgtaattccattaaaacattctaaaggctcaaaataattaaaatcaatattacataaattatgcaaatttattaaacaaagaatatatgaaaaaactacaagaaagtctatgagaatacaagccaaaagttctattgtttaatgtaactgttacacagctgaaaagtataatatttgcatacaaaaacatcataattaatatgtgataatttatgaaacagttattgatctttctatttattctattttaatcatataaattatttttcatcaaaaattctaattttaatatttttattttttattttttattataacattaattatatttttaatattttttagtggcacaaatacaattatgcccacctccacctcagattcccaattctcacaatatgacaaccacactgaattatcgggatggagaaaaagtatctgttctttgccaagaaaattatctaattcaggaaggagaagaaattacatgcaaagatggaagatggcagtcaataccactctgtgttggtcagtagtgtataatttgttttacataattctttcaaatgaggttaatattctcttgtgcttcgtgtaaacaagagagaagttctttctctgtgtctattactttatcctgacaaaataaattaggacctaggcacattaatcaatcaccactctttcagttttttgaacaaaatacagccaaaatctttggaatattatgtaaatgtcagataacatttccattcatgcatattttaatccttgtgatgaacaagacatgaatgaagatgattattgaacaagaggatggtaacatagatatggtggaggaatatatctttgcgagtttctaatatgtttttgtttttaaataattttatttgttcaaattatactcactttaaaatccgaaatagtatttagttttatatttcaatttaagtattttatttgtttttaaccctttgattttcattcttcatttagaaaaaattccatgttcacaaccacctcagatagaacacggaaccattaattcatccaggtcttcacaagaaagttatgcacatgggactaaattgagttatacttgtgagggtggtttcaggatatctgaagaaaatgaaacaacatgctacatgggaaaatggagttctccacctcagtgtgaaggttaggccaatatgaatactcaatttctgtttatagtagaattcataaaaataatctcttgttatcaaagtgaggggaataattgagattactgcatatataaaataatttatatattataccattaaaatactttttgcatgattgaatctattctatttatgttaattttatttgttcatgatagagtcactttgtattctggcattaaaaaataatatctagtgaaattaaacctatctgtattattctcatgctgccataaagaactgcccaatactggataatttatacatacaaaaaaaggtttaattggctcactgttctgcatggctgaggaggtcttaggaaacttacaatcatggtggagggagaagcaaacgcatgaagacaggaaggagaagttctgaccaaagggaaaaggcccttataaaaccattagatctcatgaaaacacactcactatcctgagaacagaagcatggggataactgcccccattattcaactacttcctactgagtccctcccacaaaacatggagattatgggaagtacaattcaaattgttatttggttggagatacagtcaaatcctatcattccaccatggcctatcccaagtctatgtcctcacaattcaaaacacaatcatgccttcccaacagtcctccaaatcttaacttattccagcattaactcaaaagttcatatccaaagtctcatctgagacaaggcaagtcctctctgcttatgagcctgtaaaatcaaaagcaagttggttatttcctagacacaatgggggtacagggattgggtaaatgcttccattccaaaagggaggaaatggctgaaacaaagtggctatatgcttgatggaagtctgaaatttaatagggcagtcattaaaccttaaatttccaagattatctcctttgactccatgtctcacattcaggtcatgctgatgcaagagatgggctcccacagccttgtgcagatgtggctttgtccccctcctggttgctttcatgggctggcattgagtgtctgtggcttttccaggaacatagtgcaagctattgatggatctaccattctggggcttcaatgattgtggtcctgttctcacagctccacaaggcagtgcctcagtggggactctatgtgagggctctgaccccacatttcctttcctcaatggcctagcagaggttctccatgtgggctcccccctgcagcaaacttctgcctggacatccaggtattttcatatatcctctgcaacctagttgtaggttcccaaacctcaattcttgacttgtgtgcacccacaggcccaagactacatgtaatccaccaaggcttggggtttcaccctttgaggcaatggaccaagctgtttgttggccccttttagccacagctggagctgaagcagctgggatacagtcctgaggctgcatagagcagcagggacctgatccaggtccatcaaaccatttttccctcctgggcttctgggcctgtgatgggtgggggtgtcatgaaggcctctgacatgccccggagatatattccccattgtcttggtgattaactttggctccttattatttttgcaaatttctgcagcaggcttgaatttctccccagaaaaatgaagttttattttctattgcatttacaagctgcacattttccaaacttttatgctctgcttcctcttgagctctttgccacttagaagtttattctgccagataccctaaatcatctctctcaagttcaaagttccacagatctctaaggcagggcaatatgccaccagtctctttgcatagcaggagtgacctttactccagtttcaaacaagttcctcacctcatcttcatctgtgaccaccccatcctggacttcattgtccatatcactgtgagtattttggtcaaagccattcaacaagcctctaggaagtgccaaactttcccacatcttgtcttctgagccgtccaactccctaggaagttccaaacattttaacattctcctgtcttcttctgacccctccaaatggttctaacccctgcctgttatccagttccaaagctgcttccacatttttggttatctttacagcagcaccctactctctgcagtaccaatttactgtattagtctgttatcatgctgctataaagaactacccaagactgcataatttataaaggaaagaggtgtaattgactcacaattccacatggctgggaggcctcaggaaacttacaaccctggtggaagggtaagcaaacatgtccttcttcacatgatgacaggaaggagaagtgcaaagcaaagacagaaaagctccttataaaaccatcagatctcaggagaactcacgcagtatcatgagaacagcagcagaggaaaaatcgccctcatgattcaattttctcccaccaggtcccatccacaacacgtgaggattatggcaattgcaattcacgatgagatttgggtggggacacagctaaacctgttctgcaagttgtcatgtttgctttgccactatgttttaaaacttcttttacattcttcccacaatgccccttcttatttcctacaatatattatgttttacctggaatcgttaactctcaatgtgtatcttattatcactagtaagtttacagaggcattgtttaccaggcatagatgatctctttctgaaatgtattgctatttttagtttcaagtccttcttcagttggtgacagtccgatagacagacagacaccagaaggctagttttaggaaacatttgtgttacttctctgtgatgtcatagtagctcctgtattgtttattttcaaataaaactacttaatattaaaacaggcatataaaattaaatttatgagttagtgaaacctgaattcattcttttttttttaggccttccttgtaaatctccacctgagatttctcatggtgttgtagctcacatgtcagacagttatcagtatggagaagaagttacgtacaaatgttttgaaggttttggaattgatgggcctgcaattgcaaaatgcttaggagaaaaatggtctcaccctccatcatgcataagtatggtgcattgaattttattatatgtatgataaatattcttcattcaaagtgtaagtggtaccaataagaaagtaaacagggactctagaaattcataaggttttcttgaatattctggactgctgtgggaaattatagctgtagtaattaaaacatttgacattataagccaaattagttcattttcacatcatcttgtgtgaactttaagcatcctctgatgtatattctcagacttctcatctctgttcttagggcacagctgcctctactcatcaatctccacattattcaatcttctgtcagtttatcaacaatctgcctataagtacattttctgaaatattttaaaaaatcattataagtatttcacatttgatagaagcaaaaaatttggaaatgcacacacaatataggtggtgtattattccgttttcacactgctgtaaagaccttcctgagactgggtaatttataaaagaaaaaattttaattgatcacagttcctcatgactgaggaggtgtcatgaaacttaccattaccgctgaaggggaagcaggcaccttcttcacaaggtggcaggagagagaggagtgagtgaaggaggaacttctaaacagttattaaatcatcatatcttgtgagaactcactcaccatcgtgagaacagcatgtgggaaactgccaccatgatccaatcacttcccaccaggtctctctctcaacacctggagattattattcaagatgagatttgggtgaggacacaaagcctaaccatatcaggtggcaagtatggacaaaaataatgtgaacaaaaaaatgtgtaatctcaattgctacggctaccaatatttcttcagtcttctaatatcatttctatcttgtatttttaatagatttagaagaatttaatgtaattaagacaaaatggctaatatattttctcaagttataagaaaaatgttgtacagtattcattgattctatatatcgctattttagaatccattacatgtattgtatgtaacctatttttaaagatttgcggaacaaatacatatttttcctatttcagaaacagattgtctcagtttacctagctttgaaaatgccatacccatgggagagaagaaggatgtgtataaggcgggtgagcaagtgacttacacttgtgcaacatattacaaaatggatggagccagtaatgtaacatgcattaatagcagatggacaggaaggccaacatgcagaggtactttggtgaattttcaaaatttatttatataatgtgtgggcccagcccagtggctggcgcctgtaatcccagcactttgggaggccgaggtgggcggatcacttgaggtcaggagttcgagaccagcctggccaacatggtgaaaacccgtctctactaaaaatacaaaaaaatagtggggcatggtgacatgcatctgaagtcccagctacttgggagactgaggcaggagaatcgcttgaaccagggagatgaagattgaagtgggccaagatcgtgccactgcactccacccagggtgacagagtgagattccgtctcaaaaaaataaataaacctgaaataaataaatatataagtacaatttatttatatagagtgttttgggaataaaatatagaattgtctctaacatcattaaaatggacataaattaagtttttacggcaggacaaagtagtcgtatgcctaaaaataaaaagatggaactgagtatttgatgattaatcttagctcaatagttctcaaagtgtggtcgctaaaccggtagcatcatcatcttcttggagattgtttgaaatgaaaataaaattccgtaagctcattctagacatccagaatcaaaagtctcaaagtaaaaccctgaaactgttttaccaacacctccagggaattctatttacacttccgagtgagaagcattgctatagtctattcactacacatggatatgaaactctctgatgaattttgcattgttcagcataatatccttaatcattggcaattaaattatctgaggttatttttattattataggctttttaaaaaaatttttccacatctccaatttggatcctttgattaaccattcttcctccttttaacttgggtaattttcaaaatgtgtttttaattctttgcttattcgctaagaaaatgcctatttgagtttatttttaagaggctaaaatgtataagcaggatgattgcaaacaaaaatctggtatcacataatctatttatgctgactttttgcattttataaattaatgttaaataaatagaactggtaatatttgtttactcaaactcaaagagagatatccaggaaaactttcgtttacactggcttccagaagggaaaaataaaggtctatcagtgttctagcgaaggatgaagaagaaatttaaaacatcaacgcttgtaccttacaaaaaatagtttcatgtcttttcctcaatattacatttaaatttattaaaatcaacaaaatatttgatgagattgtctacttattttaaattcgtcttgaaatatatttgtaactgttatcagttgatttgctactcaaaatgaacactaggtggaaccacttcttttttttctattcagacacctcctgtgtgaatccgcccacagtacaaaatgcttatatagtgtcgagacagatgagtaaatatccatctggtgagagagtacgttatcaatgtaggagcccttatgaaatgtttggggatgaagaagtgatgtgtttaaatggaaactggacggaaccacctcaatgcaaaggtagagtattatatttcttttaacattttgggggagtatagcagggttaaaatatgttgatttaaacaaaatgaagtcatttttattaatagatttttcaaatgcaaataaaatgactgatggtgcttaaaattcaattcttcctgtgaacagaacacaagtaatagggtatattattttccagaaagattcgaccaaattgagagttggaacctgaaaaacaatactttttaagcattacaacacttagttccttctcaggaatacgtgtaataaaagatacattatgtgcatttgacagccataagtgatgtgcattctaagatatggaataggcagttgaagagagatcatagactgtgatataaatgtgggcatcttcagtatatggattatatttaaaggtgtgtgactgactgtatttataaaaagaagtccgagcacatagtcctgggtcattctaatataaagagatgaaataagggaaaccaaaaaaggaaattgtatcttactcacctttatgttttaaaattaatgtttttctgtattttttttttcactattttacttagactctacctatgtttattattgaagtgagtttttgtagacagcatatagttgggtcatgtttacatatccattcatcctttcatggcctgttaactggtgcacttggaccatttacacttaaaataattattgatatataggacttaaatctctgtcgtttatttgtttctgcctgtttcctctgggtttcagtcctatttccctattcctccattccctgtagggaaattattaaggagattaatttcgattcatatgtattgttttccattctatctctttgtatagcttttctcctccttttaaaaagttgttgctctagctaatactatatatgtaataatatattactgtctactggcactgacatttaaatctacaactggaatatggaaaccttactttcatgtagatccatttacactctccacgttgtaagtataaatgccactagtattttctctgcatacattgagctccatattaaactcacttgcttcaaatatcgaacataattgaaaaaacttatgaggaaaaagatatcctgttatattgactcctctgtttatccattctatttttctattttttcaggatcctaaagtctcaagctctttcttttatctgttttattttaatttgaagaattcctttagttaatctttaggcataggtctactggagacaaattcccttggtatccctttctctgagaatgtctgtattgatccccttacttgtaaaagatcgtgtcactggatatcaaatttggagttgacagttctttgaacacttgaaaaccgtgccacatggttatagatgaaaaactcagcatcatttgaattgttgatcccctcgaggaaaagcatagtttttgtctagttgctttcaaggtatttttttctttttttaaagtagttttattttaatgtatattggtataaattccaatgtttttatcctctttggagttcactcagcttcttaaatataagtttataccttatggtcaaaatgggaagttttcaggcatcattttatttattcatttttccagcccaatatcctttctcttctttttctgcatcggcattatttgttgttgtatttttctgaatgtctcagttcagttttttgttttcagtttattttcagagtgggtaatttatattgctgtatgttcaagttcatggatttatttgtctgtcagctccccatgtattattaagtatattcagtgtttttaaaaaatttttgtcatacttttccattttataattcctatgggatttttcgaatatgaaataagaaacttcctttgtcatagttttctatgtttagcatgtattcattcggaaagacatttcttaatcctggtctaccataagcagcaatatttgttaatgttttatgtgttctttcagtacggagaaaagaacttaaatatattactttcagtttaaagggttaaaatttcttccaggactcatttctttcaccagaaatcacaaaactgttgatattatatacagtgctgtgtttgcgtttgccttatttgaacttgtattttgatttgctctcacaacaaatcaagtgatgaaatgatgttttttagattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacgtaagtactttaatattcacgtggctggaaaaatctctgtgatgagtctgatatttcactgtttgtaacaaaatactcacagattattgaacaaccattctgctgaatgcttgcctaccaaatatttctgtcagaaagtaaagtttagaaatttttctctttagggctgggtgcggtggctcacacctgtaatcccagcactttgggaggctgaggcgggcagatcacgaggtcaggagattgaggaccatcctggctaacacggtgaaaccccgtctctactaaaaatacaaaataataataataaccggcatggtgacgggcacctgtagtcccagctagtcgggagtctgaggcaggaaaatggcgggaacccgggaggcggaggttgcagtgagccgagttcgcgccactgcactccagcctgggtgacaaagcgagactccgtctcaataaaaacaacaaaaaaagtaatttttctctttatatttatattttattttaaagcatttagttgacaaataaaaatatattttgatgtttgacaatatgttgttttgatatatttatgctacaaagattaccacaaattaattagcacattcttcatcacctatgcttagcattgggtgtaggtgggtgtgtgagtatgtgtgtgtgtgtttgtggtgaggacacttaaaatctgctttcttaccaattttcaaataaacaatacaatattattagctctaaatatcactagatctctatgtttgattccaagttcttattcatattatagctgaaagtttgtactctttgaccaatatcttaatcaaaagcagcaatgataagttctaaaacgcagggatcctaaaatgacaactgatgtaatgaatcattgataatacacccctaattctcatacattaaacatcgaacctcattttcacatcgattaccattctaagtttattcaaatcaatatgatgtttctacatagttggtttggatagtgttttgagaaataattcctgaaccatcatataacattctacttgaaaacctgaaagtctatgaagatttgcatactacttaatgttttatgtttactgttttttattttcagatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctctt

SEQ ID NO: 37944 - DNA, 86325 bp, Homo sapiens
gtcccgtgcgccctgtggtgacagctcaggaggtaggtgacaatgtcagggagctgtgggtgggagcagagcaggaaagccagggcagggctgggcaggagggagtgggcaagctgagggctgggacaccccccaacccccggcctgcagctgatgcaatgggcctgctggggcgggggtgaagggcaagcagcaatgggacacttcctgtctccaaggaaagaggaatgggaccctcctgaatgacagtaaggggatgttccctgaaccccacatggacacaccactgacacctcccagagaggcgctagcagaacaaaaactgtccccaaaagagaggaagagccatgtcctaggagcaaagggactaggtccccttctccaatccacgtaccccacttccaacaaggatagaccacactcaagagcaactggatgccctcccagacaaaggcagtatagcaaactgtagatcccagcggggcaaagggactggacccctatccctaaaaactgaaaggcctattctagggaggacaaagaggaggaggaggaggatcaggcctccccggtaccatctccctctgcaaaggcccctccctcctgcccccaacccctctgaggcagctccaccaccccatgcgtaacttgttgaccaaagcggggctcctatctcccctcccacagggtgtgtgcgctcagcaggggccagcatggaccagtctgtggcaatccaggagacgctggctgagggggaatactgcgtcatcatatccttcctgtgctaactgcggccctgagcctgccctggccttgggaagaggaatggaaggtgtcgaggtgtctatcccctctcctgcccctctgaaccatcaggggagaaggaaatcagtatttactaagtacttactgagtcctggactctcagccaaatgctttaaatacgcagttatcctcctaactccctatgaagttggggattattatcctcatttcatagataaggaaggcttagagagcctgtttgtctgttagttcagcacatggtttgagtgctcacccaaggccacacagtgaatctgggggggcaggggaacagagggaaggtgggacagcctgggtggggagaggcctcgcctctgggttgtcttcccttgactctgagccgcaggcggtgcaaggtgtgctgtgtgagggggacagccggcagagccgcctcctgggactcgtgcgctaccgcctggagcacggcggccaggaacacgcgtgagtgaggggcttggtccccacctgtctgggccatggggttgttcatcactgcaccctccagctgaacttcaactgtccctccagggcagggtctgagtctcctagaataattatcacaatgatagttaatattttttgaacactatattttaaaccctgcacacgtactaactcataatcctcaagatctaaggaggaagtttcttgagaagagacagtttaacatactagtccagatcttgagcctcgtggtccaaatgcctgggttcaaacccaggctttgttactaacaagccacatgatctattgtttgtttgttttgagaaggagtcttggtctttgcccaggctggagtgcagtggggtgatcttggctcactgcaacctctgcgtcccaggtccaagcaattctcgtgcttcagcctcttgaggagctggtattacagaggtgcccgccaccatgcctggctcatttctgtatttttagtaaagacagggtttcaccacgttggccaggctggtcttgaagtcctgacctcaagttatccacctgccttggcctcccaaagtgctaggattacaggcatgagccagcgtgcccagcctcacatgatcttttttttagagacggggtctctttctgtcacccaggctggagtgcagtagtgcactcatagctgcatgctggaactcctggcctcaggtcattctcccacttcagcctcccaaagtgttggaattttaggcatgagccaccgcacctggtggaaccacatgatcttgagcaagttgttttactcctcgatttgtccatattaaagagtaaagtgagttaggccaggtgcagtagctcatgcttgtaattccaacactttgggaggctgaggcaggaagattgcttgagcctaggagttcgagaccagcttgggcaacatagcgagaccgccccccctaccccgccccacctcccgctccccggctccatctctacaaaaaataagaaaattagctgggtgttgtggtgcatgcctgtagtctcagctactcaggaggctgaggcgggaggatcacatgagccgaggagtttgagattacagtgaactacgattgcagcctgggcaacacagcaagaccctgtctctataaaaaaaaaaacaagaaaaaaaaaacgaacaccatggggtgtgtagaaagtgctcaataaggctgggtgcagtggctcatgcctgtaatcccaacactttgggagtctgagctgggaggactgcttgagttcaagaccagcctgggcaatatagtgagacccctatctctatttcaaataatttaaaaaatataataaataaaaaaaagaaagtgctccataaatgttgtctagtaacacccacataccacacagaagcagagagagagtaatagttgtcaaaggtctcatagctggtaagtgactcagggtctaggagctgggagggagggggccttagacattttctgatccatcaccccagttttacagatgggaaacaggttcagggagagaagtgggtagctaaggttgcactgttcctgtcacacacagtgctagaatgcaccatggttagatcaaacatgtgtttgtgttttactaacaatcaggggctcctgcagatgagaaaagttctggtttgatgacctcatccataaaactgcagtctctgatgggcaccacagacagagatggcatgaggagtgtgcctagccagggcaccaccagcacagtgttagggaccaacgagcgagtgtgagcaccccgagacctccaagatagggctgagggacagccagcgggcccccatcctcacctctgcttcctgcccttagtctcttcctctatacgcaccggaggatggccattaccggggacgatgtctctctggaccagatagtgccagtctcgcgggattttacgctggaagaaggtgccacagggggctgggtggtatgaatcctctcctatgggccccccagctcatctttgtccttgatgggggggcaagggggagtaagctcaattgctaagggcattctcatttccctccccacagtgtccccagatggtgaactctacatccttggtgagtggtcctcttggtctgggtcccactcggggcaggggtgcctgattttcagagaaagaagaatggtgtaaagtaagagcaccccctgctaaacttattgcagcaagtaagaccctgtaggatctggcacagcccatctccgtgggctcatctcccatcactctcctccttgctgctgtttccgtctcccccgataacacacattctcaccccggagcccctgcacacgctgtcctctcctcctgcaagcctcacatctcttcacctagccaactcctactcagccttcagggcttccattcatgcatttctcttcccaggcagcctttgttaaacccctgaaattaggccagggcagtggctcacgcctgtaatcccagcactttgggggggccaagatcacgaggtcaggagttcaagaccagcctgaccaacatggagaaaccccgtctctactaaaaatacaaaattagccaggcatggtggtgcatgcctgtaatcccagctactcgagaggctgaggcaggagaattgcttgaacctgggaggcggaggttgccgtgagccaagatcgcaccattgcactccagcctgggcaacaagagtgaaactccatctcaaaaaacaaacaaaaaacccccaaaaaatcctgaaattgttttgtatcccatggatacatgtgtctgtccctccctccctcccttcctctctctctctctctctctttcttgacagaatctcactctgtcacccaggctggagtacagtggcatgatcttggctcactgcaacctccgcctcccaggttcaagtgattcccctgcctctgcttcccaagtagctgggattacaggcacccgccaccatgcccagctaatttttgtattttctgcagaggcggggttttgccatgttggccaggctggtcttgaactcctgacctcagatgatccacctgccttggcctcccaaagtgctgggattataggcgtgagccaccacacctggcttgcctttttcttatttttgccagcctctctcaatcagtgatgtaattctttatattgacatatttaatgtctgtctgctttgctatacaacaataataataatagaagcaaataatgagttaatgattatcccacgccagcattgtgctagaagttttacatacaccaaatcacgcttttctcttttttgtttgagacagagtctcgctctgttgcccaggctggagtgcagtggcgcgatctcggctcactgcaagctccacctcccgggttcacgccattctcctgcctcagcctcccaagtagctgggactacaggcgcctgccaccacacccggctaattttttgtatttttttttagtagagacggggtttcaccgtgttggccaggatggtctcgatctcctgaccttgtgatccaccccacctcggcctcccaaagtgctgggattacaggcatgagccaccgcaccgggcctaaatcaggcttttctcacagctctatgaggttatcactgtttgcatctccattttatggacaaggtaactgaggcccagagaaattaaacagtttagtaaggggtggaaccaagattcaaacttagagaattcagattctagagcccacactattttattttattttattttatatatatatatatattttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggtgcccgctaccatgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctttattttattttttgagacaggatcttgctctgtcactcgggctggagtgcagtggcacaaatatggctcacttcagcctcaacctcctgggctcaagcgatcctcccacctcagcctcccaagtagctgggactccacatctggctaattttttatagagattgggtggcggggggtggtgtctcattgtgttttccaagctggtctcaaactcctggctttaagtaatcctcctgccctggcctcccaaagtgctgggattacaggcatgggtcactgtgcccagcctagcccacactcttaatcgctctgctaggttgcttctgtttgtctgttagttcagcacatggtttgagtgctcaccatgtgcccggtattgggtatatgctatgaatagggaagccttctacagtctagctccctgagacgggcccacgtgtattctcttcaccatggtattccctgtgcctatcacactacctggcatagtcaggtagactgacccatggacattccctcttgtctgcctctatgtgcttttcatttcatcgggaggggaacagactacacatccagagaacctgttctttcccagttccatctagtactgcagttgaggcttactgacttttcagagccttcttctgcctcctgtataaagaggggatgatgttaatttggaactcagggtacagagggtttccttgttgtcccagcagctgtcccaagtaagttgcttaagggctgaaggggctttgggagtctgggttgctgattctccattctcaggcttaggctgcatcaagcacttagctcctggcagccaagggttcatttcctgcctcctttgtgcaggctcagatgtgaccgtccagctggacacagcagagcttagcctcgtattccaactgccctttggttcacaaaccaggatgttcctccacgaagttgccagggcctgtccaggtaggtaagaccccaggctccctgggggtgggtgggttgctgggtattcacctacccaccccagttgactctccaccctttggactcttaccccatggtttctgtgtcctttcgaagctgctggtgtaaagccatagtgcccccaggctgccagccaaccatggtgtttgcttttgtgtttacagtttctggagttgagtgttaactacagcagggcccctttgctctcctggctctgggcagggttgcacaggataggttgtgactgtgatgcagaatctcttacaagttggcagactaagcagcttcaagcggcccaacttccctctctctgccacccacagctagaactcacagctagaaccatctgtcatattggctctcctgcccttgaaccctgctgtcactcactgccgctgagaaaatggtctagctttgggctagcagtgaaacgttagtggcctttaggacaaaatttgtttagaatgggacattagcccggcaggtaaaggagagtttgtgtacagagcagaggattagtcatagaacatgcaaattcaagccaacaggtgctggggcttaaatgtttacccaccacttttagctgtcttctttcaagctatctcttgtctttgtggcaatgggagagggctggtcttctctgtggtcttgctgtggagcctgagcctccaggggcttcactttattttgcttgctgtgccaggaaggggactgcccttggattcaaactaggggataagggaaaaggaagcagaagaaacagctaggcttagtagcttgctcgtaatcccaactacttgggaggctaaggcaggaggatcaccggagcccaggagttcaaggctacattgagctatgattgcgccactgcaccgcagcatgggcaacagagtgagacccctgtctctaaaaaataaaataacaggccgggcgcggtggctcacgcctgtaatcccagcactttgggaggccaaggcgggtggatcaccaggtcaggagatcgagatcatcctagctaacacggtgaaaccccgtctctactaaaaataaaaaaattagccgggcatggtggcgggcgcctatagtcccagctactcgggaggctgaggctggagaatggcataaacccaggaggcggagcttgcagtaagccgagattgcgccactgcactccagcctagggacagagcaagactccatctcaaaaaaaaaaaacaaaaacaaaaacaaaaggaagtagaaacatgattatagagctttgaatgcctggttaagaggtttatttattttatttatttttttgagacggagttttgctcttgttgcccaggctggagtgcagtggcgcgatctcggctcactgcaatgtccacctccccggttcaagcaattctcctgcctcagcctcctgaataggtgggattacaggcgcccaccaccatgcctagctgattttttttttttttttttttgagacggagtttcgctcttgtcgcccaggctgcagtgtggtggtacgaccttggctcgctgcaacctccgcctcctgggttcaagcgattctcctgcttcagcctcccgagtagctgggattactggcgcccaccaccacgcccagctgatttttggatttttggtagagacacggtttcatcatgttggccaggctggtcttgaactcctgacctcaggtgatccgcccacctcagcctcccaaagtgctgggattacaggcatgagccaccacacccagcataattttttgtattttcagtagagacagggtttcaccacgttggtcagggtggtctcgaactcccggcctaaggtgatccacccaccttggtctcccaaagtgctggggttacaggcctaagccactgcgcccagccaagaggtttcaaatttattaagcagggggaaatttatctctaaatcttaaaataaaaggataacatattttatgattattaataatagttgtaggaggtataataatagaaataacaccaaagagcctgggctttgaagctatacagccccttgagtttgaaacccatctctgccagtacctagctgtgcaactttgggcaagctacttcacctctctgaactttagtttttgtaggcttctgtatgtaatgaataccttattcatgggttgtgagaattaaatgagataacacatgtaaaagtgcctaccacatagcaggaactcagaaaatgtttttcccctctacaagaagactcgtagctcacattcattgttgatttggcatgcgttaggcactattccaagaacttttcacacattatctcatttactcctttttaaaaaaattttttaaatttaatgttaattttatttatttatttatttatttatttatttatttttgagacagagtctcgccctgttgcccaggctagagtgcaatggcgcaatctcggctcattgcaacctccacctcctgggttcaagtgattctcctgcctcagcctcccgagtagctggtacaggcgcatgccaccacacccagctaattttttgtatctttagtagagacaaggtttcaccatgttgatcaggctggtcttgaactcctgacctcgtgatccacccacctcggcctcccaatgtgctgggattacaggcatgagccaccgtgtccagctttttttttttttttttttgagaccaactttcactcttgttgcccatctgggctggagtgcaatggcacagtcttggcttactacaacctccgcctctggggttcaagcgattctcctgcttcagcctcccaagtagctaggattacaggcacctgccactatgcctggctaatttttgtatttttatttttatttttattttattttattttattttattttttgagacaaagtctggctctgtcgcccaggctggagtgcagtggtgcaatctcagcttactgcaacttctgcctcctgggttcaagcgattctcctgcctcagcgtcccgagtagctgggactacaggcgcatgccaccatgcctggctaatttttgtattttttggtagagacaggttttaccatgttggccaggctggtctcgaacttctgacctcaggtgatccgcccactttggcctcccaaagtgctgggattacaggcgtgagcgactgtccctggccaacttttatatttttagtagagatggggttttaccacgttggccaggctagtcttgaactcctgacctcaggtgacctgcccatctcagcttccaaaagtgctgggattacaggcgtgagctaccttgcccagcctctcatttacttttatttatttatttatttattttttgtgagacggagtcttgctttgttgcccaggctggagtgcagtggcgccatcttggctcactgcaacctccgcctcttggattcaagtgactgttctacttcagcctcctgagtagctgggattacaggtgcacgccaccatgcctggctaatttttgtatttttaataaagacggggtttcaccatgttgttcaggctggtctcgaactcctgaccttgtgatctgcccacttcggcctcccaaagtgctgggaatacaggtgtgagccaccgcgcccggcctggcctcatatactctttaccacgatcttacaagggaagtattatcgatgtgtccatttcatagatgaggaaactgaggctcagagaggataagagcgttgcctgagtacctagctggtaaacgatagcgccaggattaggcaggattatatagttctactccaggccaggcacggtggctcatgcctgtaatcccagcagtttggaaggcctagacgggtggatcacttgaggttaggggttcgagaccagactggccaacatatagtgacagagcgagactctgtctctcaaaaaaaaaaaaaaaaagttctgctccagagcctgagcccttgcgtgttttgctctagtgcttccttagctcatggcaccctctcccctataaacagcccaggaaggcttcatgtaggaggtgaatttttttttgagactccctggctggagtgcagtggcatgatcttgtatcactacaacctccacctcccgggttcaagcgattctcttgcctcagcctcctgagtagctgggactacaggtgcctgccaacatgcctggctaatttttgtgtttatagtagagacagggttttaccatgttgcccaggatggtctcaaactcctgacctctggtgatccgcccgcctcggcctcccaaagtgcgggaattacaggcgtgaaccaccgcgctcggccagaggtgatatttaagcttaggctagaaggatgaagaagagtttttccccaggcaggcaacaaggaggaaaagggcttggcagtcggagggaagggcaggacctttggtggggactgaacttgggggaagaggagggtgtggagagagctgagccaggaggggtcagcagagagcatctcatgaagggtcttagctacccagcaaagagcttggactttgccctatagcttatggggaaccattaaggaattttatttatttatttattttttgatacggagtctcactctgtcgcccaggctggagtgcagtggcgtgatctcggcttactgcaagctccacctcgcaggttcatgccattctcctgcctcagcctcccgagtagctgggactacaggtgcccaccaccacgcctggctaattttttgtatttttaatagagactgggtttcaccatgttagccagaatggtctggatctcctgacctcgtgatccgcccgccttggccttccaaagtgctgggattacaggcgtgagccaccgcgcccggccgccattaaggaatttttaagctggagagtgataaggcaagatttgcaagttagaaaagttcctctggcaactggtatagaaaaagagaactagagcagggagataggaatgtactggaatggctaaggaatggaaaatgaggctgggacctgggagagccctggtgatgggaatggggaaggagggatggacttgaaaaatagagaggtcaaactgatgagaatgaaggcaccatgggggcagtgagtttgggtcacgttcacaacttcatccgcagagataagaacagtgccagcctgcaaggtggctcacgcctgtaatcccagcactttgggaggccaaggcggggcggatcacgaggtcaggagttcaagaccagcctgaccaatatggtgaaaccccatctctactaaaaatacaaaaaaattagccaggcgtggtggcacgtgcctgtagtcccagctactcgggaggctgaggcgggagaatcgcttgaacccgggaggcagaggttgcagtgagccgagatcgtgccactgcactccagcctgggcgacagagccagactccatctttttttttttgagatggagtctggctctgtcgcccggactggagtgcagtggcacgatctcggctcactgcaagctccgcctcctgggttcacgccattctcccacctcagcctcccgagtagctgggagtacaggcgcccgccagcacgcccggctaattttttgtatttttttagtagagacggggtttcaccgtgttagccaggatggtctcgatctcctgacctcgtgatccgcccgcctcggcctcccaaagtgttgggattacaggcgtgagccactgcgcccggccaagactccatcttaaaaaaaaaaagaacaccgcctgtcagatagcaggcacttaataaatatttgttgactgcaggagcagaggttggtagctatgagaatgaaagacaggagtcaaggatgacttctttcttttaggattgggtgtgtgtcttgcagtccccttacctgtcatccttctggggtccacaccacacctggggtaaccagcagagaaactctgtaccaaccaacttctctgagtgcttgtcatgatggggatttcctcagggagggacctgggttagaagggactctcagtattgacagactcttagatatccaccagcccaactctttcattttactagaggcactagaggcaaaaggaactaggttttttccacccagtccttgatggataatgttgtacagcacaaaaggccagagagtggaagtgtcttggctaagaatctactattagagaaacatcagctaacaagagatcacagttagctaacattaattgagcacctactgtgtgccagacatttttctagataccgagacaatgcacaacaactgtatttctccgtttggtcttctgaacaatactaagaagtagatatcctgttttacagacgagtaaattgacacagaggaggcaagcaacttacccaagatcaatcatcaattgaagtaataggggccggatggggtggctcacacctgtaatcccagcacttttgagaggttgaggtgggcggatcatgaggtcaggagttcgagaccagactgaccaatatggtgaaacctcgcctctactaaaaatacaaaaattagccaggcgtggtgccgtgtgcctgtaatcccagctactcaggagtctgaggcaggagaatcatttgaacccgggaggcggaggttgcagtaagcagagatcacgttactgcattccagcctgggcgacagagcaagagtttgtcccaaaataaataaataaataaataaataaataaataaataaataaataaataaaataaaaattgaagtaatgggaccaggtttgaaacttcagtttctgatgccaaagccctcggagttcagagatttcagtgcagatcccaggtctgtcacttcctaaatgtgaatgtgaacactacattttattttatctattatttatttatttatttatttatttatttatttatttattgagacagagtctagctctgtcacccaggctggggtgtggtggtgcaatcttggctcactgcaacctccacctcccaggttcaggttattctcctgcctcagcctcccgagtagctgggattacaggtgcccgccaccacacccggctaatttttgtattttctttttttcttgagacagagtctcactctttcacccaggttggagtgctgtggtgcgatctcagctcactgaaacctctacctcccaggttagagggattctcctgcctcagcctcccgagtagctgggactacaggcgcatgccaccatggccagctaattttttgtattttttgtggagacagggtttcaccatgttagccaggatggtctggatctcctgacctcgtgatctgcccgcctcagcctcccaaagtgctgggattacaggcatgcgcctggccctactatatattttattttttcagaccttggcttttttatttatacaatggaaatataaacttgccttcttcaataagccaagttttttgaggatcagacgaggccaagtatgggttaatagtatgtaaatgctgaagacaacttaaaagctgtgtctggcagtgccatagtcaggactggaactcaagtcttctcatatatcatgtccttgcacatcctattcagttcggtcgggttcatgcagctctacagacagagcaggtgggatagcaggagggttaagagcaactgttccagagtcagatagtttgagtcagagggtttgagtcagagacagaggtgactcaagaatttctaagagggagagtggcagtctggttaagggagaaacagaggacttgtcttgatatatttcatagtaaacacactgcttacttacggcgtgtgtttctctggagtgggctgccaactgctgctggaggttatgggtggtgaaatcctccaaccctctggcatcggtttgaatcctccactctgctagtcactctgcgacctcagacttaacctctctgaacttggttgccttgtatataaaatggggataataggccgggggtggtggctcacgcctgtaatcccaacactttgggaggccgaggcaggtggatcatgaggtcaggagatcaagaccatcctggctaatacggtgaaaccccgtctctactaaaatacaaaaaattagccaggcatggtgacacgtgcctgtagtcccagctactcgggaggctgaggcaggagaatcgcttgaatccgggaggcagaggttgcagtgagcggagatcgctccactgcactccagcttaggcgacagagcgagactccgtctcaaaaaaaaaaaaaaaaaaaaaaagaaaagaaaagaaaattgggataatagtttcctccctcataaaaggtgtgttacgaggagtaggaagataatatttatacgaggcacagaccttggcacatagttaccgtgaggttcaaggaatggcggtggtctctgccttggaatagtacttttgtgttcacaattattcttgcatttgaacctcagtgcgcacagaacccttctgtgcgcgggagaaacagggccggagtctcttgggataatacaatcatgcagagccggctcttcaagctcgtggctcagtctgcccccatttgttcctgcacaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggcaggtatccgtcccggaagaaacggtggggattggaggaggcccggccacagggggcgggctccgttctgttttggggcggagcgatggagaagacaggctttcgattgatggagcgggcacacgggggcgggttcgtctgggggcggagcgcgcgggacgggcggcgggatgaggagcttgaggaagcaggcagggaaatgtctgccgccgccggctctcgggagcgcaacactgcaggttcggcgggcggcgggaagctgggctggggagctgggccgggggcggcggtgcgcccggccctcgggtgggcagggtcggcggtttggccagtggacgctcggggcgaagaccaaagtcctggtggccctctggaggctgggacactggggcagaagttctgtgatgttcttcttaggcgtgcgtgacgagggtaggcgggtgggaatggggtacttgggaatccggaggctggggttttagtaaagctccgttccgaactcgctgtgtgacctcgggccactcgctgcccctctctgggcctgttgctccatctgagcttgctcttcaatcctgatcttccgagtttgtcgcgtggggcgggtgggggagtggtgccctgcctacgatagagtcttcctttgggtgaggtatggtatgtgttggggctctgtcagttctcagcccctgtgatgatagcgcagtgtacagggctggagtcttggggagccctgtctactctgggactagaggccaggatgaagttacaggttataaaaggactaggttttttcccacccagcagttggtggataatggggagcacagaaggccagttgctgagcaggagcttgtcgtttggagatgggaggctcagggctgaaatttgggtgagtccgtgctctgggaggacctgcagacctgtctttttttgtccagctccagggttttctgcaagggcccctggtgcttttttcccctgggtgtgtccgtgaggctccatttatgtgtgagctttggcatgacccctagtacctatttgtgacagtcatttgccagcaatgaagagcctgtcaagtagctgtgtaaagtgtgggccagccctccacttgctcttacaaggcttggaaactatgaggggcagggaggagtggcatgttgcacaagagtttgtaaactgagaggaaacgaggtgagcagaggacttcctcggtgcttgtttctccttcattgcagccatcacaaggtgcgatcgaagcgcctgatggtgctgatagtttgcatcttccttgggcttatctcagagttcactatcactagagtttccatgacattctgggctatggtgctgggacgggtgagagtttaagagcacctcatctccttgccccttcacaagagactgccagaatccagacaattggcggaggacaaggccaatggcagcagaaagaggtgggtgctgtgttctcagccagtacaccagagccaggccatgcaggcacttcattcccttagtcttctatgacaagtcaggccagctagctctgaagccagttagctgccccgactgagaaatgtgcagggatctcaatctttcatttcctttcaaaaaacagagactagccatatgctggtgaggaattattgttacggtttcggttttatttttattttaaaataatttgaaagctgaacatggtggcgcgtacctgtagtcccagccacttgagaggctgaggtggaaggcttgagcccaggagtttgagggtgatgtgcactatgattgatcctgtgaattagttgctgcactccagcctaggcaacatagtgagactgtctctaaaataaataaataaatagttttaaaaattttgtcagccaggcgtggtgactcatgcctgtaatcccagcactgtgggaagctgaggcgggcggatcacctgaggtcaggagttcgagaccagcctggccaacatggcgaaactccgtcactactaaaaatacaaaaattagatgggcgtggtggcaggtgcctgtaatcccatgtactctggaggctgaggtaggagaattgcttgaacccaggaggcagaggttgcagtgagccgagatcgtgccattgcattccagcctgggagacggagcaagactccatctcgaaaaaaaaaaaaatttttctcttaaaatacctacagtaagtggggtgacactattaattgctaagttgctcctgctaaaattggtaagaaatggtatcaagcccctcagttctatttgggtcatctgtttccagagttattatggcctcagaggagagttacatcttctataacaggtaggaagaaccctttgggctgcctttggatgtcgatacaggccccaagggaaacagagtagtagattgttttttcctatatgcatatgatcaaaatacccactttttgatagcctagagaacccaaagcaaacagttgcttaaaaatgctgtttctggctgggcacgatgactcatgcctttaatcccaacactttggaaggctgaggcgggcggatcatgaggtcaggagttcgagaccagcctggccaacatggcgaaaccctgtctctactaaaaatacaaaaattagatgggtgtagtggcacatggctataatcccaggtacttgggaagctgaggtaggagaatcgcttgaacccaggaggcagaggttgcagtgcgctgagatcgtgccactgcactccagcctgggagacagagcgagactccatctcaaaaaaaaaaaaatttttttttatcttatcgtaatacctacagtaagtgactgggtgacactgttaattgctaagttgctgctgctaaaattggtaagaaatggtatcaagctctccagttctgtttgggtcatctctgtttccagagttgttctggcctcagaggagagttacatcttctataacaggtgggaagaaccctttgggctgcctctggatgtcgatacaggccccaagggaaacggagtagtagatttgttttttcctatatgcatatgatcaaaatacccactacttgatagcctagagaaaccaaggcaaatggttgcttaaaaatgctgtttttggctgggcgcggtggctcatgcctaatcctagcactttgggaggccgaggtgggcggatcacaagatcaggagttcaagaccaggctgggcaacatgacgaaatcctgtctctactaaaaatataaaaattaggccaggcacagtggcttatgcctgtaatcccagcactttgggaggctgaggcaggcggatcacaaggtcaggagatcaagaccatcctggctaacacggtgaaaccccatctctactaaaaatacaaaaaaaattaactgggcatggtagtgtgcgcttatagtcccagctactcgggagtctgaggcaggagaaccgcttgaacctgggaggcagaggttgcagttagccgagatcgcgccactgcactccagcctgggcgagactccatctcaaaacaaaacaaaacaaaacaaaaaaaccccaaaaaaacagaacttagctgagcatggtggcaggcacctgtaatccctgctacttgggaggctgaggcaggagaatcagttgaacccgggaggtggcgattgcagtgagctgagatcgcggcattgcactccagtctgggtgacaagagcaagactctgtcccctcagaaaaaaaaaagctgtttttgattcacggcaggagaaacaaaggcacccctcaggagctggcagtctgactgagaggggtctgataatacgtagatagaggtaagagagtatagggttggcccagcaggacagtgttccttgtagcgtgagccaagggcatagagcacctttgaggcccaggcattttgggggataggtgaatctggtcttcattctttgcctttgcattaatagagataggaatgatctttgatgattctttcaaaatgtcctttcttttctttgatttgtctctgctgaattcaggagtgttaggctgagcttggtagagattatagtagaaaaatgaggccgggcgcagtggctcacgcctgtaatccctgcactttgggaggccaaggagggcggatcacgaggtcaggagattgagaccatcctggctaacatggtgaaaccccgtctctactaaaaatacaaaaaaattagccgggcatggtggtgggcgcctgtagtcccagctactcgggaggctgaggcaggagaatggcgtgaacttgggaggcagagcttgcagtgagctgagattgcgccactggactccagccttggtgacagagcgagactctgtctcaaaaaaaaaaaaaaagaaagaaaaagaaaaatgaaatggagctagtttcagactggaatccacgtcttcaggttcagaccagtgtctaggaggtaacttgtggtgttgaagtcaggtaatgcttttggttgagtggcagcttgttcacgtgattctcttgccaagcccagcttgcactgactttagattggtagttgaatcggtagattggtaggagtctttctgctcctgcacttatttaactgctcctttttttttttgagacggagtcttgctgtgtcaccaggctaggagtgcagtggcacgatcttggctcactgcaacttccacctcccgggttcaagtaattctcctgccttagcctctctagtagctgggactacatacatgcacctgcacgccaccacacccagctaatttttgtatttttagtagggatggtgtttcaccttgttggccaggatggtctccatctcctgaccttgtgatctgcccgcctgggcctcccaaagtgctgagattacaggcgtgagccaccgcgcctggcctcactgttcttaacatcttttttcttttctttttttttcttcctaaccactagatgaccagggatgctgttaacttccttttgcagctttttctttccttaaaaagagtgaagtctgatttgggagaaatacctcattatttccatctagcaactgaagttgctcttattcagaaaaccccattgaggatcctgtacagggcccagtacttatccaagtcagtctgtaaaatgttcacctgcattgcatcctgggtacatgcaaaacctggagctgtgttctggagggttttgaactatgcactaaaaaggaaatggctactcagaagtcccacaggggccattctgggctattttaacaaagcagtaatagcaaatacattttgtttttttttaatccaaagttgattagaaatgagccagcttcgccgggtgtggtggctcaagcctgtaatcccagcactttcagaggccgaggtgggcggatcacaaggtcaggagttcaagaccatcctggccaacgtggtgaaaccccatctctactaaaatataaaaaattagctgggcgtggtggcgtgcgcctgtatcccagctacttgagaggctgaagcaatcacttgaacctgggaggcggaggttgcagtgggctgagatcacgccactgcatgccagcctgacgacagtgagactccgtctcaaaaaaaaaaagaaatgaaccagctttgtagtaactcaaatttacaaggggatgtgtttaagtattttttcttctggacccaggaaacaaagtattaaagtctgtcatgccagtgaaaggaaatgaatgctatttatatctcagggtaacataaagggtaacctagtttaccagagtagaagccagagagcatgttagcaaaatagcccccggggtggttttctctctcactctctctttcatcttgttttgtcagtactaataggtaaaacttgtgtgaccaacatatccttttagcatggagaaaataaatttgcttttgtttatcttagagaacaaatattgcccatcatttccaccgttgtgggaagctctgcaggctcctaagtaacttattttaagtcactttgtttccttaaacaaaagagaactgtattcgtttttcttcttccttttgttgttcccctctccattttccttctttgggccatttaatccagttttatgtttctagtacaagagaaccccctaaagattctttttttcttctgaaaacagtttgttttggaattctgcagttattgttgagagcaagtgaggtgacccacaaacactcagttagaagtggagctttgaacagaaaaatcctcagggagggacagttcaggaagagggaggcatcaatatatttattagaggaaagatactgtactgttggaggatagatgctagctgacttgcatgtttttctttgctacttaaaatatactgttagcccggcacagtggtgcgcacctgtagtcccagctactcggaggctgaggcaggagtcttgcttgaggagttccagaccagcctgggcaacatagtgatatctctaaatttaaatagataaatatataaaataaattacgctctaacagttttgttattggtgatccatacatgaactgaagctagcaaatatgaatgagaagagactttctttcttggaatgccaatgatgagaatttaaacaaagtggatgtcaagaggcctggacatttttctttttcttttcttcatggttccttggtgcactattactttctctttttgtttttatttatttttatttttattttattttatttttttgagacggagtctcactctgtcacccaggctggagtgcagtggtgtgatctctgctcactgcagcctccacctcctgggtttaagcagttctcctgcctcagcctcccaagtagctgagattacaggcatgtgctaacatgtctggctactctttgtattttcagtaaagacggggtttcaacatgttggccaggctgatcttgaactcctgatttcaggtgatctgcccaccttggcctcccaaagtgctgggattataggcgtgagccatcatgcctggactaatttttatatttttagtagagacagggtttcaccatgttggccaggctggtcttgaactcctgacctcaagtgattcagcctgccttggcctcccaaagtgctggcattacaggtgtgagccaccatgcgcagcctctttttgtttttagagacgagatctccctgtgttgcccaggccggtctcaaactcctgacctcaagtgatcttcccgcctctgcctcccaaagtgctgggattacaggcatgagccaccgcgcttgacctctttgtacgatattaaacgtgtgtctcaactttcctcttatgtctttaaaatgggagtgaatgtttgcctcctggaaagtcacacaggacttaagcaatgctaattatttagacgtgctttcatttgggaaatacaattagaaatgggaaatgctggccagcagcggtggctcatgcctgtaatcccagcactttgggaggctgaggtgggcgggtcacttgaggccaggagtttgagatcagcctggtcaacatggcgaaaccctgtttctactaaaaatacaaaaattagcccggcagggtggcacatgcctgtagtcccagctagtcaagaggctgaggtacgagaatcgcttgaaccccagaggtggaggttgcagtgagccgagatcacgccactgcactccagcctgggcaagagcgagactctgtctcaaaaaaaaaaaagaaaaagaaatggtaaatgctcacctctgagaactgagaacctggctgctgtcttcagggtctatcctagggggatttcttcctgataagaactgcattggctgggcacagtggctcaggcctgtaatctcagcactttgggaggctgaggcaggtggatcacctgaggtcaggagtttgagaccagcctggccaacatggtgaaaacctgtctttactaaaaatacaaaaattagccaggtgtggtggcttgcgtctgtaatctgcgtgccacttgggaagctgagacagaagaatcacttgaaccctggaggcagaggttgcagtgagcagagatcacgccactgcactccagcctgggcgacacagcgagactccatctcaaaaaaaaaaaagaactgcacttactcctttcctccctccattttcatatttctgaatgcagtcactaacaacctcagggtatccttgactcttccctctgctctcatgtctaataagcaaattctgttcatttttttttttctgcagtgcctctcctatctacccacatttcaaaatcccccttattcatgttggtatcctcttagctgaactgttgcagtagtcttcttgtaagtcttcccaacctcaagtttccctctcctttagggatctccttagaacataactttgatcgtattctactattttgtatgtgaacttcaatattgtaccactccctgttgcctatagaataaagctcaaattccttagtatagtggtcaagtcctgcactgcctgacctcagcctgcttctctgtctggtcttatctgctacaacttatcttcatttccttttacttcaaacttgactgcttattatttctggataaagccctgtactttttcacctatttgttgacttctcattcagctacatttttgtaagcttgaacttgctgcttttagcattttgcattctctctccttcccaaatgacagccgaatgccttgtacatcagtaggtgctcaaaaaatgtctgtctctggttgaattgtagagacccatacaatttctagcccaaggtgctttgtggcctcaacaactcctgcccccttcctctttgagcatgctctgcatctctgtgttgccctccccgcttcctggtttgctcttgcccacttctcttttagctttatcaccagaccacagacagttcacagaaggcccactgaagggaagcctgagaaggaaaaattcaagtcatctctccaggggcctatcaccactaaccaacctgttgccgtaaagtaattgcactgtagtcttcctccttgaaagctaaactggtcatatttagtccttgccagcctaaattggatttgcacagggtgcaaattggatttccagtctagaacttacaggtttgcttggcatgagatgtgtttttagagatgtctgtgttcattttattttattttattttatttatttttttgagacggagtctcgctgtgtcacccaggctggactgcagtggtgcgatcttggctcactgcaagctccgcctcctgggttcatgccattcttctgcctcagcctcccaagtagctgggactacaggcgcctgccaccatgcccggctagttttttgtattttttagtagagatggggtttcaccgtgttagccagaatggtctcaatctcctgacctcggcctcccaaagtgctgggattacaggtgtgagccaccgcgcctggcttatttcattttttgaaacggagcccagcttatttcattttttgagacggagttcactctgtcacccaggctggagtgcagtgacatgatctcgactcaccttaacatccacctcccaggttcaagcagttctcctgtctcagcctcccaagtagctgggactacagacatgtgccaccatgtctggctaacttttatttatttttattatttttattttcatttttttgagacagattctagctctgtcacctaggctaaagtgcagtggcatgatctcaactcactgcaaccttcacctcccatgttcaagtggttctcctgcctcagcctcctacgtagccaggactacaggtgtctgccaccacacccagctcatttttatttatttttagttttttgagacagtcttgctctgttgcccaggctggagtgcagtggcatgatctcggctcattgcagcttccacctcctgggttcaagcagttctcctgcctcaacctcctgagtagctgggattacaggcgctcgccagcaagcccgttacaggtgcccgccaccacgcctggctaagttttgtattagtagagacggagttttgctatgttggcctggctagtctcgaactcctgacctcaggtgatccacctgccttggcttcccaaagtgctaggattacaggcgtgagccaccacgcctggtctttattttattcattattatttttaaaaaatttttgtatttttagtagagacagggtttcaccacgttggccagactggtctcgaactcctgacctcaggtgatcctcccacctcagcctcccaaagtgtggagataataggcgtgaggcactgcgcctggccctgtgttcattttaaatgatagaatctatggcacttctttttaaagctgtgagatatttgagaaatgtaaaagaaatgaaaaaagaaaactaaacatggttatttaactttgaagaaagtaacaaaacaatttgggatggtggcaaagctgaactggaaaaaatggattttttccattcttttcaatgccaggtgccctgtgttatgaatgtcactcaagagttacctgccctgtgtactatgtgctaggtaaacagctcctttttgtcataagagtaaaatccaaactctacatggcgtttgaagtcttacagtttagcctaaatttactactgttgttatcattattagtagcacttaccatttattaagcacttactttgagtccatgggccttacactgtgtcacaaaaattccataagaggatctctattatttttatttattgatttatttttgagatggagtcttactctgtcacccagtctggagtgcagtgacgcgatctcggctcactgcaaactccacctcccgtgttcacgccattctcctgcctcagcctcctgagtagctgggactacaggcgcccgccaccacgcccgcctgattttttgaatttttagtagagacagggtttcactgtgttagccaggatggtctcgatctcctgaccttgtgatatgcctgcctcggcctcccaaggctctgggattacaggtgtgagccaccgcgcctggccgaggatctctgtttttcagctgggagattgaggcttagagagggtagggtaacatgcttgtgatcactcatctggtcattggcggagtcgaaaatagaactcaggtcgcacttgagacctgactcttacactcttgttcttcttcttcttttttttttttgagacagagtctcactctgtcgcccaggctggagtgcagtggtttgatctcggctcactgcaacctccgcctcctgggtccaagtgattctcctgtctcagcctcccaaatagctgggattacaggtgcccaccaccacacctgggtaatacttgtgtttttagtagagacagggtttctccatgttggccaggttggtctcgaactcctgacctcaagtgatctgcctgccttggcctcccaaagtgctggggttataggcatgagccaccgctcccggccacattcttcttttgtatccctagtgcttctcaaataaaacttttccctacttatttatcctacttattattacttgtttccaagcataccataatgccctatctttgtgcttttgctgaagttaaattttctctgccagaaatgctttctgagcctctcgttttctcatcagtgatatagtttattggttgagagcacagactcttggctcagattccctgggtttgaaccctggctgtgtgccatttactactgtgtgctcttgggcaagttatttaacctctctgtgtatatctcctggtctgtaacgtggacataataacagcacctacctcatagagtagttgtgaggataaaatatatgtaaagtgatttaaacagtgctcaatacgtagtaagccttaagtattagtttttgtttgtttgtttgtttgtttttttaagatgtagtcttgctgtgttgcccaggctggagtgcagtggcatgatcttggctcactgcaacctctgcctcctgggtcaagtgattcttgtgcctcagcctcccgagtagctgggattataggcgcctgccaccacgcctggctaatttttttttgtatttttagtagagatggggtttcgccattttggccaggctggtcttgaactcctgacctcaggtgatctgcccacctcggcttcccggcttcccaaagtgctgggattacaggcatgaaccactgctggccaagtatttgctcttaatattattagtatttataatactatcattgtcatcatcaacagagcctgacttgtattctaggtagttggatctagagtggtttatttccccatgaattctttgctagtatgtaaggccctgtctcagacttagagagcccttggaatgtccccctggtggtgtgtgcagggcatgatcttgctggcaaacattgaacctactcacttaatccggtcagtttgaactgtcaggtattctgaagcacatggtttgcaggtattttgcttgcatggttttgcaggttcttccagtgtgctggaaatgggatgcaaaggctggtgactgagaagataggaggggacacctcctcctagacctaataggtgctcaggaagggtagaacgtgatctccacccagcagtgacagccacactcccacatatcctgtacagactgtgctgatacttttgcttggttatccaaacagatttaaaccttctattcacatcgtacttacccttgggagtttatagtttcattgatgatgatgtcctcatgcatgcaaaatgggaggctgtgggactttggagtcaagcagatctgggttttaatgtcagctgcaccatttactggctctatgtccttgagcatgtctgctatctgctctaggcctcaatttccttatttgtaaaacaaggctaataatcagacacaatgcatgaagcattgaacgtattacctaactatgagaggtacttgataaatggtagtcatcattattaaagcagtgggggattaggagtgatggagaagagggagaggaacagttcctgaatgtctgctgtgtaccaggcattgtgctaggttcgtgacccatgtagattgtatttgtttatccttttgaggtctccgtaaatatggtagcattacttccattttacaaatgaggaagcaaattaagtaatttgtttgaggtttcataagaggtgatggatggagtcagtaacatcaccagctctattttattccaaagcccaaggcattttccaaaacagtctaatgtttcttaaagtgccagacacattatatagacaggaagacactcaaaattcagagaaatgactactgagaacttatgtggctggggagggcttcatgaaggaggaggtgggagttgaggctgggcttcgaaggagaggtggccaaaaagtaggagtaacttcatatgaaggcaggagtgcggatggcatgtgtgaagaatctatccttttagatcaggctgtctttgggtgatggattgatgaaggagagtagagccatttgcaaagggcgtcagatgccaattgaaccagtttgggtcttaacctgtacaggaagatttagagcagagagatgaaatcagagtttaatcaggccaagtgcagaggctaaatgggtagggagaagtgggaagatctcttagttgggagactcctgaggtagcaagtgaggagatggtagcctggaggaaggcagctgtgagactgaagaaatggatgactaactctctctggggggccaaggagagaggtgagccgatggcaagactgtacacctggctgataggaagaatgatggtgctggtaataggcgggagagctcagggaaagagtccagaatcagactacagttttacctgggtcccccctgcatacagaacgtcttgtagaaatgcccaggggatggtggaggtgctgagctcagacagggctggacagcctcattcataatcaaccaggatggctggtgggttccttgtagaagaggaagaacaaggtctagatttgcactgtccaatgtgctagtcactagccatgtatggctattttatttatttatttatttttaagagatggggtcttgctatgttgattgactaggctagtctcgaactcctggtcccaagccatcctcccatcgtgaactcccaaagtgctgggattacaggctaaacttaatttaggtaaaatcaaattaaaaacttcagttttttggctgggcacagtggctcatgcctgtaatcccagcactttgggaggcctaggcaggctgattgcttgaggtcaggagtttgatagcagcctggccaacatggtgaaaccatgtctctactgaaaatacaaaaattatccgggtgtggtggcgcatgcctgtaatcccagctactcgggaggctgaggcaggagaattgcttgaactcaggaggcagaggttgcagtgagccgagatcgcgctactgcacttcagcctgagtgatagagcgtgaccctttctcaaatatatatatatatatatatatatatatataattatttttttttttcccccgagacggagtcttgctttgtcacccaggcaggagtgcagtggcacaatctcggctcactgcaacctctgcctcccgggttcaagcaattctcctgcctcagcctcccgagtagctgggattatcggcgcccaccaccatgcccagctaatttttatatttttagtagagacggggtttcaccatgttggtcaggctggtctcgaactcctgactgcctgatctgcttgcctcggcctcccaaagtgctaggattacaggcatgagccactgggcccggtctcaagccatattttaagtgttcaatatatattggacaacacagttatagaatattttcatcatcaaaaaggttctattggacagtactggtctagggcttgaggagtacctacaaataactaaggggcctcgaggaggaaatagagcaaaaggaggcagaaggagcaattgaatgaagaaataatgttgctgcctctcagatgattctcaaaacaaatggggtatttccattttggtttgaatttatttattttttctttgtatgatggcatgttttagaaaaagcccagactggctggacgcagtggttcacgcctgtaatcccagcactttgggaggctgaggcaggcggatcacctgaggtcgggagttcgagaccagcctgaccaacatggagaaaccccatctctactaaaaatacaaaattagccgggcgtagtggcgcatgcctgtaatcccagctactcgggaggctgaggcaagagaatcgcttgaaccggggaggcagaggttgtggtgagccgagatcgtgccattgcactctagcctgggcaacaagagcaaaactctgcctcaaaaaaaagaaaaaaaaaaaaatgaaagaaaaagaaaaagcccagactgcagtggctcatgcctgtaatctcagcattttgggaggtcgaggtgggcggatcacttgaggtcaggagttcgagaccagactgggcaagatggcaaaaccccatctctactaaaagttcaaaaataagctgggtgtagtggtgggtgcctgtaatcctagctacttgggaggctaaggcacaagaatcgcttgaacctgggaggcagagattgtagtgagccaagattgcaccactgaactccagcctgggtgacagagcgagactccatctcaaaaaaaaaaaggaaaaagaaaaacccagacaccaattcagtggtaggcctggctaccggatgttaaaatcaaggccttgctgcctatctttgttttataggtctgggccttcaacagatcttatttggcttctagaacacctcttggtcatgcagtgagggataccctcaagttaactatgggaaaagaagacagcaattgtatgaggcagacactgttatcttattcacatgaggaagcagatgcttagagaagttagataactttctcaatataacgtgtctttgactccaaagcctgtgtatgtatataaaacacaaaaaacatgttattatagctaactataggaaatacatataagcaaaaagaaaaagaaatctaatcactgagaaatgactactgttaacattttgctgtgcacccttccagactttccatgtgtctgtgtctgagtccatacaaatacagcatatgtgaatatttataagtgtggtatctatgcacacagacatatactccagtcctttctaatgcatataggtattgtcaggccatgctcattaactaccatcctcaatcccttatcagcagttctgaagtcctgaaagctctgaaggctggaacaaatttttcttgtaagtttgacccaagctcaatttggcagtaagacttgcttgaactgacatgagactatttataggctttgtttctctcactaagtattactcttcgtaagttatactgtggaaatatgaaagcgtttgattaactgggtattgcctcagaccctgctggggttgttatgtagtatttgatacaggtaatgtgttatcttcctaaaatctcccacattctgaattccaaaatgcacttggcccaagaggcttcagataagggcttgtgggtctatattaggctatgttgctgcttgggctgaggaaggcacctcaagggtcaacactgtctatttagtgaggcatgtgagagttttggttctacacaatatgcagtacaaagcacagaatttgcaagaaaaatagaacacttgcacttttacacatcgcaatcaagctgcagttgttactgtagcttgttgacttactaggtaggctgctcctagggaaatggtttcaattgtcggcatgaaaggtggtcaatgagagtacacagaaaaatcacactgagcttaatctgcctggggactgtttgtttagggtgtgtttactgactgcctggtgtgtgccatatattgtggtgagctggggccagagatagcacattggtccctgcttccaagaagctagtggtctaggtgtagaggtaagacagataagaacaattaaacccaggtatgatcccattatcataatggaaccattatcatgccttgatggaagtaagcactgagttatgtgagaatgtatggagggggccagagaaagttttttgaagataactcctgaactgagtcttgaaggatgagtttgtagttcatcacgtgaaggtggaattgggatatggaaagatatacccaggatcaggggtggagtgaataggcagtgtgtgaaaaggtaagtttggtgtgactggattgggaggtaagagagagaagcttccagtggggatgggaaatggggctggagaggaagtctgaagctatttataaagatcttttcatgcaatcctcagaggtttgggttttgttccaaaaattgttaccggaaaggggtcccgagccagactccaagagagggttcttggatcttgagcaagaaagaattcaaagcgaatctatagagtaaagtaaaggcaaatttattaagaaagtaaagtaataaagaatggctactccatagacagagcagccctgagggctactggttgccgttttaattttttaaaatttcttgattatatgctaaacaaggggtggattatgtcacgtgcttccatgtgaagagtccaccaacaggctttgtgtgagtaacaaggctgtttatttcacctgggtgcaggtgggctgagtctgaaaaaggagtcagcaaagggtggcaggattatcattagttcttataggtttgggataggtgtacaaagtacattctcaagggcggggagaatattacgaagcaccttcttaagtgggggggtagaatatatcctatcagttagggtggggcaggaacaaatcacaatggtagaatgtcatcagttaaggctattttcagttcttttgtggatcttcagttgcttcaggccatctggatgtatacatgcaggtcacaggatatgatgatttagcttgggcttagagacctgacattcctgtcttcttatattaataagaaaaacaaaacaaaatggtggtgaagtgttggggtggcgaaaattttttaggggcgatgtggagagataatgagcaatgtttctctgggctgcttcgagcaggattaggggtggcatgggaacctacagtgggagagattaaactgaagaaagattttggggtagggggtgatattgtggggttgttagaaggagcatttgtcatatagaatgattggtgatggcctggatgcggttttgtaagaattgggaaactaaacggaagacacaaggtcctaataagagaaggagaaaaacaggtattaaaggactaagaattgggaggacccaggatatccaattagagagtgtccaagggggttcagcgtaattatttgattggttggcgagttttggggctctatccttgagtttttttatgttgtcatataccaggccagattgatttaggtaaaaacaacactcttcatttaaaaaatgttttttgttgtttttgtttttgttttttgagacagactcttgctttgttgcccaggctggagtgcagtggcgtgatctcggctcactgcaagctccgccttccgggttcacaccattctcctgcctcagcctcccaagaagctgggactacaggcacccgccaccacgcccagctaagtttttgtattcttagtagagacagaatttcactgtgttagccaggatggtctcgatctcctgacctcgtgatctgcccacctcagtgttccaaagtgctgggattgcaggcatgagccactgcgcctggcccagagtccccctttttttttttttttagcagtgagtaagtcgaggcctctgtgattttagaggaaagagaaatgcaaagccagcaattgtttgttaaagaaggtttagaaacagctaggagagagtgagtgagattgatagtgtggtggagatagctggggagaggtagaggatggcataagaatgggaatgagaataagagtgagtataaaagtaaagaataggacttcatcagggtaaaagtatcggagggtgccctgtcagcaaagttcatctatccactctaagagggagtcaagagtggcggattggggatagtaccaggagatatccgctacaatggtttggaggaaaagcgtaaaccagcagtgtaaacaagggcagggcatttacaagtagttgagaatggtgaataggagtatgactagacagaagatagggatgacaagtttttggggcacagaacaagtagtgggggtgactgcgtaaagccctattgcaaaaagtagggtaaggatgaatagacctaatagaatgaagggttgtattaggctcataagggttattactgctcttcagaaatgcaaataagtttaaggaaagtaggggtgaacacttgtgacttccaggaggaagaggagagatcaggctggctgtttgacgggcacagctttattctggaatgatgaacctaatggtggggcatcctgcagacgaacagccattggggtactatagatgactaagtggggtccagtccatggaggttgtagagtttgaggggtcagattcttaacaagaactgatcatccagctagggtgtcttcatatggctgggaatctggagtaggcaagagaagatgagcagcctagcgaatttcctgtctagcctgctggaggactggaagatagttgcctagagggctggtgtctgggacgaggtcagggctgagcaagaaagtgcgtccatataaaagttcaaatggacagtaccctgtagcatctcgaggacaggctctaattctgagaagggcaaagtactgtccagtcctggccgtgagggacagaagttggaaagctagctgcttctttaactaccttatcagcataagcgttgccctgagcagtgggatctgatgccttttgatggcccttgcagtgaatgactccagcttcctttggaagtaaaacagccttgagaagagtatttattaaagaggcattaatgatggaggacccttgagtagtgaggaaacctctttctgcccatataacagcatggtggtgcaggatatggaaggcatatttagagtcagtataaatattgactcgtagtccttttgcaagaatgagggcccaagttaaggcaatgagtttagcttgctgagaggtagtggagggggtcagagtggtagcctcaatgatagatgtgaaagatactatagcatagcctccctttgctggtgagtggcgattaggcctggtggaactgccatcaataaaccaagtgttatcagggtgaggaacaggaaagaaggaaatatggggaaatggagtgaatgtcaggtggatcagagagatacagtcatggggatcaggtgtggtatccggaataatgtgggaggccggattgaagtctgggccaggaacaatagtaactgtgggagactcaacaaagagtgagtatagctgaaagagctggggggcagaaagtatatgcgtcaagtgtgaggaggaaaatagattttgaaagttatgggaactgtagagagtaagtggagcatagcttgtgattttgagggcctctaaaagtattaaagcagcggcagccaccacacgcagacgtaagggctaggctaaaagagtaaggtcaagttgtttggacagaaaggctccagggcgcggtcccggctcttgtgtaagaattccgaccacacagccctgcacttcagctgtgtgtaatgaaaaaggttgggatgagttagggagaggtagtgtgggagcatcttttagggctgttttttaaggaatggaaaggggagtggggaaaggatttaggatttatggggtcagctaggtttatctagaacagaataatgggttgtggagggaggtattgaggatgggagaatatatggctttggcaccacagggtggataggcaagacaatttggtcgatagggtgcagatcctgaactaacctgtaagactcgtgtagtttttggacaggtaaaatggggaattgtaaggagagtttataggctttaaaaggccatgctgtagcaggtgagtgataacaggctttaatccttttaaagcgtgctgtgggatgggatattggcattgagcagggtaagggtgattaggttttaatgggatggtaaggggtgcatcatccgttgccaaggagggagtagaggtgtcctatacttgtggattaaggtggggagatacaaggagaggatgtgaaggaggctttgaactgggggaaaaggaggcaatgaggtgtggctgtagcccaggaatagtcagggaagcagaaaatttagttaaaatgtctcaacctaataagggagctgggcaggtgaggataactaaaaaggagtgcataaaagaatgttttccaagttggcaccagagttggggagttttaggaggtttagacgcctggctgtcaatacccacaacagttatggaggcaagggaaacacgcccttggaaagaaggtaatgtggagtgtgtagcttccgtattgataaagaagaggatggacttaccctccactgtaagagttatccagagcatctgtgatggtcctgtaggcttccgaggcgatcgggcagtgtcagtcttcagccgctaagctgagacgatctgggaaggagtcagtcagagagccttgggccagagttccaggggctctgggagtggctgctgggtgagttggacagtctgatttccagtggggtcctgcacagatgggacacggcttaggaggaatcccaggctgcaggcattccttggcccagtggccagatttccagcactagaagcaagatcctggggaggcggtcctggaggaatgcctgacccctgaggtttaggcgttttgaagttcttgtgtgctggagatgtagctggggtttctctcacagcggaggcaagtaattacaactcttctgtattactgtaccccttgaaggtgaggtcaattaagtactgttggggggttgaaggccagaatctaatttttggagatttttctaatgtcaggagtgggttgggtaataaaatgtgtattgagaataagacagccttctggcccctctgggtctagggcggtaaagcatctaagggttgttgccaaacgggccatggactgggctgggttttcatatttgatgaaaaagagcctaaacgctaactgatttgggagaggttggataaagaaaaaggaggattaaccttggctatgccttcagctccagccacctctctgagaggaaattgttgggcaggtgggggagggctggtcacggaatgaaactgtaagccagaccgggtgtgaggaggggaggtaatagaagggttatagggtgggggagcagaggttgaagaagagttgggagctggctcggcctggcaaggagcagcctggggaggagggtagaggtcagatgggtctgtagaaaaggaggattcccaggattcagagcttggggtggagactgaaggaacagacaggagagaaagaagaaagctttgggatgaatctcattgggaacagagattaggaagggaccgatgtgtaaaagaatgcctggacgtcaggcacctcagaccatttgcccattttatgacaagaattatctagatcttgtaggatggagaaatcgaaagtgtcattttctggctatttggaatcattgtcaagtttgtattggggccaagcggtgttgtagaagaaaataagacgcttaggttttaggtcaggtgtgagttgaagaggttttaagtttttgagaacacaggctaaaggagaagaagggagaatggcgagtggaaggttgcccatagtgaaggaggtaagtttaaagagaaaggtagagacatggagaagtgggtgggtgagcagccctgggctgcaatgtgggtgagcagccaaagcaggcatccctgcaattgacttgccaccaagggaatgtgggtgaatgactaaggcaggtgtccccgcagtgatcagacaccagtggagggtgggtgaataatcaggcaggcatctccgcagtgattaaacaccaagggaagactatcttcccgagtccgtgactggcgccagagttttgggtccacggataaaatgtgtctccttgtctctttttttttttttttcctttttctggagaacggggtctcgctatattgcccaggcaggtctcgaactcctgggctcaagctatcctcccgcctcttagcctccctgagagctgggattgcaggcgtgagccaccgcacctggccgtctccttgtctctactagagaggaaaaagaattggaattggaaggacagggagattgaagggtagcaagagaggaagattgaagggtagcaagagaggcatgagaagagtgaaaagactgcttacccaatttgaagttggtgagatgttccttgggctggttggtctgaggacctgaggtcacggagtgagggcgaagacaggggactggtctcctgaaggagtcctcctgtcctgggttttggcaccaaatgtcacacgcatccttgtgaagagaccaccaacaggctttgtgtgagcaacagggctgtttatttcacctgggtgcaggtgggctgagtccgagaaaggagtcagcaaaggttggtgggattatcattagtttttatacgtttgggataggtgtacaaagtacattcttaagggcgggggagaatattacaaagtaccttcttaagggcgggggagaacatagcctatcacttagggtggggcaggaacaaatcacaatggtggaatgtcatcagttaaggctgttttcagttcttttgtggatcttcagttgcttcaggccatctggatgtatacatgcaggtcacaggggatatgatggcttagcttgggctcagaggcctgacagattattcatgcctcccctttttagaccatatagggtaacttcctgacattaccgtggcatttgtaaattgtcaaggcactggagggaatgtagcaatgaggacgaggtgggtcactctcatggccatcttggtttggtgggtgttagcaggcttctttacttgagcatgttttatcagcaaggtctttatgacctgtgccttgtgctgaccctcacatctcatccagtgacttagaatgcctaactgtctgggaatgcagcccagcaggtcttagccttattttacctggcccctattcaagatggagttactgtggttcaaatgcctctgatatttctccctcccttttataaaagagcccttaatcataagggttgcaaagggatgaaaatccatcttctgtaacttcttcatgctgaataggtcgattatattcctgcctaactatgagggtctcttgtattcagggtagagaggagctcagtcagaaagcagcagtatggcaaggccattcatgtctcttgagttccaacaaaaggtaatatctggaagattaataagtgttcaatttaagaaaacattcagtaagcttattgtgcgtttctacacaaagagtacaacagcaatgtattccacaacggtaaagcaaaataagtgaaattattccaaataaactaaattagaaggcttttcatgaactgggcaactgttggaaccaagctgatatgggattgctagctgattccaatatatgcccagaattagaatattgatccaggtttttacattacctatatctcttgtttcttctgagctgcaccagagatcactagttggttaatagaaataagtagggtcagtctaaattgcaggaaaaaacgtaaacacaactgatgagactagaacctaataaccataggttttttttttctttctttcttttttttttttttgagacagagtcttactctgttgcccaagctggagggcagtggtgcaatctcggctcattgcaacctccacctgctgggttcaggcaatcctcctgtctcaacctcccgagtatctgggattataggcacacaccaccatgcctggctaatttttgtatttttttttaatagagatgaggtttcaccatgttggtcaggctggttttgaactgctgacctcaagtgatccacccacctcagcctcccaaagtgctgggattccaggtgtgagccaccatgcccagcctaaccatagtttttgaaacatatatttttttcctctctccagtctttcatttttactaaagacaaatcatggtaagaccgatttgctttattatacttggactgattatttgtataaagtgcagcaagaataaatatttttttacataggcttttaaaattggctttgatggaagtctgcttcttaagaaatcttagataatacttttttaaagctgagcccagccatgggtttgtatcctgaagtacctgtaagttgggtaaatttctctcctcttgaggttccaagataacttggggctcctgggcctgtcagaaagtgacattctttaattaccacaggtcaagaaccctgtacagagtctgtagccaaggtatgaggccagttttctcatggggcttttattggctctgttagtcaaatttgattctttaaaggaaaacataccattccagtcaaagccttggtaaaataaccaatttctccaactgtgtcctattgcaaaaagaaacagattcttattgcacttatgcaaataattatattgccataagttgagaatactcacaaatagtttccaaattctgagaaattaggtagagtgaaacaaatacggtctaaattttgttcacaggagtatactttactcaatttttaaaagatgtaaatagctcaaaagaaaagttttcttgactctgaacaacaaaacaagggatcagcaatgttttaagcaaagtcaaaaagattactttagtcttctattagttcagtccatgcagttaacttctgttctgattgacattcatgaacatttcagctttgcatgagtcctgaaagtttttcctcaattctaatgtcacagtctccaaagttattagaaacctgcattcaagagcacttttcaaattcctatagctgattaaaaccacctttgaaagaggattaaaacaagacaacagttgtctgtggatgacaaaatgttttaaggcagccacagtcaaaaacacaactgacaaagaaatttggttaccacagtggcatgtaacaattttacataacaattgtaattattagtaacatacactaagtcatgacagaattataggagttttccataattttggaacatataccaataacatatttttgtttatttatttatttatttttgagacagaatcttgctttgtcacccagcctggagtgcagtggcacaatgatctcagctcactgcaacctctggctccagggttcaagcaattctcctgcctcagcctctcagatagctgggactacaggtgtgcactaccatgcctagctaatttttgtatttttagtagagatggggtttcaccatgttggccaggctggtcttgaactcctgacttcaggtgatccgcctgccttggcctcccacagtgctgggattacaggcttgagccaccacgcctggcctcaataacatatttatgcaaatacagcccaatgaaagccaaacactatttcatatttgacaatgcttcctttatgatttatataccaaataagccaaacttcactttgcattagtatactattaatgttaaacccaattcttaataaaaccttatagacaaatctatccaactttaatgcctgaccataaggtaagattttcattaaccttttataaccctttaaaattttttttttttttgagatggagttgtgctcttgtttcccaggcaggagtgcagtggcacgatcttggctcaccgcaacctctgcctcctgggttcgagctattctcctgcctcagcctcccgagtagctgggattacaggcatgcaccaccacacctggctaattttgtatttttagtagagatggggtttctccttgttggtcaggctggtctcgaactcccaacctcaggtgatccgcccacctcggcctcccaaagtgctgggattacagacatgagccaacgtgactggccaaccctttgtaattttttttgttgaagagcagattagtgctctaagaaaaacttactgtacttttattctaatatttaatttacagaaaaactgaataataccctcttaactttagccagtatgttcacacacagaatttcatttacaagattaacaaactcttaaactttcagttttattctatttaacttaaacaatcctttaaccctttaggcgaaaaaaaaatccacattcccgtgacttcttatttatttatttattatttttttttgagacggagtcttgctctgtcaccaggctggagctcagtggtgcgatctcggctcactgcaatctttgcctcctgggttcaagtgattcccttgcctcagcctcctgagtagatgggactacaggcacgcatcaccatgcctgactaattttttgtattttagtagagacagggtttcatcatgttggctaggctggtctcaaattcctgacctcgtgatctgtctgcctcggcctcccaaagttctaggattacaggcatgagccaccatgcctgactgacttcttataatcttttatgaaaaacatatttcagtttctttacacaccttgcatgtaaaactgtttttatttcccaaagattacttaagtcatgtgaactaaaaggcattacactttttacttttctgacaaaaaatattttatttaagcctttttctttttttggacagaatcttgctccgtcaagtataatgccgtgatcttggctcactgcaacctctgcctcccaggttcaagcaattcttctgcttcagcctcccaagtagctgagattacaggcatgcactaccatgcccagctaattttttttttttttgagacggagtctctctctgttgcccaggctgtagtgcagtggcacgatctcagctcactgcaagctccacctcctgggttcatgccattctcctgcctcagcctcccaagtagctgggactacaggcacccgccaccatgcccggctagttttttgtattttttagtagagacggggtttcaccgtgttagccagaatggtctcaatctcctgacctggtgatccacccgtctcggcctctcaaagtgctgggattacaggcgtgagccactgcgtccggccccatttttattttatttcttgattgtatgctaaacgaggggtagattattcaagcctccccattttagaccatatagggtaagttcctgacattgccatggcatttgtaaactgtcatggcgctggtgagagtgtagcaatgaggatgacctaggtcattctcgtggccatcttggtttggtgggttttagcaggcgtctttactgcagcctgttttatcagcaaggtctttatgacctgtgccttgtgccgaccctcatatctcatcctgtgacttagtatgcctaactctctgggaatgcagcccagcaggtcttagccttattttacctagctcttattcaagatggagttgctctggttcaaatgcctctgataaaatgatttaagttattgagggattttacccacagtagtgacgtgtccagatttgtgttttcttttcttttcttttttttttttgagacagggtctcactgtagtgcccagagtggaatgcagtgatacaatcatggctcactgcagcctcgagctccctggctcaagctgtcctcccccttcacctcctgagtagctgggactacaggtttgcactaccatgcccagttaattgaaaaaatatattttgggaggctgaggtgggtcgatcgcctgaggtcgggagtttgagaccagcctgaccaacatggagaaatcccatctctactaaaaatacaaaaattagctgggtgtggtggcacatgcctgtaatcccagatactcaggaggctgaggcaggagaatagtttgaacccgggaggtggaggttgcagtgagccgagattgtgccattgcactccagcctggttaacaagagcgaaacaacatctcaaaaaaaattttttttttgtagaaatagggttttaccatgttgtcttggattcctggactcaagcaatcctcctgcctcagcttctcaaagccttgggattacaggcatgagccactgtgcccacccagatttgtgttttcttctaggtgttggcagaatggaattggaggaggtgaaaatggaggtagggaaatcattaagtgggctttccagaaacattaagggcctaaactaaggcatgacagtagggatagagaagacagtcagatataaaaatatttaagagaggctgggtgaggtggctcacgcctgtaatcctagcactttgggaggccaaggtgggtggatcacttgtggtcaggagtttgagagcaccatggccaacatggtgaaaccccgtttctactaaaaatacaaaaattagctgggcgtggtggtgcatgcctgtgatcccagctttcttgagaggctgaggcaggagaatcgcttcaactcaggacacagaggagccgtgagctgagatcacgccaccacactccaacctgggcaacagagtaagactctgcctcaaaaaaaaaaaatttaatagaggattcataagacttggtgaccgaacatggggaaaaaaggaaaaatatctattgtcacctattagattgggtgacaaaaagattggaggtctgaggttaaaaaaagggcagagtgggagtagggaagcaggagaggagaaaagacaggaagctgtggccagagggggaactatggggctgtgtaatggcaaatctggtcaagagctgctctgacagccagcttccgtgccaggttctagagaggagattccgagaagaccgccctgtggctggaaatcccccacatcatgccttaaagtttccataggtagtgtaatgagtgaagatgttctggtccttgctggactgtcctgagagaccccctgtgagaagacatcgacaagatgcagggccattttcccatcagtacgctatgtacccctggccgtgaactgaatccacaaactgtcagcccttaggagatgacctttcagtctgctaggaagtacctaaagaaacatcctgagagagtcattagaaaccactgacatgcagaagcagagcacttcctcataactccttagtttgaaaagtgcaggtgcctttccatatggtaaaggcccctgaaattttgatatttaaaatccccactttatagatgaagaaaccgagacccaaagagcagaagtgacttctcatgtcacacaggaagatagtagtagagctggacgtcagctgacatttcctgatactttgctgtacttaatacatagagtgcctgctgtgcactgggcaaggaagcagaagaaagaagaccaagtccctgcctcgcagagctcacgatttagtggaaatggcatccaataataatgaataaatataagatttaatatcaggtcgggcgtggtggctcatgcctgtaatcccggcactttgagaggccgaggcaggcggatcaccaagtcaggagttcgagaccagcctgaccaacattgtgaaatcccatctctacgaaaaatacaaaaattagctgtgtgtggtggcgcatgcctgtaatcccagctactcaggaggctgaggcaggagaatcgcttgaaccttggaggcagaggttgcaatgagttgagatcgtgccattgtacttcatcctgggtgacaagagagagactctgtctcaaaaaaaaaacaaacaaaaaccgaaaacaaaaattagctgggtgtggtggcatctacctgtagtcccagctacacgggaggctgaggtatgagaattgcttgaacccaggtggcagaggctgcagtgagctgagattaccccactgtactctggcctgggtgacagagtgagtgagactctgtctcaaaaaaaaaaaagaaaaaaaaaaagaaaaattcaaagtaaacatggagatctgtgggaacaccagacaaacttccagttgaaagtagttcagccgggcgcagtggctcacgcctgtaatcccggcactttgagaggctgaggcgggcggatcatgaagtcaggagttcaagaccagcctgaccaacattgtgaaaccccgtctctactaaaaatacaaaaattagctgtgtgtggtggcacgtgcctgtaatcccagctactcaggaggctgaggcaggagaatcgcttgaaccttggaggcggaggttgcagtgagttgagatcgcaccattgcactccatcctgggtgacaagagagactctgtctcaaaaaaaaaaaaccgaaaacaaaaattagctgggtgtggtggcatctgcctgtagtcccagctacgcaggaggctgaagcacgagaattgcttgaacccaggaggcagaggctgcagtgagctgagattgccccactgcactctagcctgggtgacagagtgagtgagacgctgtctcaaaaaaaaaaaaaaaaaaaaaattcaaggtaaacatggagatctgtgggaacaccagacaaacttccagtggaacgtagttcagccgggcacagtggctcacgcctgtaatcctagcactctgggaggccaaggcgggcggatcatgaagtcaggagaccgagatcatcccggctaacacggtgaaaccccgtctctactaaaaatacaaagaaattagctgggtgtggtggcggactcctgtagtcccggatactcgggaggctgaggcaggagaatggcgtgaacccggcaggcgaagcttcagtgagccgagatcgtgccgctgcacttcagcctgggcgacagagcaagactccataaaaaaaaaaaaaaaagatgaaatggaaatctttttatgtgtattattttttcaaattgctactaagttgttaggacttaaatacttatttggccctaactacttaagtagaactgttagggattccttttggcctagaggtaccttgagaaaattattattattattattttgaggcagagtttcgctcttgttgcccaggctggagagcaatggtgcgatctcggctcaccgcaacctctgcctcccaggttcaagcgattttcttgcctcaccttcctgagtagctgggattacaggcatgtgctaccacggctggctattttgtattttaagtagagacggggtttctccatgttggtcaggctggtctcgaactcccaacctcaggtgatttgcccacctcggcctcccaaagtggtgttgggattacaggtgtgagccactgcgtctggcctcagaattgttaatcaggacccccatggaacaccattatcaactagagtacaatgcttctgtacagttccacttgcctttagtctttttttttttttttttgacagtttcactcttgttgcccaggctggagtgcaatggcgcgatctcggctcactgcaacctccgcctctcgggttcaagcgattctcttgcctcagcctcccaagtagctgggattacaggcatgcgccaccacacctggctaattttgcatttttggtagagatggggtttctccatgttggtcaggttagtctcgacctcccgacctcaggggatccgcctgcctcagccttccagagtactgggattacagacgtgagccactgctcctggtgcctttagtcttatagataccactcatttctaaagttacttaggtaaacactttttcccctactcccttcaatgaggtggtttcatacctttgtgatataggttagacacttttgtcattttctgcattttactccagaatctcctgacgtcctaaatgattttttaaaattttgtatacattaaggttcattctttttttttttttgagacagagtctcacctttcgcccaggccagagtgcagtggcgcgatctcggctcactgcaagctccacctcctgggttcacaccattctcctgcctcagcctcccgagtagctgggactacaggtgcctgccaccgctcccggctaaatatttgtatttttagtagagatggggtttcaccgtgttagtcaggatagtctcgatttcctgacctcgtgatccacccgcctcggcctcccaaagtgctgggattacaggcgtgcgccaccgtgcccagcccagtttcattctttgtgttgtaaaaatctgtgggttttgaaagctatagatactaccatgtatcaccattatagtttcttttgagtatagttttgctgtcctaaaaagtcccctgttcttcatttatttgaccccaccctcacccccaaaacccctggcaaccattgatctgtttaccgtctctatagttttgtcttatccagaatgttgtgtaattggaatcatataataaatagccttttcagatggacttccttcactcagcaatatgcatttaagattcattcatgtattttcatggcttgataactaatttttctaattgcttaatattttattatatggatgtatcacagtttattcatctgttgaaatatatcttggttgcttccagtttttggtgattttaacgctgctataaacttttctgtgcaggtttttatgtgtacaaaaattatttttcttgccatattttttagaggtgggatctccctctgtcacccaggctggagtgcagtgacaagatcacacctcactgcagccttgaactcctgggctcaagtaaccatccctccccagcctcccaagtagctaggactatgggcatgtgccactacttttatcttattttatttttatttttatttaattttattttattattattattatcattatttttaattgatcattcttgggtgtttctcgcagagggggatttggcagggtcacaggacaatagtggagggaaggtcagcagataaacaagtgaacaaaggtctctggttttcctaggcagaggacccttcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcgcatgtttcagagagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccaccttccccccctttctattccacaaaaccgccattgtcatcatggcccgttctcaatgagctgttgggtacacctcccagacggggtggtggccgggcagaggggctcctcacttcccagtaggcgcggccaggcagaggcgcccctcacctcccggacagggcggctggccggacgggggtctgacccccccgacctccctcctggacggggcggctggccgggcagaggggctcctcacttcccagtaggggcagccgggcagaggtgcccctcacctcccggacggggcggctggccgggcggggggctgacccccccacctccctcccggacggggcggctggccgggcagagtggctcctcacttcccagtaggggcggctgggcagagcgcccctcacttcccggatggggcggctggccgggcagaggggctcctcacttccccgtaggggcggctaggcagaggcgcccctcacctcccggacagggcggctggccgggcagggggctgacccccccacctccctccctccgggacggggcggctggccgggcggggggctgactcccccacctccctcccggacggggcggctggccgggcagaggggctcctcacttcccagtaggggcggccgggcagaggcgcccctcacctcccggacggggcggctggccgggcggggggctgacccccccacctccttcccggacggagcggctggccgggcagaggggctcctcagttcccagtaggggcggccgggcagaggcgcccctcacctgccggacggggcggctggccgggcggggggctgatccccccacctccctcccggacggggcagctggccgggcggggggctgacccccccacctccctcccggacgaggtggctgccgggcggagacgctcctcacttctcagacggggcggctgccgggcggaggggctcctcacttctcagacggggcggttgccaggcagagggtctcctcacttctcagacggggcggctgccgggcggaggggctcctcacttctcagacggggcggttgccaggcagagggtctcctcacttctcagacggggcggccgggcagagacgctcctcacatcccggacggggcggcagggcagaggtgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcctcacttcccagacggggtggtggccgggcagaggctgcaatctcagcactttgggaggccaaggcaggctgctgggaggtggaggttgtagcgagccgagatcacgccactgcactccagcctgggcaccattgagcactgagtgaacgagactccgtctgcaatcccggcacctcaggaggccgaggctggcggatcactcgcggttaggagctggagaccagcccggccaacacagcgaatccccgtctccaccaaaaaaatacgaaaaccagtcaggcgtggcggcgcgcgcctgcaatcgcaggcactcggcaagctgaggcaggagaatcaggcagggaggttgcagtgagccgagatggcagcagtaccgtccagcttcggctcggcatcagagggagaccgtggaaagagagggagagggagactgtggggagagagagagggagggggagggggagagggagagggattttattattttttaagagataggggtctctattgtccaagctgatctcaaactcctgggctcaagcagtcctcctgcctcagcctcccgaatagctgggactataggcacaagccatggtgcacccagcatactttcagatcagtaaatatctaggagtgtcatgggtagaacatatggtaagactgtttaactttttaagaaactgccaagctgtcttccaaagtgtctgtatgattttccatgcctactatcaatggatgagagtcatggctcctctgcatccttgtcagcaattggaattgtcagctggttttcttttttttaaatttcagtcattctaacagatgtccccaatacaccattactaactcaaataccttagctctctaagctttattatagctcagtgagagtaaagaaagagaagtagaatccagctggggattgcatttctagaaataattattaagtaactatgggttagtagaactctagacataacccattctagttctcctttcttatttttgttatattttggagacaatgggaagattacctgaaacattccaaaagaatgctacagacttgaacttggatgttacgtatttaaacatataaggcacacaggggccgggtatagtggctcatgcccgtaatcccagcactgggagacctgacgtcaggagtttgagaccagcctggccaacatggcaaaacccgtctctaccaaaaatacaaaaattacttgagtgtggtgttgcgtgtctctaatcccagctactcgggaggctgaggcaggagaatagcttgaacccgggaggcagaggttgcaaagagccaagcttgcgccactgcactccagcctgggcaacagagcgagaccctgtctcaaaaaaaaaaaaaaaaaagaaaaaagaaaaacatagacgcatggggattcaggttcattgcgcatttaatattgaattgtgtgactgtactgcctataatgtgctgggtggtatgctgaatgatggggatacagtgatgcataaatcagacaaagtctagtcctcagtaagcttacagtctaactgggaagaaaaaacacctacagtacacagcaatcaagactgtgatggggagtacagggagctatggaaacaccaatgtcagggcatctaaccagcctaggagaggttagagaagtcttcttggaggaaatgacctctaagatatggcctatagcaggagttggtgaagtgcagcctataggccaaatccagcctgccatctgctttggtacagctcatgagctaagaatgattttttgcatttttaaatgtttgaaaagattcaagagaataatgctttgtgatatgtgaaaattgtatgatattcaaatttgagcatctttaaataacatttcgttagaatgcagccacactcacagctgcttttgcactatagcagcagagttgaacagttgcaagagactgtatgacctgcaaagcctaggatatttactctgtggccctttacagaaaaagtttactgacccctggcacaggatgggtaggagttagccttataaagcagaatgaagaagagggaagttgctttctgacgggatctttgcatagctgcagtaaccttaatatgcttagagcatggcatcaaggaggtaggggctgaaggactgtggtgagtattggggctagagcagtgggtaggatccagactgggaagagccttggcaattgtatgtatggatttgggtttatccagtatgaagcctttaaaagatttaaagtgatgtgatccgatttactttttaaaaaatcctctggccacagtgtagaaactgggttggagagggtggggtgagaaaagaggcagggaaactagttgaggcttttatagtcattcaggggagatgttggtaacctagactagcacagtgacactggggataggaatatattggtttgagaggcatttaggaagcaaaattgaaaggctttggtgtcttagtttttagccttagtctgtaggctgttataacaaaataccatagactgagtggtttataagcaacagagatttggctgggtgtgatggctcacacctgtaatcccagcactttgagaggctaaggcaggaggatcatttgagctcaagagttcgagaccagcctgggaaacatggcaaaactccatctctacaaaaaaatacaaaaagttagctgggcatggtggcttgtgcctgttaatcccagctaccagagagcctgaggtgggaggatcacatgagccctggaggtcaaggctacagtgaaccatgatcaggctgctgtactccagcctggagaccctgtcccaaaaaaaaaaaaaaaaaaaaaaaaagaaaaagaaaataataaaaaaacatacaggaaaaacaccacaaaacaaaagcagagatcagagatttatttttcacagttttggaggctgagaagtccaagatcaaggtgctggcagattcaatgtctggtgagggcctgctttctggcttagtggcagctgtcttttttcactgtgttctcacatagcaaaaggggaactctagtctcctcaacccttataagggcactaatcccaatcatgagggctccacccttgtgacctaaacacctcacacctaaaggccccaactcctagtatgttatcttgggggttaggatttcaacatatgactttgggcaggggtataaataatcagtctatagcatttggtgattgattggaggcattgaggtgtaattattttcatgttcaaatgattatgctttcttttttcaaaagtttttttctggttcatgtgaatgcatggttgagaaatccatgtttagtaatagtcttcgcagcaaaattcttcagtggtgtttcattcctccagagctccttcccataacttgggttttaaaatcacatctctctgtgaccgcttcatgttgttccctgttgacaagagatctggcttttaaagagcagagaagctattggcagattaattttcctttccaggtttatcttggtttaacgactttcccaaaatatttctgggttgggcccttgggctctttggttttcaaggcaatttgtcaacaatgacaagcgcttctcattttctagagctcttagactatttccagttttaatctctgacccttgcctttctcctcttcagagtggaagtcgctatgttatgttttataatatgttgtattgcttttaaagtgcctactcatatgtcaactcagttgaccctacattaaacctgtgaagaaggcaggacaggtcaaattactgagattgagagaggttagatggcttttccaaagtcaggaggtaataaataataaagcaggtgataaaactcaggttttcagatttcatggttttattctttccttaatgtaccctttatccaagaaaagggagttagactagctggaatagttacactttcagcagtaaagatacctggatgagatacttttttctccttctgtgtatggtctgtgggacttcacccagacatcagcataggccctttgaagcaatatgtggactaccaataattcctagactacaatttccgaagctgttgtctgtatattaaagcatatgtatgtttcatttatttatttatttgtttgtttgtttgtttttgagatggagttttgctcttgttgcccaggctggagtgcaacggcacgatcttggctcactgcaacctccgcctcccgggttcaagcgattctcctgcctcagcctcccgagtaattgggattacaggcatgcaccaccatgcctggctaattttgtatttttagtagagacggggtttctccatgttggtcaggctggtctcgaactcccgacctcaggtgatccacctaccttggcctcccaaagtgctgggattacaggcatgagccaccatgtccagcctatgtatgtatattttaatttcttctccttccctttaggtggttctaactttgatggtttgagaccaaatgggaagggagtgcctatggaccaaagctccaggggtcaagataaaccagaaagcttgcaaccaaggtaatgcaactctcccttcacttgtcccttgtaggactgaggttctcctcacagtactgagaccattttgggtataatgtaagttgtcccagggtagctggcctaggaagtgtcctttttttttttttttgagacagagtttcgctcttactgcccaggctggagttcagtggcatgatctcggctcaccgcaacctccacctcctgggttcaagtgattctcctgcctcagctttcttgagtagctgggattacaggaatgtgccaccacacctggctaattttgtatttttaatagagatgggttttctccatgttggtcaggctggtctcgaacttgtgacctcatctgatcctcccatcttggcttcccaaagtgctgggattacaggcatgagccaccgtgcctggctggaaatgttcttaataatacctgacatttatttgcacttactgccaggcaccctgctcttatttggactatcttattttagcctaagaggtaagtacttttttctgttttacagttagggaaactcaggtaatgagaagttatataactcacccaaggtcccagaattatcaagtggtcaatctaggatttggaactggcagtctagccctcccttgaaaatgtagattagaaacgtttgatttcactctttcattcttttaggtgtttcctgactctgaagtgactttttttcctgttttatttactctttcctgactcgcccctgaggtgtgttattatataaatatctgaagtctgtactccagtgccccctactgaatatctccagaatctgtctggtcaagataaaacacttacttgtatcagtattttagttacgactataaatacagtacaatgcaaataataataaaatataaattctcattgcctttctttttattttggattattcctgtggaatagatgtacagaatagaatgatcaagttaaaggacctagagggttttacagtttttttctttttttttcttttgagacagagtctcactttgtcacccagtcactgcagcctccgtctcccaggttcaagtggttcttgtgtctcagcctcccgaggagctgggattataggcatgtgccaccacacccagctcatttttgtatttttggtagagatgggattttgccatgttggccaggctgatctcgaactcctggcctcaagtgagttgcctcccttggccttccaaagtgctgggattacaggcatgagtcaccatgcccggcttgtcaattacatgattgaatcccatactctgccaccattcatgtgggtgaggcgttaatgacactgggtttcatttttctcatttagaactgagggaattagattatctttaagatgcccctctggtctgagattctgtgactctattattaggaaaatctccagaccaacatattatacaatcaacaaaatataaatttacttaattccacatagaaatagtgttgttttagtagataaattttactttggcctcctttagtcttctgtgacttagatgcttgtataggggaacttttagctttgtattcattcattttgccatggggactcatccacatatgaaaaaaatacttctgtttttccagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggtagctaactgggttctaggatgttttcagagcagaatgatcatttggcactctggaatttgagcacttcctcctatacctggatttggagacatactcttctatagaatctctcccctcattttcaaaatgagtgattccatgcattctttattaacaggcatttattctgtgccctttctaggtgggcacggtgataggtgtggtatagtgggagtgacacgacttgcagatagttacagaaatatttgtggagacaaatgggtacagaagaaggagcgccatcctgattcttttatttatttatgttttatctttttgagacaaggtctcgctttgttgcccaggctggagtgcagtggtgcagtcacagctcactgtaccctcagcctcctgggcccaagtaaccctcccacctcagctgctggagtagctggtaatacacatgtgctgatttttaaatttttgtagagacagggtcgcactgtgttgcccacatgggtctcaagctcctgggcttgggcaatcctcccgccttggcctcccaaattgttgagattataagtgtgaaccaccacacctggcctcttgattcttatgtatccctccaaggttttatactcccttggcattctgggcctttgaagaaagtcatttaaaatgaaattactaaaatgaagttagctggtgtttggtaatctttttaggcaagattactaaaagctaaattaataaaggttgtgggattctgctagatctttcaaaatcgttgcattgggactataagataaaataacattgtttctagggatacaaactgtgaattatggtgaagaaatagccttttgaatactggtgttgctttcttgccaaaagtaattaccaaagcacttttcattttttcatttcagtagtatatacaaggcaaataattatgcagataatgcctgggtaatggctgtttaaaggaagtgggaatgttcggagtaggcctatactatttgaagttgttatcacaaaagtaacagataccatgacagaccgcaagtcactccttggtgctgcagtcctggtctaggttagaaatgacatttcttatgtctcaaaatgccagtccacagagacggaaaccagcataaatcagcataaaatgctttctcctgttatctccatagtgattcggagtcactaattatttctctttggtgacaggttttttgcgggaacatacaatgtaaatgggcagtcccccaaagaatgcctccggctgtggctgagcaatggtatccaggccccagatgtctattgtgtagggtgagtgcttctcttctagtcccctctccatcttcaagcacacagagctgtggttgaaggatgggtcttcacaacaggtgaaggatttgaaaaatgaacagatgcctgataacagctgtttccctgtttgatgttcttcctcatggcaagcaaatgtctgccactattaaagtggggtgcttggcatttaagtgctagtatttaatttttagtgtaatcttctgttaaaatcctgaattgcatcctgaactcagtgcatcctgaactgaactttattgcttggacattcaatacatttttggttacaaagcaaaactatcttctgccagagaagaaaggttagctgaagaaagtcccatcagttagtcttttttttttttaatcttctcatctctatactgggcattactagtggggaggggcagcaaagcttgtatggtatattgaaaagaactagaattcataatttatgtagaccaaggtttgaatcccagtttgccacttggtgcttgtgtgaactaggggttacagatgtaaaatagggacacttcgaactacttcataggctggtcatgaaaagaaaatgggtttttgtttgcaacagcacctgcaaagttccttggcatttagttccttggctctaaatgtttattttttcctcctgagggtcctgaagtttagctagaaagctagggcttatgcacctaaaccaatctgagaatgtgtcatttgcacattacttttctttactatctaactggttgcttctcaaaataggttccaggagcttgatctgagtaaggaagcttttttctttcacgataccccaaaggaggaagagtggttcaaagctgtgtcagagggtcttcatccagatgccaaatatgcaaaggtaagagaggagtcagggacctcttaattttatgttgccatgcagggaaattccaagatcatttttcaccttttccatgacctttatcttaagccagtcttaattatcccgcaattttcatttccagatcttccagaaggggtgcctccgggtgggaaagatgcagggtctcgccactcgtaggttagcacatagcatgcttggtgaattgaacagatgattacctgtgttctagtgtggagaaggagacacgtgaatactctcagccagcttccagactatgtttcctttggggtatttattcctgtttgcaatttctatttaatgccatgtctctcttttccaggtgaagcttatccgactggttgggattatgctgctgttatatgtcaaacaggagcatgcagcttatatctcagaagtggaagccgagactgtggggacaggaatcatggggaggatggtgagtccttggttggtttgtttggcacattgaggaccttagctcctgaggtattgaccacttctgatgacacagtgactacacgtgtcccagtttgaaggtgccaatattccaagatgaatcataccctcaagcagggctcagtcgagcaaactatttagaaactgttttagtgaactacctgctgatttaaccaattagcgcctgtcctcatattccccaacactagagcctccagttgatcctcccatttcacccatgaagtatgttgcagaaactatgctgggtcattcagaaaaacaaagaatgctgacagtaggtttgcaatttcctcttcttattgaggccattaaagttctgtttttaggttcttctgtgagagcttagctttgtgttttcaaagggtacctatggtttgcctgtgatttagtgaaaagaacactggattaagggagctaggttttggggctgggtgtggtggctcacacctgtaatcccagcactttgggaggctgaggtgggtggatcacttgaggccaggagttcgagagagttaggttgtggattcagctttgccattgactggctagtcattctgccttctttttttttttaatctgtacaatatagataataccacaggattattataaagattaagacaaaacattttgaaagtctgtagggttttttttttgtttgtttgtttttgagatggagtctcactctgtctcccaggctggagtgcagtggcgtgatctcagctcactgcaacctctccctcccgcgttcaaccagtgctctgcctcagcctcccgagtagctgggatgacaggcgcctgccaccacacccagctaatttttgtatttttagtagagacggggtttcaccatcttggccaggctggtcttgaactcctgacctcatgatccacccgcctcggactcccaaagtgctgggattacaggcgtgagccaccgtgcccggccagaaagtttgtaggtttaagtgactgacacaattaagtttgaattggatttctttggggatcctttccatagggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgagtgagtctgggcttccaccccatgcggttcaccatgagtacatagagttgtgggctctgtcttttcatggggagatgcctggtggtggtttcctattgctgcaatggtggtagctcccacctcttggttatacatggattatatctcttgaaaatatttagtttcctaacttgctatctggcagatctcttgagtctttctcttttcttacttttttttttttcgagatggagtcgcgctctgtcgcctaggctggagtacagtggcgtgatctaggctcactacaggctccgcctcccaggttcataccgttctcctgcctcagcctcctgagtagctgggactacaggcgcctgccaccatgcctggctaattttttgtattttttagtggagacggggtttcactgtgttagccaggatggtctcaatctcctgacctcatgatccgcccacctcggcctcccagagtgctgggattacaggcgtgagccaccgtgcccggccttcttattttatttttaaatttttatttgcatgtcatccttgctcagggactatgctaatcttctctgtatcatttcaattttagtatatgtgctgccaaagcaagcacactctagagtctttctcaagcatcatgtgtccttgggaaggtataagttttatttatttatatatttatttttgagacggagtcttgctctgtctcccaggctggagtgcagtggcgcaatctcgcctcatcacaacccccacctcccagttcaaatgattctcctgcctcagcctcccgagtagctgagactacaggtgcgtgccaccaggcctggataatttttgtattttgagtagagagtggggtttcaccatgttggccaggctggtctcaaactcctgacctcgtgatccgcccacctcggcctcccaaagtgctgggattacaggcatgagccaccacgcccggccatttgttttttcagtatttaattttatcaacatgtgtgagaatccctggctgctatagtatagcagccagaaataagaagaaagtgaggctgggtgcagtagttcatgcctgttatcccagcattttaggaggctgaggtggggggatcgattgagcccgggagttcaagactagcctgggcaacatagtaagaacctgtctctgaaaaaaatttaaaaattagctgggtgtgattctgcatgcctgtaatcccagctactcaggaatctgaggcaggaagataagagaaagggaaggggaggggaaagacaaagagaggagaaaagaaaaaagaaaggaaaggagaggagaaaggagaaggaaaagtttattttgagcagagaatatgacaaaacagcagttgacggctatattgtagtctgagttctgcttaagatttcttttttttaaagatttattttaatttgggtctgcctacctccaacattatgaagaaaacaaccaaagaatgagcatctcaaacccagtttttagaagtatgttttaggattttatttgtctgttctttccagagcatgtataattgagagttggactacatttgtttgcctccacttggtctttttttcctcttaattcaactttacaaagatatagttgcagcttctgagagcatcttgtgctcatttttgtttcttctctttactttatctcatttatctctacaacttcctctttgtctaaagtcaaagccttagaattttagactttatgataacatacgccacttcttttataaagaggaagaagccactggggccgtgatatctgccaaggagtaaacagagttaacgcctcttgtcctgcctgccgaggtggaactatctggagcattttggtgttctggaagctgacaggatggtttttcttctccagggagcctagcagggagtgtcttgcagccgagctcttccattctggtgaacctgcagcatcctagtttgtgaggtcgcagcttatgtgtcagtttgtctgcttttagtttgtggatgcattaattttggtgtgcgtgtactgctgtgcagattctctaatgacatggttgttggcttcagatacagcagtattagacttaatgagatgtacagtgtcatcagggagccttcagttagctttttcccaaagcagcagaaggaatcaaacaccttctacactccactctgcagtacagaaagagccaaccaatgatatactgctggttaaatccaggctccactataaagtttgaactttgtttcagaggaactctgctctagaaacaaaggctgagagtgtgttttgtgggttgcagtatacacagaggcagaggtggtatcgtggcatcatctgatttgggatctctgggtgattggcgtgactctcaattcttgattttttttccctcttcccaggaatggggtaaattactatcttttagatcttattagactgtctttccaacctacaagaataaaatagctaaggagaacacaaggctgtttataatgaacttggaccaagataattgagcaagcatcacattagattattaaatgggatggcgagagaaaaaaattttccgaacagttgagccattttcccacccacctcccaagaggctgagcctcaggggcctttgtcagaagcaccctgggtagatcaggttaaagttcctcctaaaccctgttacctttgtgctctgtcctcacagtgtgatcttgtggctgggggacctcaactacaggatagaagagctggatgtggaaaaagtgaaaaagctcatcgaagagaaggactttcaaatgctgtatgcatatgatcaggtacagatggccacctgtgccctcttccagcagctgtcctccaccatgagggcacagaaaagcctggcttccaaactcgcagcctcttcctccttggcttgggaggtttccctgagttcctgatgttgtccagtcatttcttcatttcatctgcatttccctcttccatagttgtctccccattggctctctcctgaagcaccttgtctcctgtgggagcaagagcatgttctctctctcaccttgtcattcatttattcaagaggtctgaagttagggctaaaagagtaccaagcttctataaagaaaggacttggtatatttaagatgatgtaataattgtttttagaatgagcctccttctcctctgtgcttctcgtcaccacacttctctagtgtgagtgacagctcttcccaagtggctttcctcactttctgtaggaatcacttctgtaacctgctgttctccatcattgcttgacgtagcgtttccttctcagagcactcgctgtttcacagtacaagagaatctgtttccctgtgactttcttctggctacttctttcagtagatttcagacctgttcaggtggtcaggttgttcagaatgttaaagtccttttttgttgttgttgttctatatcctcccttttagtaaccttagtattgtcattagtctaaatctttctattatcttttttttttttttgagacagagtcttgctctggcacccaggctggagtgcagtgttgtgacctcagctcgctgcaacctctgcctgctgggttcaagcaattctcctgcctcaacctcccaagtagttgggactacaggcacgtgccagtatgcccggctaattttttatatttttagtaaagacggggtttcaccgtgctggccaggctggtctcgaactcctgacctcgtgatccatccacctcagcctcccaaagcactgggattacaggcatgagccaccgcgcccagcctctattatctttttttccccagtgcagattaattaaagaaaaagattctcaacttagttatgtctttctctgtttatctcctctgtgttctggtctgaggcattctaatttctcttgtagtttgatacccatctctacttgccttcttttctggtctttcctgaagtagttgtacccattttgtgtgttatctgcctaccacatggttttaagctctatatgtaagggtcagcttacattcatacctacatttttactattttctgttgctttttaaatagttttttcaggaatttggcaagtagtatctactaaatagctgaccatgtgcaatgttagagctgatagttcttcaccagtccgtgtagtgccaagtgtggtgctccagggaagagggaagagcacctgtggttttgatcttgctgagagtgtgatctggaaggcgctcctaaaattaataggaaggatgctagctgttttcctaatgtgtcaggcactgtttaagttgacagtgaatctttctaaagaccctatgaggtagattctattataaatccaaaatttacagatggagaaaccaaggcacagagcttcccccagttcgcataactaatttgacaacgcagttctatctttatgtatatttggagcaactgtgctacacagatgaagtgtttgatacctggaagagaaaaactattagtttgttaagtggtacctaatcctcttaaagatatctcagtaagatgatactcaggccctttgggtgtagctatgctcttatgaaagagccttagccagacacaatggcttgcacatgcaatcccaacactttgggagaccaaggcggcaggatcacttgaggccaagagtttgagaccagcctaggcaatatagtgagaccctgcctctaaaagatttttaaatatagctgtgtggtgttgcacagctgcagtcccagctacttgggaggctgaggcaggaggattgcctgagcccaggagatggaggctgtagtgagctatggtcgcacaatggcactccagcctgggtgacagagtgagactgaaaaataaaaaacattaggctaggcgctgtggctgacgcctgtaatcccagcactttgggaggccgaggtgggtggatcacgtcaggagttcgagaccagccttgccaacatggtgaaactctgtctctactaaaaatacaaaagttagccaggcgtggtggcatgcgcctgtaatcccagctactcaggagactgaggcaggagaatcactttaacctgggaggtggaggttgcggtgagccgagattgcgccattgcactccagcctgggtgacagagcgagactccgtctcaaaataaataaataaataaataaataaataaaacattaaaaacttaaaaaataaaaaataaaaaccatatacaggcaaaagagtggtcagcttgtccacttcctaggagttagctaacttaagatcttacagaataactttcttttggggctttttcctttgggttagagtttgaattccagattgatatgcttttctccactaattcaaagtttgacctttttattctgatatttttttttctcccatccttttgtatagctgaaaattcaggtggccgcaaagactgtctttgaaggcttcacagagggtgagctcacattccagcctacttacaagtatgatacgggctctgacgactgggataccaggtaggtcagaggttgcttcaaagggttgagcaaacggaaacccagaaattctgggaagtacttgcccttttggacctaaggaagaatatatgcttcctgtgactttttccctatgttttgcactctgatcaaacattttctctcagtatctgctcatgaagcaggcttctttcccatgtattaactttgtgactgccttagcctttgttccataattttaatactggtttactttttagctgtgcctaggatgagatgattccaactaacttagctggtacttggacattacacagtagttaatatttttgtttgtttgtttgttttgagacagagtcttgctctgtcatccaggctagggtacaatggctggatcttggcccactgcaacccctgcctcccgagttcaagcgattctcctgcctcatcctcccaagtagctaggattacaggcatgtgccaccaggcccagctaattttgtagagacagggtttcaccatgttggccaagctggtcttgaactcctgacctcaagtgatccgcctgcctcagcctcccaaagtcagtagttaatatttttattagtgcttaccatgtgccatgtactatttgatgcccttgttattttctcatttaatcctcaagaacctgttgaagtaggtatgatttattaacctcattttatgagattggaaactgaagcatagaaaaattaaagaggcccccaagcagacaaggggtacaggtaggatttgaacccaggcagtgggaattcagaggctgttctcttaactagcatctttttttttttttgagacggagtctcactctgtcgccaggctgtagtgcagtggcacaatctcggctcactgcaacctctgcctcccgggttcaagcaattctcctgcctcagcctcccgagtagctgggactacaggcacacaccaccatgcccagctaatttttgtatttttagtagagacggggtttcaccatgttggccaggatggtctcaatctcttgacctcatgacctcctgacctcatgatccccctgccttggcctcccaaagtgctgggattacaggcgtgagccaccgtgcctggccttaaccaagatcttttaaagaccataggctgggtgcggtggctcacgcctgtaatcccagcactttgggaggccgaggcgggcagattgcctgagctcaggagttcaagaccagcctgggcaacatggtgaaaccccacctctactaaaatacaaaaaattagccagccatggcggtgcacacctatagtcccagctattcgggaggctgaggtaggagaattgcttgaacctgggaggtggaggttgcagtgagctgagatcacaccactgcactccagcctgggcgacagagcaagactccatctctataaaaataaataaataaataaataaaaataaaaaataaagaccatagcatgcttactgtcagattggttttttaattctctcctgattctcataggaggataaagatcagagaatcagtctgaactctgttttggctttgagctttcatggttgttttggatgatacccacaggatacatgttatcccttggtgggcccgaattgctcttgctgcctcagatgacttagccacatggacatgaaggccctgattcatcactccccacctgagccagggcactcgccaggcagcgggcactgctgtttctgtgagtacttccagtgtggactttgcatttcagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtaggtggcagctggtacctgttgtaatcattctggagggaattggctttcacaactaagaccatttcttgtctttctggtttcttcctctccttttgagagggaagaagccccttttaggacaatttaaaacaattattaacaacttggttaataattgttttagtatgcctctgcatttttcctcatacatggaagttcccttttgcatttttgaactgtctctttgcagacctttctctatgcgtttataaatgggtgtgtcagtattgtgtatacaacattgaggatatttttccttttttgtaaaagagatcatattatacattttgctctgaggacatctttttttccctgactgaatatgtcttaggagatctttccaggacagtgaaggtagagctttcttctcattatttttaaaggttgcaaagtattccatagtatggatgagccataatgtatgtattgatgatcataaagttatttccaaagttttgctattatacacagtgctgttgtgaccacccttcacatgtatgtttgtgtatcagtgtatttctatagaatgaaattattagagatgaaattagcggttcaaataaaaaatgtattttaaatttattagatcttgctaaattaccctcacaacagttttaccactttatacttctaccaaccatgtataagtttattttcccatacccttgtcaatattgggttttatcagtcttcaaaatttttgccaacccaataagcagatattttatcatgttagattacatttccctgattacctatgagatcagcatctttttcttcctttcctttttttttttttctgttgagatggagtctcgctctgtcacccaggctggagtgcagtggcgtgatttcagcttgctgcaacctccgcctcccgggttcaagcgattctcctgcctcagcctcccaagtagctgggattacaggcacattacaccacgtctggctatttttttgtatttttagtagagatggggttcgatctcctgccctcgtgatccacctgactcggcctcccaaagtgctgtgattacaggcatgagccaccgctcccagccttttctttttgttttttttcaaaagacactgttttgttctgtcacccaggctggagtgcagtgatgcagtggcacagtcacagcgaactgcggcctcaatctgctgggcttaagcaatcctcccacatacatcagcctcctcagtaggtaggattacaggcatgcctgtatgtgtgtgtcaccttacctgactaattttttttttgagatggagtcttgctctgtcacccaggctggagtgcagtggcgccatctcggctcactgcaagctccgcctcccaggttcacgccattctcctgcctcagcctcccgagtagctgggactacaggcaggcgcccgccaccacacccggctaatggttttttttttttttttttttgtatttttagtagagacggggtttcaccgtgttagccaggatggtcttgatctcctgacctcgtgatatgcccacctcggcatcccaaagtgctgggattactggcgtgagccaccgggccctttttttttttttttttttttttttttttaaagagacagcatcttgctgtcttgcccagactggtctcaagtgactcctgggctcaggtgatccttctgccttggctaccccaagtgctgggattacaggcatgagccttctcatttatttattatctatctgtggtggctctttattatcattacaatgcctcacacctgtaatcccagcactttgggaggctgaggtgggtggattgcttgagctcaggagttcaagaccagcctgggcaacatggcaaaacccctcatctctacaaaaagtaaaaaaattagctgggcatgatggcttgtgtctgtggtctcagctacttggggggctgaggtaggagcatcacttgaacccagaaggcggaggttgcagtgagccaagatcactctattgtactccagcctgggtgacagcaagaccttgttgcaaaaaaaaaaaaaaaacaaacttgagaaacactgctttaaatcaaagccttagaaaaagttctcactgctggcctgttggtggcagcaagcaaaatagagctaggtactgggcaagcatttttctgccctggtcctaagacctggcagaactaactgctaaccatgctttcacttccatgtatttttttctggtaatcaggaagcagatgcctgtaccacaagctttgcctctggcagatccttctaagtcaattgttaatggagttcattaattaactaaatctatagcctttgttttctgtgttgctatcaactgctatttcccagtgctgtgaatgccgtctatactgagaaagaggaaatgggcagaagccaaggtactcagtctctgatgtttccctttcaggtgagggtcgtaaatgacgagctttaccggaagacactggaggaaattgttcgctccctggataagatggaaaatgccaacattccttctgtgtccctgtccaagcgagaggtaggaaggacatgttaagaatattagcattgggctcaggccgggtgcagtggctcacgcctgtaatcccagcactttgggaggccaaggtgggcaggtcatgaggtcaggagatcaagaccatcctggctaacacggtgaaaccctgtctctactaaaaatacaaaaaattagccgggcgtggtggtcggcacctgtagtcccaactactcgggaggctgagacaggagaatgacgtgaacctgggaggtggagcttgcagtgagccgagatcgcgccactgcactctagcctgggcgaccaagtgagactccatctcaaaaaaaaaagattagtgttgggctcttctattcctagagcttaaatctcctcatctattggagctcagagttctaggaggcacctatagcactatggactgtggtctttcttgatagactgcttttcgataaagtgaggctgatggtgttagctgagaagagagaggttgttggcttaggtcatcatgtcctattcttctaaaccagaatatggttcaaaatgtgttttgattttagaataactattgtgtattcttgcaatggatttttcttcttactgatgctttgctttgagattaaattgagtttggatacccatgagttaatgggagggaagacagtatagaaaaggaataggtaatataggaagttgaatatggtctgaaggtttttcatggaagagccacatggaagatcactcacacttgacattctacaaagtcaaattggggtttaaggtgaaggcgttttttgtttggtttgtttgttttaaacagagtcttactctgtcacccaggctggagtgcaatggcacgatctcggctcactgcaacctccgcctcctaggttcaagcaattctcctgtctccgcctcccagtagctgggattacaggctgtgccaccatgcctggctaatttttgtatttttagtagagatggggttttgccatgttggccaggctggtcttgaactcctgagctcaagtgatctgcccgtctcggcctcccaaactgctaggattatgggcctgagccactgtggcagccgcagatggcatttttaatgccctagatgtccagctacttggaaggatgggcttgatcttcatgtttagaagtggaatttgtgaagggtattttgtaaatggtttttgggtatagaagatataaactttgacttcttcaggaagtagacatacaaaaacaaacggaatttttggattttgggttaaacacagataactagtctttagtgggaactgtggcctcccaggtagatacttaaagcagaaacatttaaaagagatggttcattttctttccatggtaaggactgcccagttggggtggctgggcaggttgctgaggaaagggcactggttttcactggccccgggcttcttcccagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccaggtaaggcctctgttcctagcttcctggtatctggtttggggaatgccttactctatatttgctcattttcctaaaatgagctttttgcttgagtgttttattctctgcttgaggctttttaaaaagccctatagatgaacccattcatgaataaaatagaaaatagtgaggagcatgagttcagtttcaaaagcattctcagtcatttatgtgttccataatttcacagaaagagaaaacataaaattgctgtatagcaggtgctgctgttaaaggaaccattttactatcttgctataatcaactcccaattatctgctcttgataatggggaagtaatccagaaattatatctggctctggaatgtaccatccacatttttcccgacttctccttcgcactctgcatggtactctgtgatggaacaatgaagggtgttttgtggacaattcacaggccgataattgcgttacacttctactgagtcagtcatcttcatcttacctggctcagggaaggctctttgatccatgccttcttattctgttagtatttctagcttgagctgtgctccttagtgcttgaattttatagcatttgtctattcaaatgtttttgtttgttgttttcatattcccagttggactataaactctttgttcttgtgtctcctgcatgccaagcacatttggatgcttgttggttggctgataccttttctttccttttcctaaccctttatgccttaccctcttccctcctgccttctttcccctttcctcttggcctgcccccggccaacattatttttaaaatttctctgcagattctgatgttgagattgacttggagctcttcgtaaataagatgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctggtgagtaatatgccacaaagaaacatctagaactttgtagcagacaagccagtcaaacaagatattcctatgcctaccttcctagggacttagaaactcttcagcttcctagagcttgcttagtgtatcagctgtatattgctgtgctacaaaccatcctgaaattttagtagtttttaacaccgagttattgctcctcatgattctgtgggtttcccatgtgggtcttctgcttgtctcacctagccccatttgtgtggttataatcagatggcagctgtgatggccggagggctccagatggcctctctcacatgtcttggtgttagcttttctctgggtttcactcaccacatggactcatcattcagaaggctagctcagtcttctgtaggtagtggcaagaacatgagagaagaactgtaaggccttttgtagcataggctccaaaatgcatacaaggccacttctgccatgttttattggtagagcaagttgtgaagccagactagattctacaagtggagaaagactccacttcttttttttttttttttttgagacggagtttcactcttgttgcccaggctggagtgcaatgacgtgatcttggctcaccgtaacctctgcctcccgggttcaagcgattcttctgcctcagcctcctgagtagctgggactacaggcatgcgccaccacgcctggctaatattttgtgtgtttttagtagagacagggtttctccacgttggtcagacaggtctggaactcccaacctcaggtgatccgcccatctcggcctcccaaagtgctgggattacaggcatgagccaccgcgcctggcttttttttttttttttttttttgagatggagtctcactctgttgtccaggctggagtgcggtggctcaatctcagcttactgcaccctccacctcctgggctcaagtgattctcctgcctctgccaccctagtagctgggactacaggcatgcacaccaccacacccagctaatttttttttttttttttgaaacagagtctcactcagctacccaggttggaatgcagtggcacatcttggctcactgcaaccaccgtctcccaggttcaatcaattctcccatctcagcctcccaagtagctgagattacaggcacccgccatcatgctaattttggtattttagtagagacgggatttcaccatgttggccaggctggtcttgaactcctgacctcaggtgatccgcccacctcagcctcccaaagtgctaggattacaggcgtgagccactgcacccagccaatttttgtatttttaatagagagggagtttcaccatgtcggccgggctggtcttgaactcctgacctcacgtgatctgcccgcctcagctttccaaagtgttgggattgcaggtgtaagccaccacgcctggccttttttgttttgttttgttttcttttgtgagtcggcgtctcactctgtccaccaggctggagtgcagtggcacgatcgtggcttactgcaacctctgcctcccaggttcaaacgattctcctgcctcagcctcccaagtagctggcattacaggtgcccgccaccatacccggctaatttttgtattttctatagagacggggttttgccatgttggccaggctggtctcaaactcctgacctcaggtgatctgcccgccccagcttcccaaagtgttgggattacaagcatgagccactgcgcccggccttttttttttttttttttttgagacagtcttactctgtcacccaggctggagtgcagtggcacgatctgggctcactgcaacctctgccgtccaggttgcaagcgattcttgtgcctcagcctccccagtagctgggactacaagtgcatgccaccatgcccagctaatttttttatatttttagtagagacggggtttcgccatgttggccaggccggtctcgaactcctgacctcagctgatccacccacctcggcctcaccaagtgttgggattacaggcatgagccaccatgccctgcctaactccacttcttgataggaaagaaaagctgcaaaatgctgtgaccacgtttttcagtagttcacttatagtatgtatctttgtttgggctgctttaacagtatcccatagactgggtggtttatcaacaacagaaatttatttcttacagttctggagactgagaagtccaagatcaaggcactgccagctttggtgtctggtgagggcctacctcctgattcatagagggccatcttcttactgtgttcttacatggcagaagaggggagggaggtctctgaggtgtcttgtttagggccactaatcccattcatcagggcagagcccttatgacctaaccatctcccaaaggccctacctcctagtaccatcacatgagggattaggtttcaacgtacatatttgagggggacatacacattcagtttgtagcagtacattagagaaactcagccatgggttgggcacagtgactcacaattgtaatccttgcactctgggaggccaaggcaggataaatgttttaggccaggactttgagaccagcctgctcaacgtaatgagactccatctctacaaaaaaattaagaaatgagctgggtatgggggtgtgcatttgtagtcctagctacttgggaagccaaggtgggagggagcctgggagttcaagtctgcagtacctgagcgatagcgcaagacagtctctaaaaaaaaaaagaagacaaactcagccatgaattctaaaataatgaaagttccatagtcaatgatattattcttttgtttttttttaaatcatcatcggtaggtcaatgatattattcttttgtttttttttaaatcatcatcggtaggttatcatcctaaactaaatttgctgccatctaaaagattcctatggagacaattctaatacaagggaactaatttggagcagacctatggtaatatgtatgctttttttccagtgcatttttaaatttagggagtcttgaactccctcttcttcatcatatagatgaaaacaggggcccaatcaaggagagtgatttgtcacaggtcatatggtgagttaacagtggacctggaggctgggtgcagtggttcacgcctgtaatcccagaactttgggaggctgaggcgggtggatcacaaggtcagaagtttgagaccagcctggccaagatggtgaaaccccccgtctctactaaaaataaaaaaattagctgggtgcagtggtgggcgcctgtattcccagctgctcgggaggctgaggcaggagaatcgcttgaacccaggaggcggaggttgcagtgagccgagatcgcaccactgcactgagcctgggcgacagagcaagactccatctcgaataaataaataagtaaataaataaataaataaataaaaacagtggacctggaggcttggtatggtggctcacgcctgtaatctcagccctttgggaggctgagatgggtagatcacttgagtccaagtgttcaagaccagcctgggcagcatagcgagaccccacctcaaaatttaaaaaaaaaatcaattaaaaaaaaaatcgggccgggcacggtggctcacgcctgtaatcctagcactttgggaggccgaggtgggtggattgcttgagctcaggagttcgagaccagcctgggcaacatggtgaaaccccatctctactaaaatacaaaaaattagccgggcgtgatggcacacgcctgtaatcccagctactagggaggctgagacaggagaattgcttgaacctgggaggtggaggttgtagtgagccgagatcgtgccattgcactccagcctgggtgacagagtgagactccgtctcaaaaaaataaaaataaaaaaaaataaaagaaaatcaaaacagtggacctgggccttgaactcagatttttggactcccaagtctgtgctgtttcctcaccagaccgcaacttctctctggttctaatagtgaaatgctataggaatgattttttcctgaaaagatggtgcatatttgacctgattcattgaaactgcttgtcataaccctctcctgattctcaaaaattaccttttgttccttgatcataccacctgatttcatttctgtctgtggaatgcgtggttaggggcagtggaatgttttcctttttctgtgggtttgctgtccccatgccatgcattttcctggagccagcctggcagaagttctgtcatgatcttgattgctttccagactctgatgccagtatggactggagatgatgggagccagttggatagccccatggaaatccccaaagagctctggatgatggttgattacctgtaccgaaatgctgtccagcaggtaggttgtgtttaagcattcagacctgattgaggccaggctgccttgaggaccatcagccccaagaacttttttcataaggaaactgtggagaactgttcttcacccagggaggggaggaaggatagatagtatgccatgtttcacactcctgggagaccctgctatttttttttttttttttttttgagacagagttttattctgttgcccaggctggagtgcaatggtgcgatcttgactcactgcaacctccgcctcctgggttcaagtgattctcccgcctcagtctcccaggtagctgggattacaggcacctgccatcatgcctggctaatttttgtatttttgtagagatgggtcttgcaacttctgacctcaggtgatccgcccaccttggcctcccaaagtgctgggatgacaggcatgagccaccgcgctctgccagaggccctgctattacgtgtagtacctgattacccccaagggaagcagcgttgcataggaagcccatcccagcacagcatagcatgttccttcccatggcctctggggtccccctgccagaaagctgcctggaggcctctcaggatgtcatcgctctccttcaggaactctcaccagcttctgggaatgggtggggccaacttgttgataaaccaagcagaggcaggggatcagatgcaacccctgggccacaaatttggaggcctgatttctagagtgactagggcagccttcactaatcagattggttagtttcactgacctgtttatataggtttcagggagacctatacaaactacaagcccactttaccacttcagagcaacatcctttttttaaaaaaatatacattcttatgatattccattttcacttttcttcccctcacatttattgaaagttgcagtgtaccaagcactattctaagtgttttttacagcattgcctctagttttcacagtagttctcagatgaggaaacagatgcctggaaaggtgaataacttggttaaggtcccaaagctgataaatgggcagaggtggaatttgaatacagtgaatctggctagagaagtcatattcttcagtgctgtactattctaccttctctgtagcactcctttcaaatggaacttttgagcaatacatataatattgttattattaatacagttatatggtattaagtcattttgtaaaacaaatgaacataaagtatcctgagactaatagaaatagctttgctgccataatctgtttttattgagatggagtctcgctctgtcaccaagctggggtgcagttcaccatcttggctcactgcaacctccgcctccccggctctagcaattctcctgcctcagcctcctgagtagctgagattacaggcatgtaccaccaagcccagctaatttttgtatttttattaaagacggggtttcaccgtgttggccaggatggtctcaatctcctgacctcgtgatccacccgcctctgcctcccaaagttctgggattacaggcataagccaacacgcctgatggctgccataattttatttgcccaaagcattgaggtgccttgttagcgttctcttatgctcttatgcactgtatattttcttcattttttttcccctgggtaatccctctataccactgcaggacacatagctgcttttacattttctccaatgttggatcttcttgtgtgatgtgtgccctacccatagttttataatagatgcctgaagacctattgtagaaacatgccagggaaggcctgcaagatgaattcgccacatcagcctaaatcagatcatctgtcaggtgattcagaggcctcaccacactgctcctttttgcattctgctattgatattgccaggtcaggaaatcattgatgattttctgagaaaataattattttgttactgtcttcccttttgcaggaagatctgtttcagcaaccaggcctgaggtcagaatttgaacatatcagggactgcttggatactggaatgattgataacctctgtatccttcagacattcagctctgtgtgtgtgtgtgtgtgtgtgtgtgtgtgagagagagagagagagagagaatatgagtgagaggggtgagaaaaagtaaagtattttatggctcaaaatctgatattgtatcctcagctaccatgttttacttaaagtttgcatagagaagactttacaactttatttatttattttttgagacagggtccatctctatcacccaggctggagcctgtggagcctcccacctcagcctcccgagtagctgggaccacaggtgcatactaccacacttggctaatttttgaacttttcgtagaggcagggtttcgccatgttgcccaggctaagaatttacaactttaagcaaccaatagagcaggaactcaggagggcctggctcacctgacaaacagtgtggtcccttcgagaagttaggctggcatcctagccctgagcagagagcctgacagggcaggcagcacttctggcatgtgcttgctcctgggccttttcctaaccatggacagcagcattatcggttccttaacaatggggccaaaagctgccagcaatcattctgtagccgaagccctgctgcttttcctggagagccttccagagcctgtcatctgttacagcacctaccataactgcttggagtgttctggcaactacacagcaagcaaacaggtgagaggaagcattgagcagcatgtggttagccccagaccccatggggctaagggaacagagtggacacagttcctcaagtgcagcatctcagaaactgaacaccttatctttccttctcaaacctgctctttctcttatgtctttgtttcttttaatggcatcacccttaattccagtgagtcaaccccgaaacctgagtcatttctgactccaccctctccttgcctcccatgtgcccagtctcgttgatctatcacccatcctctctcttccattctcattgcacttagcttggttcagtgccctgcattcacgatctccttctgctgatttgttttgcatgctgccatcagattgtgtattctaaagctattgtcatgtgactgttggtcaaaaactatacttggctctctattgccaattactgattttcttaaatattgaagacgttctatgatctagcttggtggttcacacatacaacaggccttggcagaataatctagaaaacttgccaataatagagattctaaagccacaccccaaatctactgaatcacactttttttttttttgagatggagtcttgctgtgtcacccaggctggagtgcattggcgcgatctcagctcactgtaatgcctcccaggttcaagcgattctcctgccccagcctcctgagtagctgggattacaggcgtgcaccaccatgcctggctaatttttgtatttttagtagagatggggtttcaccatgttggccaggttggtcttgaactactgacctcaggtgatccaccctcttcggcctcccaaagtgctgggattacaggcatgagccactgagcccataatcacttttggaatctattcaaacttccaaactgattctgatatgcagatagctggagtactcattgatcagggcctgatcaacccttctaattatgctcctgccaaaattgacttctcataaagtgttctctctacttacttcactatttcccttctcctgccctttttttatactttctttgctctcaccccagttattaacctctgtaagtcccattttgtcttacattcaagacccaactaaaatgtcttatttctttcagtcttataggaacatgtagttaaaagtttgacttctaaattcatgttgcatttgacccgtacctctcttttgatacttatgccaagtggtaagcaaccagttttctgtgcacagtctttctcgtgcacttggatcgtgtatacagttcttggactatagtaggcacttgagaaatgattcagtgaacaaaagacaaatcccggttcttcctctttcaggtcatttctactctccccatattccacaaaaatgtcttccactacttgatggcgtttttgcgagaactgctgaaaaattcagcaaaaaatcatttggatgagaatattctaggtaagcagccaaatgtctatggaaagcatttctgcaaactgagagactcgtaatgagaaatgaggttgaggagggtcccaggtcccttgcagtagaactaaaatatcaagctctgggcaaagattttttaaagcagaaagttttgcgtttggacactcctccccactcctaacaacacaagagtaagtatagtcatgggctgggggcggtggctcacacctgtagtcctagcactttgtgaggctcaggtggacggatcacctgaggtcaggagttcaagaccagcctggccaacatggtgaaaccccatctctactaaaaatacaaaaattagctgagtgtggtggtgcatgcctgtaatcccagctaaacgggaggctgagttaggagaatcgcttgaaactgggaggcggaggctgcagtgacccgagaccgcaccactgcactccagcctgggcgacagagtgagactccatctcaaaaaaaaaaaaaaaagtatagtcatgtaccatataacatcttggtcaacgaaagaccacatatacgatggagggcccataagattataataccgtggttttgtgcgtgtgtgtttgtgtgtgcatgtgtgtgtgtgtgtgtgcttgagaaagtctcactctgtcacccaggctggagtgcagtggtgtgatctcagctcactgcaacctctgcctcctgggttcaagtgattcttgtgcctcggcctcctgagtagctgggattataggcgcttgccactatgcccagctttttaatttaatttaatttaattttttagagatggagtctcgctctgtcgccaggctggagtgcagtggcgtgatctcagctcactgcatcctccgccacccgggttcaagcaattctcctgcctcagcctcccgagtagctgggactacaggcgcgcaccaccatgcccagctaatttttgtatttttattagagacagggttttaccatgttggccaggatggtctcaatctcttgacctcgtgattccacccgcctcggcctcccaaagtgctgggattacaggcctgagccaccgcaccctgccttttttttttttttttttttaaagggcagtgaccctccccactgcaggatgggagagggctgggagccagtgggagccagatggtcacccaggccctcacagccaacccttggacaggggccaccgggccacaccctccaacgcccgtgcctcaaccatccctaccacgctcatggaacctcatcgcatcctggggacgagcccccactggggacacggggtggttgggggaggaggcaggaaccagagaggcaggacaccaagcagggctgcctcccccacaaccccccaacctcagccacctctgacacagcaccattccccttggaaagcccactggcagggacaggctaatttttgttatttttagtagagatggggttttaccatgttggcctagctggtcttgaactcctggcctctagtgatctgcccgctttggcttcccaaagtgctgggattataggtgtgagccaccacacccagctcataataccgtatttttgatgtgcctttcctatgtttagatatatttggatgcacaaatacttagcactgtgttacaattgcctgtagtattcagtatagtaacatgctgtacaggagcttaggagcaatagactataccatctagaattgtgtaagtacaggtttgtgaaagtttaagtacacgctatgatgtttgcacaatgatgaaatcacctaatgacacatttctcagaacatatccctgtcgttaagtgatgtgtgtctttagtaccttcttttgctgaatcatttcttttctgtgttttttcttgcagctagcatatttggcagcttattgcttcgaaacccagctggtcaccaaaagcttgatatgacagagaagaagaaggctcaagaatttattcaccagttcctctgcaacccactctgagcctctctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaactttagttatttaacacagatttttttattttttatttttttttattttgagacggagttttgctctgtcgcgcagggtggagtgcggtggcacgatctcggctcactgcaacctctgcctcctgggtgcaagcaattatcctgcctcagcctcccgagtagctgggactgcaggcacacactgccacgcccagctaattttttgcattttagtagagacggggtttcaccgtgttgcccaggctgttctaaaactcctgaactcaggtaatctgcctgcctcggcctccccaagtgctaggattacagatgtgagccaccacgcccggccttttttttttttttttcttttttgagatggagtttcactcttgttgcccaggctggagtgcgttggcgtggtcttggctcactgcaacctctgcctccttggttcaagcaattctcctgcctcagcctctcgagtagctgggattataggcgtccgccaccatgcctggctaatttttttgtgtgtttttagtatagacacggtttcaccatgttggccaggctggtctcgaatgcctggcctcaggtgatccacctgccttggcctcccaaagtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggtgtggtgatgcatgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 37945 - DNA, 40985 bp, Homo sapiens
gcctgaggtgcccgccctggccccaggagaatgaaccagccgcagaggatggcgcctgtgggcacagacaaggagctcagtgacctcctggacttcagcatggtgagccaggacccccgcccagcccccgacacccctttgcctccacagttcacgggaaggttttcaggggagagtgtttgctgaatacttcagcgatggagcctcagctgtttggatgggaggccccggtggggctgggggagtgggccgctctctggcaggaggctgacagcgcacggcagcacgtgtgctatggggcttttgcccggacgcagcattctacagcctactgctttacagatggggaaactgagtcctcaggggcatggtcctgggcccccagcttggctgggtaagcaaaatgcggccttgatcttctgatctgtaaaatgggcctgatcagggtcgcttacctcattgtagatacaaaaattaaaagtaagtaaaagatcactgcactccagtctggttgacagtgagaccctggagaccctgtttcagtaaatgggaggggggctgggcacagtggttcccacctgtcattccagcactttgggaggctgaggcgggaggatcgcttgaggccaggagttccaagtccagcccaggaaacatagtgaggccccatttctcaaaaagacaaaacaaaactcaaaaaattagctaggagtggtggtagatgcctgtggtcccagctacttgggaggctgaggcaaggagaatcacttgagccctggaggttgaggctgcagtgagctgtgattgcgccactgcactccttcctgggcgatagagtaagatccttcctcaaagaagtaaaggagggggtgcccagtgctgagcggaccaccctccgtgaacagggcagacacaacctgccccatacgggactcccctggtgggcagaggatgcgggcatgaaactgactgtgtggttaattagtcacacgtgggtgctgaagttaagctgccagaagccgagcttgggccaggaggaggctggattgggattgagtgggaattcatgggccaccgagcagacagcagcgccaccattgtgactgccacggttatcactgcggagcaggcaggcccggtggggagggcggggcggcttcttcagagtcttaggtggttggatctgtccctgtacggcccattctccacctgggtgaacggaggctcagagggtgctggtcctcagaagtcacacagttcaggcaggtgcagtgaggctggaatgccggagccccctggggtaccggccgctgacgggtgctgtaaaggcccggggcctcggtttgcctgctggtacagtggggccatgtgttatgggttcctggagaagcccagggaccttggtttgtttcttctggcctgtctacagatgtccttaaattctgctccccccccccccccatgcccagtggcagcgtttggggttgaaacaggttgggggagggcactttcagtctgaatttaaccctcccgcctatgaggcacaggccactgaggtctgtcaaaaacaaaagtccccaaactgaaacaacaccggccaccctgcggaaaaaaacagcccaagggccggaggggccaaggctccggaagggccatgctggtatttttaagccccgttttatttttgcttccctggctgagtaacccgaggtgcagttgggttgttttttgttaaactgacaagtcacagaccgctgggctggaacagaccagcgtttggggggagggggcacaggttcagccccaggacctgactcctcacctcaagccactcagcacgtctccccatcccgggtcggagccgttcccagatgaggaaacaggctgggagcggcgaggtgcccgtcctctccgggcgtcccccctcgggctttacccagaggtggagttccacctccctggccaggacggggaggcagaggcagcccctgtgactgcccgcatccccactctgttcctgcatgcctgccttctgcccctgccgaggctgggtcctaggggaagcacttacttccctggaccagatgcgtataaagtgagagaacagggaactccaaataaatacgagggagaacgctaacccaggctgttcccagcgcgcctttgtcctgccctgacccaggctagctttggtcgggaacgaaggacccgccagcactggcctgggctgacatgccctgcctgggtcccaggcagtccctgggcctgagtcaggggcttcaggaatgaagggggagcgagtccctaggaccgaggctgttggaagcgagctccccaggccctgccgcgtgcgagactcccatgggcttttgggtttcaccacgtcccacacagccagagccctcggtccatttctcagaagaggaaactgatgctccaaggggtgcgggggctgttctgggctgctcatgaggcctgcagagcccacaggacacagcccggtacccatgtgacctgtggcacgttggtgcagccctggtgtcctaggggacaaagcagatagaaatgcagttggctgtcccccacagcaggcctttgtttcccaaatgagaggttggcccttggaggtctgggtccaggggaggctgggtgcaccggagcctgcgggagggggtgtggtccagggcgaacactgccttcagcgcgggtgccacccctacccgcaagaccgttcttcctctccagggccaggtgagaatgcggcctccgtttccccttctgcaggaccagggagtgggggacaaccccgcttcctgggtcccctttggacctgtggatcgtggccacaggcgctgtgccttcgcctcctggctggctggggaaggtgttggggatcttggctgctcctcagaaagcccctggctctgattccagccactttgatcacttaagccccgatgggagccttaaaacgcagccccttggggcagggcggaggcttgttgtgtttttttctgtggcaaaagggtttgttgccgttggcttttccggttaatgccgctgagcccgttaatctttagggacttagtgttctgggtacgggtgagccgggcgggagggagggtggcagtcccacacccctagcacccaggagctggatcagctgtggggtgcagcctctccccagcccctccagcttcctgccgggcccggggctccatcccgtgtcttcctcgacctgctgcctgtctgagcctcggcttccccttttgccaagcaaacccatacccagccctggtagggggacactgggccctaccccccgctccagggaccccctgctccagggcctgccatgcggggccagtgcacacacaggaaacgaggagtcagccagggctcaggcatccggggactctccacatgtccacctgttgagtgtaaacctctcacttttcagagctgaaacgtaaagacaactttgtatcactgtcaagagctgataagttgtatccttcgcctaatgggatacccctccccccagagcaaaggcagggggaacagcgagttttcagcggcagggactctgcctggcggtacagcggggtcatcgtctggagttttctcactctgggcgtgggtgtccagggtgcagcgtcacttgagggcacgcgagtcctcagagtcttctggtctgtgatggggcggagcaggacgggccgggcctagatggagcgcagtctcaggttcccgggtgtccccagctctgctcccagcttgggtttgaacccgggactgtagggtttggtttgccacccgccccgctcacgtctcccctcccctccctgcagatgttcccgctgcctgtcaccaacgggaagggccggcccgcctccctggccggggcgcagttcggaggttcaggtaggaccccgccttcctgccagcgctcgtggagtgaggagatcaagggtctgttgaagacagtgtgcgggcgagggaggctggggcagcaaaggagggagacaatggggaaagggccacacaggccgggtcgggggcagcgagcctgaagacccctgaaatcagctgccgttgcccgtgtgacctgccttgggagcccgagcccctgagcccctcgtcccctcgtccctcccgcgcctggagcctgggtctgggggctgggtggggcttgtttttaggcgcagggttggagctgggcctgtgtgtgggtggggatctcgagcatccgtttctccagtcaatccataagggggaaactgaggctctggagagggcgtggtgcgggatcccggctctcactggatcccacccaccttgtgagcctcgacgactttcatttaagcaggtattaggcgcttgctgtatgcagggcccagcaccagggtgaccggccattgtggtttgcccaggactgaggggcaattcctgggacccgcggctttgagtgctcaaagcagaaacatcccaggctgacctggatgagcgggtcaccctcgctgatgacacagcagtgggcgggacagataggggagacgtggggtcctgggggtggcctgaaaatcacactctggagcatgggcagggcttcacggcacacccagcgagggccaggttgccccaaagcgggacctctagtgaaggtctccgcagagggcgtgtcggggcagagccctgagggtgagaggaaggggccgtgggagcatgaggggaggaatttgccaggcagagagagcagcccgtacggacgccctgcggtgggaccggccggcggggcgggctaggggcgctgtgttcgttgcaggggcagcggggagccctggatggttgtgaatggagagagggtctagtctgatgtgcatttgggcggcccaggctggctgtcgacaggatttggtgggggaggttggggcgggtgcccccgatgctgcttcagagccacgggtctctttgtggacatcagcatctttccggggagtgggggcctcgggttggggcctctgaagctgtgtccttcctgcctccgggatctgggtggaaagcgccgtcctgcagttatctccagaatcccccaggggtgggccctggctggagtgtcggggttttgagtggtgggcaaagggggttctgtacttgggcacttgcacccccacatggagagacatcgctttgctgcccccactgcctcacactggccttcccctctacgtgaggaagtggccacagggctggccggaatatgctccctgaggcgtggaaatccccaaacgccaccctgccagccccccggaaacagccccaggaaccggacatgctaatgcttccctgtgtgaggcagagggtcaggccctgggggcttcctggaggaggaagcgcaactcccaaggccgtccacccccattctcctgggcctctgggtgggcttacagcagggcctggtggggagggtggggtgggaggtgtcttccctcgtcccctgtcgcctctcaccccctcagccctggcacggaccactgtgagattggtccctgggtaaccagagctgtggtgtgtaggccgtgtggacctgagaatgctccctctgggttgcctctccctggacgcccagcccggtcccagcaggaacctgccaatgtttgcagatgtattttctgtggttcccacagagtctcgccctgtgctccggccctgccccaatgctgcaggttgggagggtctcgccttgtcccctcacacgttagggcggaggctttggagggcccagtgaggcccagtatgttgcattttttgcccttgagggacgtgatgtggctgctccagcctgggaccccccagctcctggacacagaggggtgaccccctccccgttcagtccatgcagttaacgcccgcctgagcccgggggtggtggaggatgcagagctccaaggcctgagttggtggcaccctcctcattgcctccactcccccaggcccctgcaggctgtggcgctggccccaggtgtggccctcccgaagctcccgcaagatgggcacctgctctcttccatcgtcaggttcagcgagtcgatgggtgcgaggggcggagggatcccggcagggcccaggagctgcagtagctcatttccccgcttcctgcttctcctctccgaggacccaggaagaggggagtttggggctcatcagcaggatggagccccggagctgtgggatcccttcccaaacctcggcttcttcctggaacagtgggtgcagcttccttccaggcggggcctagttggcttcggggacgccacccttcgccaggagtccccaacgctgatggctgatggggtaccccagccgcattctccaccttggccccttcttcatgtgccctgttctagctcccttttaagtcacctcgcttttcttaagttcatttgaaaggaaactttagatttgagaaccagaaacccaggtgagaataaaaggtgtccctgaaaattaattaaacataagttttcccctgtgaagggtctgcctgttcttcgatatttataaatatttaaaaattggtgtcgagagaggagttaggtactgggcaaggtggctcacacctttaatcccagcactttgggaggccaaggcaggaggatcgcttgaggccaggaggtcaaggctgcagtgagctatgtttgagccactgcgctccagcctgggtgactgagagaccccaactcaaacaaacagaaaagggccagacacagtggttcatgcctataatcccagcactttgggggaccaaggcggaaggatcgcttgagcgcaggagttagagaccagcctgggtaacacagcaaaacctcatctctactaaaaatacaaaaattagctgggcgtggtggcgcacacttggggtcccagctactcgggaggctgaggcaggaggattgctggagcctgggaggcggaggttgcagtgagctgagattgcgccactgccctgcagcctgggtgacagagccagaccctgtctcaaaacagaaacgaaacaaaaaaggcattagagattaacgaataggaaaccaagattttctggttgtctggatcggaagacatttaaaacgggaataattttcgtacgccttctcccacccaccgcctcccatttttggaaaccctcaggcacaggtctctgagtgacagcctatcttctgccaagacagacaggctctgaggccacgggagacaccaggaaattgcttattgacggaccaaaggaaagttctttcctatttttcatttccccgtcgctttctctgtccgtgcgattgtaagtgtgacacacggtcagagtgaaaatccacagaacggcacctccgcgttctgctttaagaggaaaccccgggagaacctggcgcatgggtcatttcctccgggtgcgtgtctgggagtggaattgctgggtccctggatgctttttcacattgaaagcgtcccttgtgaccgggcgcggtggctcaggcctgtaatcccagcacttgggaggccaaggcaagaggagtacctgggactaggtgttcgagaccagcctggccaacgtggtgacagcacggcctgtctcatttaataggtgacaaagatcgtgtcctttcacctgccacttgtttaatagagggcggtggtcttctcggaaggggattgaccctgtgaatggctctctggtgaattttctgttactctcttgggccctcgtccttgaagttgatccactttttattctgaagtctttcgggattcacaggaagtggcagagtgttctcctctcacctagccacccccaggggtaccgtcccgcccacccgtggtgctgcgtcagacctaggaagccgacattggtgccgtccacagatcctgatcagattccaccggctttacacgcacgtgtgtgtgtctgtgtgtgcgtgcgggtgtgtgtctgtgcgtgtgcgcgtctgtgcgtgtgcgtgcgtgtgtgcgcacgtgtgtgtgcgtctgcgcgtgcgtgtctgtgcgtctgcgcgtgtgtgcgtgtctgcgtctgtgtctgcgtgcgtgtgtgtacgcgtgcgtgtgtgtgtgtgtgtgtgtgtgtgtgtgtgtgtgtagttctgtgcagttttgagacatgcaccttctttaagcccaggaatcaccaatctgttcttcatctgtacgattttttttttttagggaccaggtctcactctgttgtccagactggagtgcagtggtgtgatcataactgactgtagccttgaagttctgggctcaactgatcctcccacctcagccttgtgagcagctgcgaccacctaattaaaaaaatatgtattttgtagagggctgggtcagcggctcacactggtaatccccagcactttgggaggttgagatgggagaattgccggagcccaggagttcaagaccagcctgggcaacatggagaaaccctgtctctgtttaaaaaaaaagaaaaatttcagctgggtgcggtggctcacacctataatcccagcattttgggaagccagggtgtgtggatcacatgaggccaggagttcaagaccagcctagtcaacgtggcgaaaccccgtctctgctaaaaatacaaaaattagctgggcgtggtggtgcgtgcctgtcatcccagctactcgggaggctgagacacgaaaagcacttgaacctgggaggcggaggttgcagttagctgagattgcgccactgcactctggcctcggggacagagggagaccgtgtctgaagaataaaaaaatattgtctagatggggtcttgctgtgttctccaggctgatcttgtattcatgagctcaagtgatcctcttacctcagcctcccagagtgctgtgattacatgtgtgagccactgtgcccagcccaatttttcactttgagtattttgtgtaaatggaatcctatagtttgcaaccttctgagattagcttttattctgttacgttagcataattccctggagatccagccaagctgttggctgtatcttttttttttctttttattgctgcctcattaactttttttttttttttgagaccgagttttgctcttgttgcccaggctggagtgcagtggcacgatctcagctcactgcaacctccgcctccgcctccgcctcctgagttcaaacgattctcctgcttcagcctcctgagtagctgggaatataggtgcctgccaccatgcctggctaattttttgtagttttagtagagacatggtttcgccacgttggccaggctggtctcaaactcctgacctccagtgatccacccacctcggcctcccaaagtgctgggattacaggcgtgaaccaccgcgcctggccgcctcattaactttttaacaacatcagtaatacaacaatttacatcactttttttttttttttgagacggagtcatgctctgtcacccaggctggggtgcagtggcgtgatctcagctcactgcaagctccgcctcccaggttcacgccattctcctgcctagcctccctagtagctgggactacaggtgccggctaagtttttgtatttttagtagagacggggtttcaccttgttagccaggatggtctccatctcctgaccttgtgatccgcccgcctcggcctcccgaagtgctgggattacaggtgtgagccactgcttacatcagtgtttcttgagcactgtgcattggacacaaagcttggcttattcactgggaattctcagttctaacaggttagcgaaataggtgtaattattaccgtattttactggtaaagaagctgaaacttagagagtttagtaaccattgcgctaattttttgtatttttagtagaggcagggtttcaccgtgttagccaggacagtctcggtctcctgacctggtgatcctcccgcctcggcctcccaaagtgctgggattacaggcatgagccaccgagcccggcctcatttggctgtttgataatgtttgtaggcgcctgtctgtccacccgtgccaaaagtgctgggattccaggcctgaccctctgcgcctggccccgttcggctctttgataacgtttggaggcgcctgtctttccacctgcgcagggaggctgagggcgccgcggtcctcaatgcgccaacttttaggtggtttctttgttcttgactcggctgccctgtgcattttctctctctcgttgatttttcttctggagaatctgcttcattggcaaatcgatattgatcaattgatcaattttcctctttatcggcatttcttctctttctaaagtttttggtgactttcagatcacaggccccttttgctgacttctgccctcttctgttccatcagtgtggtgttgagggttccaccccgtgaaccccatcccattggtttccataatgcatgtttttctcatattactgacatttgttcctttttttttttttttttttttttcctaatttcctcttcaggtcaggttgcttcagaggtttctgagttccaagttggaggtcctttcttgatttctagatctccagtgccaaaactcagctttggcttaaacggtagctactgtttggaggacgcagagctcctctgccgaggctgaaacatggattatttttgtccttctttgtgagtacttgagggatagttggatgtggagctgcgaggcctttgaaccatatttagatttttaatctgtttaatgtcaggctgagagcagcgccatccccctctgttctgtttgtcggtttctctgttgacgtatttagatgccaggattgtgggcttgtgtgggctgagacagtgggatttcgttgtgggtcgagccattgtcaacaacaaaaaaatccgttccttggctggtggtggtggctcatgcctgtaatcccagcactttgggaggccaaggcaggtggatcttctgaggtcaggagttcaagaccagcctggcccacagggcgaaactccatctctactaaaatataaaaaattagccaggcatggtagcaggtgcctgcaatcccagctgctcgggaggctgaggcaggagaatcacttgaacctgggaggcagaggttgcagtgagctgagatcgcgccaccgcactccaccctgggcgacacagcgagactctgtctcagaaaaagaaacctcccttgaattgaaacttcgatatgaaggttgcaacccttcctttttgttggtgtggcttggcagatctttgtgctcctggttgtatctcctgagtcgcttgtttcaaaactgtctttggtcggcaccgtgttttcagattaaagacgttaagcacccgtccatcttcgttctcagcttttccttccatcgtcttattttgtttttccatctgtgtgctcccaactccggattgcttcccccggtgtgtgttttctgaagctctgtaccgctttgcggctctgccagtggttcttttctagttttgaataacacgtttaaggccgtgattgaatagcggttagtattctgcgttgtgaagaacacgtttaaacacgccgtttctcgcgctctcaacgtccgaagtgaaatcgcatctgcccccttctgtgagaaggtgaaaattgagcctgtatatttctcttccctgctggtatttgctaccaataaattgctacttttaaaaaacattgtccgaggccagcggatcatgaggtcaggagatcgagaccatcctggttaacacggtgaaatgccgtatctgttaaaaatacaaaaaaattagccgggcgcggtggtgggcgcctgtagtccagcctgggcgacagagccagactcagtctcaaacaaacaaacaaaaaaaacaaaaaaacattgtatctgttcataattgtgtatttgcatcttactaggaaacatttgtatcattaaatagtgactttgctacttactgtgagggcttgagcaaatggcatctatcttttgcgtcagtttccttatctgtagggtaggggtaatgtagccactgcaaggattcagtgaaatgagagagaactcacaaagtgcccccagagggctttccttgtgtgcctgtcttgttacggcttctaggaatctcttgattcgtaattaaatgtgctcactgtctacttcattccatagaacccccaggctctgccatttctttgaggatccatggggcttacaggcttaagacagtcttctcgttttttagggtaaatcattgaacttcttgaacttcatcctttttgttccatgttgggttccctcttgtgtctctttttctttttcttttttttttgaggtggagtctcgctctattgcccaggctggagtgcagtggcacgatctcggctcactgcaagctctgcctcccgggttcgcgccattctcctgcctcagcctcccgagtagctggtactacaggtgcccaccaccacgcccagctaatttttgtatttttagtagagacgggggtttcaccctgttggccagcatggtcttgatttctggacctcgtgatccgcccgccttggcctcccaaagtgctgggattacaggcgtgagccaccgtgcccggccccgggttggtttctgagcttgttttgaggggcaggttctccggtccccacactcaggtgtcactggtgatgcccatagacatggaagcaagagcgggatggggtctcggttatctctgtggtcactgaaattcaaagcggggccctgtttctctgagttgttacttaacatctgtgctcgatgcccactctcggggccagctctgccctccagggaaaccccagggccttgggggagcggggttgcaaggcgcccctgcttctgggggagaaggttgtccctggttctggtggaggaggttgtcctcggttctggtagaggaggttgccaggcatccccggttctggtggaggaggttgccaggcgtcctcggttctggtggaggaggttgccaggcgtcctcggttctggtggaggaggttgcgaggcgcccctggttctgggggaggagcttgtccctggttctggtggaggaggttgtccccgcttctggtggaggaggttgccagttgtccccggttctggcggaggaggttgtcccccgtgctggtggaggaggttgcgaggcgtccccggttctggcggaggaggttgcctgtgttgcccgcacagcctcactgtgcctctacccgagggcacgtcctgccactttaggtgctgtggggacccccactcttagggtggtgtgtggtctccactcacattctcttcagcctcaggtttgtctgctcgcgggcgggccacagggccctgctgtcccaccccccatcgccagacattagaggcagatcgaagtgggaggctttgcgggatctcgtcagccccccaacaaggaagggctctgtggtgccccagaagcattttctcccccactcgggatcctcctcagaagctgggagcatgtgctacacagcctgcgggccctgaccaagaagacacgacaggaagataaacccagggcggctgcagtgcgcgagctgggccgagggcatcctggtctttcatcttctcccatagcttgaatttagataaaatggaggctgtgcacgcctgtgaccccagggctttgggaaatacaaggtgggaggagcgcctgagtccaggagtttgagaccagcctgggcaatgtagtgagaccccatctctacaaaaaaatttttttaaattcaccaggcgttgtggctcatgcctgtaatcccagcactttgggagtctgaggcagacggatcacttgaggtctgggattcaagaccagcctggccaacatgtatgaaaccccgtctctactaaaaatacaaaaattagctgtgcgtggtggcaggctcctgtagtcccagctacgtgggaggctgaggcgggaaaatcacttgaacccaggaggcggaggttgcagtgagccaagatcgcaccactgcactccagcctgggcaacaagaccctgtctcaaagcaaaagaaaaaaaaaattttttaaaatactgctccacccaaggaaaggccacccccggattcaaacctctgtctgatctcacccgtcatgacccccagaggggctgggaatgggtctgagaagcatcacaagctgcaggggccagacccaggcagggcggtgggacaggctgccatcggggtccttcacgattttaattataaggaggaagaagagacggggcgaggcacgggcttggggggtcatagtgaccctgtatcgggtggcccgctcctactcccgagtaaacggaacctgcgtgaggagctgtcgaggtgttaattggtttttagacgtgaccgtggtatttggtggtggctgttatttcatttgcttttggggactgggttgttcagtacagcaggcattagccatatacacatttttaaatgtaatttttaatgtgcttgaaaaaatgctggccacgtttccagcagttggtagtgtggtccccgtattggacagcagaggtggagaatattttgatcctccaggaaaatgttcttggaagcacagttatttatgagtaaaatgaagacgttgagggtgggtgttttgggggcgtcagctgtgttccaggcagtgctgcagacaaagaggggtcccaggctgggaaggggctcaggcagggggtgtgggtgggggtcacctcctgtgttggggaagaggagagtggtgagatcaggaaagagtttggtctttatcctgaggacggtggggagccatgagagagggtagagggagggagaagagccaagttttgcttctaaaggctccatccggctgcctgaggatgtcagcagacttggaaggaagctgctgcagggactgggcttaacccgctgctgtagctatggggcaagctgctgttctttgggaggagggaaggtgaggaggactcccaggactttagcctgagcacctgagtgggggcacattgcagagctggggctataggatgaagtccccaggcccatctgaagccagaccacctggtggtgtgcctgagggtttggcaggggcggtacacagggctgtgttcagggcccgtgtccaccaatagttttgcctgcccggcatggtaaccccactcctggtactgaagtctgtcgattgggtttcttgtgcagaggcagctgaaggcacttggacagtctttttctgtatcaaggtcagccagccttctccggaaaggaccaaggagtgaatattgttggctgtgcaggacagatggtctctattggaattgattcaactctactgttgcagcaaaagcagccgttgatagtacatggacaaacgggcatagtgtgtgccaataaaactttatttaaaaagcagcttaggggccagacttggtccttgtgtactgtttgcagatccctgctgcagaccaatctcagtcctacccggtatttactaagcgccttttgaagcctccctctcccatttgccaacgagccaccaggcaaagaccagtccccggtccctctcaggaggggacccaacagggaccgggactgggaaaccaccagcctggagcattccttggctacggatggcctctctgaagcagcatctttcattgttatcctcacggcagcccaggcaggtgggcggcttccacaccccgtgactggaattggaactgaagcccaaggggtgggccgctcctggggccctctccccagcgcccctgcgccgtccactcgcaggcctctcccgaggcagccaggctggcccagggcaggaaggtgcccttcccgggtaaaactctgcggtgcttcaccaaagaaatcacagaaaaccacactctgacagcagtgtcttattctattagtacattttaattagaacaggagcaatggatgcattatgaatattcatggtgggttattaaaatgcatcattaatcggtgggggggattttaataactgtattaatgtgggggctgtccttatttttgtcatttctaggaggaggccaaggctgggtgagggagggttcccccaaagggcagattgaggccgcagtgcctctggcacaggcctgttggagtgaacttcgggggcgatccctgggcatggggccccaggaggtcccccaccacaccaggccttccaggggatgagggctggggtgccaggagcctcccgtttgctcagttgggggtctctgcacctcctggggtactggctatggccggaggggaccagacaacatgcaggtggtatagaggcaaactgagacccagagggtgccggcgctgtgcccacccctacacagccagcccaccctggcctcagcagctgccctgttcaccagggcccacgtgcaggaccaggatcttggggtgcagatggcccagacctggcagcgaatgccgtgtggattcctggagaccacaggagccccctgcctggcccccaacccagccaaggcagcatcccagccccccactcataatcacattggaaatttttgattagaaaacaaaatctaaatgaggcgcatgaatattcattagacttggagattaatatgcataattatgcaaatcagacagcaattaaacaccaatactccccggggggaatgattaacacaaaggcaccgaaatagaaggatgcgatttgaaagaagtttctggtgtggatgagcagggagggcagggggcggggcgggggagcctgcagaacagcctgaggtggtgccggtcacagacatcagcactgggctgggtcccccaggcctggctctcgggaagcctctggacttgggagttggacatggacacccccagccctgcaaaagtagggcctgtttgtaaatcatttatagagagggaaaccaaggcagggcagcaactccgtggccaagctgaggaggcccagggcccgctcctgcttctccacgggtgtgctctgtggcccccgatggaagggggaaggatccaagcaggccctccctgcccagggcagaagattctggagtcctgggcgttgcctgtgagtgttctgagagataagggccccgcccgccccgccccgggaccaaggtcctcgtcccgtcccttgctgcgccgggaactcctgccccacgcaggcttctggtctccacactgggcttgttcctgggtgatgagattcggctccaccctcacgggctgccagcctcctgcccgatgggtgagcctctgctgctgcttcagcaaagggcggccccacttcccacactggcaggtggggacagggagaccctgggcctccccagagctcatgggttagcttccacaccctcatgctgtcatgagcctttctcacagggtcagaagagtctgcatctgacacagagaccccagtccacatagtcagggctgggccagagggagggacttggggctgatggggaggaggctcggcgtgagagtgaggtctttgcccaaggagggtatgaaagctggggctttagtgggtgggtaggagttggccagcagagagccgacggaagagttaatttaagtttatggacctgtaagtgctccgagtcccagggtgtctgggtgttagctgctgactggtgtcctcatgagtcgggctgggtgaggctgggttaggaagggttccacaagccccccgggtccactgaggtttgcccctgagatgatgaaccgaagcttttagagctgggcaggcgtgagggtgacccataactctctctgtcctgcctgcaggtcttgaggaccggcccagctcaggctcctggggcagcggcgaccagagcagctcctcctttgaccccagccgggtaggagtccccgtgaggcctgagaccctgagtttcctgtccccagagttgggggcgaggggtgtggggaaactgaggctgagagaaggggccagccttccaggggtttggactgggggacatgggtttgagtcctgcctctccagctgtaatgcggggtggagggggggcctgtgaagccccagcacctctcatccccaccccatctcccctagaccttcagcgagggcacccacttcactgagtcgcacagcagcctctcttcatccacattcctgggaccgggactcggaggtgagtgcctggcctggtgcggtccctctgctgtgcacagatgtgcagacgtgggccttggcatggtcagtgcacgcacagcgccaggcaagtccccagcgttcacccagagggtgtggacagccgaagcctctgcccgtcctgggagcagctgcggggaggtgcaggggacgtggcccggactccctggcacggcactctgcaactaggcttccccgcctgagcgtagaggcagggaggccgttccagaccccacttcctccctgggatttctgcagggctcctcctgcttcccggggaggggtcagccgggctggcctgtgcccgctgggaaggaggcgtaggagttctggagactcgggagggcggccagagtgtgcggtggtcagagcccatgcccttccgcagaccgcccgcccgccctctttccctggggggccctcctgttaaccgagagaatcgtgactcaggttgggctcggtggctcacgcctgtaataccagcactttgggagagcgaggtgggtggatcacctgaggtcaggagtttgagaccagcctggccaacatggtgaaaccccgcttctaccaaaaacacaaaaattagccggtcatggtgttggatgcttatagtgccaactactcaggaggctgaggcaggagaattgcttgaacccaggaggtggaggctgcagtgagccgagatcacgccattgccctccagcctgggtgatggagcgagattccatcttaaaaaaaaaaaaagaatgaagactcaggcctggtgtctggtcccaccccaccacggaacctgggcaagcgccatcctcttctgagcctcagtttccccactgtgggaaagggaccctcccagaaccttcttggagggaggcggtgaggactgacccagctctgcaggccctgcccaatgccaggtgggggttggtgcctggtcttgggtatattccagccccgctgcaggctcacccgtgctgcaggggaacgaaccgacgcttgggaagggcaccctggccgggggtctgcggctgggtggggctgactgggacgccctcctccaggcacctggggctgcgactgggacagtgtcccgtgtgcggtccctcctgcgggtgacacaggaaatgccccgagcttcacatgctccgcctcctgcgggagtgtcaagtcctgtgccccagggttcgggggctcaggtaggggtcttgggggggtcccgctgcttggggggctggtaagggcctcaggggtcccgctgtcgtggtcagcctcctgccccagtgcctcagctgtggaatttgtggtttcatccctcagtcatcctgggatgcgggatccttcccttctctggaacccgacggtttgaggcagtgtttctgctggcttttcgtggtgcagtgggggtgtgcgctgcttagaagccgggagctgtggggcactggacctgctgcggggcccaggtgctcaccgtgtacccctcggcattgttggcttgcggggaaactgaggcccggaggactttggccgacccagccttttccctggaccctgaggggcagcgcctgtttgggccccacagcggggcagggacggtcctgtctcgctttgcccggcctcgaacttggagtacagtagagtcagttggtgtcctgagtaggaagcgaatagcgtgaaggtctggcgggtgtgtctgagggcccaccacgtgccacgggcgatttctgcccgttccccttacggggtaggtgaggcctggccccgcccccctgccgggggtggcccctgcacctgggagcctggttcctcactggctgttccttcctcccagcctcttcctcatacccccgatggccccagggtgggcagggctgacgtgggcagttcccacggcccggccagcaatgcccagagcccagccatgtcccacctgccacccccacgggtggggcccaggccatagccaggcagcttggagagggcaggcgggggtcccggggaggcacggggggcttttgccataacctcagtctcctatggcctcagttttctcacccgaggagccgggcgagtgactgctgtggccgggtgtggcctgtggggtgggtcgtggctgtcatcttccccatgtccccccgggtcaccaagatgaggaaacgggaggcaaaaaacagcagcatttgttccaggagttgggaaatcgttgaacttttaaaattcaaaaatcgggaaatttttttcctgctttgagaataatgtacattactcgatcgcgcgtcccagcccctcacagcagccccagtcacattccgtgcccagtgtcagccagaaggggatttaagtggctcaggtcctgagtaatcggggtgcctgcttcaggcaaggctggatccaggtgtcaccgcatcagccccaggccctccacactgggggctcgccccggcaggctgtcctcctccgtagcccaggccctccatgctgggggctcgccttggccagctgttcccctccgtagcccaggccttccatgctgggggctcgccctggccagctgaccccctccgtagccccgaggcctcacctgtcctttgtcactgagcgccccagggaagtgctcattggtggggtgcaggtcacgtgctcattcgcgaatgaaccctggcctgaaggctgaatgctgggcactttgggggagcctgtgcggtgaacctgatgcggtgtgcacaggccccggggctccccgccagggcccccaggcctgtcccctgggacagacaaatgcctctgaccccagcaccccagggcatcagcccctcaacgcctgaaacagaggaaactgaggctcaggaagggcaggggcctggccagcaggaagcagggccactgtgagctctgctgtccccttcccgcctcaccccgtgagctctgctgtccccttcccgcctcaccccgtgagctctgctgtccccttcccgcctcaccccgtgagctctgctgtccccttcccgcctcacccccgtgagctctgctgtccccttcccgcctcaccccctgtgagctctgctgtccccttcccgcctcaccccgtgagctctgctgtccccttcccgcctcaccccgtgagttctgctgtccccttcccgcctcaccccgtgagctctgctgtccccttcccgcctcaccccgtgagctctgctgtccccttcccgcctcaccccgtgagttctgctgtccccttcccgcctcatcccctgtgagctctgctgtccccttcccgcctcaccccctgtgagctctgctgtccccttcccgcctcatcccctgtgagctctgctgtcccctttccgcctcaccccctgtgagctctgctgtccccttcccgcctcaccccgtgagttctgctgtccccttcccgcctcaccccctgtgagctctgctgtccccttcctgccccacccccgtgagctctgctgtccccttcccgcctcacccccgtgagctctgctgtccccttcccgcctcaccccctgtgagctctgctgtccccttcccgcctcatcccctgtgagctctgctgtcccctttccgcctcaccccctgtgagctctgctgtccccttcccgcctcaccccgtgagttctgctgtccccttcccgcctcaccccctgtgagctctgctgtccccttcccgcctcatcccctgtgagctctgctgtccccttcccgcctcaccccgtgagctctgctgtccccttcccgcctcacccccgtgagctctgctgtccccttcccgcctcaccccctgtgagctctgctgtccccttcccgcctcaccccgtgagctctgctgtccccttcccgcctcaccccgtgagttctgctgtccccttcccgcctcatcccctgtgagctctgctgtccccttcccgcctcacccccgtgagctctgctgtccccttcccgcctcaccccctgtgagctctgctgtccccttcccgcctcaccccctgtgagctctgctgtccccttcccgcctcaccccgtgagctctgctgtccccttcccgcctcatcccctgtgagctctgctgtccccttcccgcctcaccccctgtgagctctgctgtccccttcccgcctcaccccctgtgagctctgctgtccccttcccgcctcaccccctgtgagctctgctgtccccttcccgcctcaccccctgtgagctctgctgtccccttcccacctcaccccgtgagctctgctgtcccctttccgccccaccccctgggcagggcttctgtgggctgcagatgctcagagttggccccgaaatcatcggggaccccttcttgtccccaagcctgtcattgggcaggagatgggcacactgagggcagggctctgcgggagatgggcatactggggccagggctccccgagatgggcacactggggtcaggctctgccagcatcctgccgtggcgctctcagtcgtgtgcacttactgagagcctattgtaggcacatggcaggcactcgggggccctcaggatgttccttggggtcgcctcccactaaccttccttctccccttgcaggcaagagcggtgagcggggcgcctatgcctccttcgggagagacgcaggcgtgggcggcctgactcaggtgaggggctcgggccgggctggggtgtattttgattttaaacaaatctgtcacccaccctctctgatctgcagaagctctcctggcttagctaggttatgtttgcttcctgatagcgaaaccaggctgggcttgggccagggtgggctgggtgggtgtggaccgggagcagaggggaggtaggtgaggaccagggaggccaaggcctgcagggctgccatgcttagctggaggggctcggttgccctctcctctgagtggcaggcaggaaaacaggccatgcagcagggctttgcaggtgtggaccccctggggagcccatacaacaggcccctgtgcagccgagatcctcacccacgctggccctggttgtgaggctgggggaggatgttgggggctgtgaccagccacaggggtcccatgcagcctccggtgctgggcacccccagggttcctccctcaccccaggacttcatctctgtccccgccgtcagctcctagctctcggtggggctcggccttgtcacaggtggggccgtctgtgtgctcactgtgcccaagccagagcaacagtagccatagtgatggagggggccagccgggtgccaggctctgcgccaggggcagatgcgcgtttccctatcagtccccgcaacgaggggccgcggcctacgtgcccattttacagacaggaatacgcaagtgcccgggctccccatccgagaagcagaactagggctcgggccctgctctctggcgctcccgggtgactcatcgagccccgcggtggccacacagggtgcgggctcaggacaggccgggcctcgggagaaggccctgtcctgggcgctgggccaccccgtggggccactggatgatgatagaacagatgattcttttttttttttttgagacggagtttcgctcatggcccaggctggagttcaatggcgcaatcttggctcaccgcaacctctgtctcctgggttcaagcgattctcctgcctcagccttttgagtagctgggattacaggcatgtgccaccatacccggctaattttgtattctttgtagagacggagtttctccatgttggtcaggctggtcttgaactcccgacctcaggtgatccgcccgcctcagcctcccaaagtactgggataataggtgtgagccaccgtgcccggccttagaacggatgaaatgcaggagtcagttccgggacccggctcagggcagccctggctccccaggaagaaagcccgtttcacactaacatgtacagaatccaaccgagggctttacaaaacaaaaccaaaaagataggaagcagccgggtgcacagacgcttagccacgcagctttgtactttgcgtctcagaatcgggggagcagccccttgggttggccacactggtatctgtttctcagtctttcgttcttcgtgaaaacagcagtgtgggatgcggtcagtctcaagtcagaaaaacacagcaggtgtcacagagaaacaccgtgacaggcagaaggggcatcacccactgcagggcgggtctgagtggcttcggcctttgcagttttttcttgaatggaacagcctggggtctggatgccagctgggcgctttctgaccatccgctccccaccaggctggcttcctgtcaggcgagctggccctcaacagccccgggcccctgtccccttcgggcatgaaggggacctcccagtactacccctcctactccggcagctcccggcggagagcggcagacggcagcctaggtgagcggggtctggccggggcatcgggggcttctgggagggagcctgcaaagggaggtaggaggcttcccgttagctgagggcaccagagggagcagaccccgcaccttccaggtcctggctggacgtcgggcgctcgggccgtgggagggatggacggtgacggggggtcgaggcaggggccggcgggcgtggcacgtccagggagaggttcctacgagcctctggtcccgaggttcctgcagctgacgggcacgggctctgccatgtgctttctgtgtcagatgcctcatggggctgcatcgtggctcctctgcactgagccctgctgcacacgcgggcatcccccgcgaggcacgtcacagcctcgggctcaggagcactggacggcgccttgaactacccggggcccattccaggcagcacagtcgccaggcatggcggcactcacctggggtcccagcttctctggaggccgagacaggaggatcacttgaggccaaaagttgcaaaccattctgggcaacatagggagatcccatctttgcgaaaaattttaaaaattagctaagtatggtggcacacacctgtggtcccagctactcaggaggctgaggcaggaggatggtttgaccctgggagttcgaggctgcaatgagctgcgatcgcaccattgtactccagcctgagcaacagcgcaagaccctgcctgaaaaaaataagcgtgaaatcacccacaaaaagcacaaaaacgtaaaagatcgtggctctgaatagaccaaggacaggagccccatgatgcgggaggaggcctctgttccgccttggctgggcacatgcgcctgggccactcgaacttttcccactgtgcgcacgtccgtgagtgatcaggaaggcgcctgagtgctggtttccgggttacggattttatcctgtaggcgagtttgcaaacagcagcccctagtggtgaagcctgactgcgtgggatagtcggggccatcttggaaggagggtggggccaaggggcttctcagcagagccttggcttagaatccaccaactcctcgttttccaaactgcgcgtcgcgggagaaaaccatcgtggttcttcgacatctttggagccgtataaatagacccggggctttttgttgttgttgctgctgctgctgttgtgttttgagacggagtctttctctgtccccaggctggagtgcagtgacacgatctcggctcactgcagcctctgcctcccgggttcaagtgattctcctgcctcggcctcccgagtagctggaattataggcacccgccaccacgcccggctactttttgtattttcagtagagacggggtttcactgtgttggccaggatggtcttgatctcttgacctcgtgatctgcctgccttggcctcccaaagtcctggtattacaggcatgaggcaccgcacccagccgacccgaggtttttaatatatgaaacgggaattgtgagggtctctcctccagggtgtagggcaggggttgttctcatggccggtggccggttctcaccccttttgcttctaacagacacgcagcccaagaaggtccggaaggtcccgccgggtcttccatcctcggtgagtcgcacgagggagaagggaccccacagctcgtcagtggcagtgccaggccctgtgtcctggcgaagcttgggaacacacatggcggggtgggccctgagtggacaggccccctgtgatttctgagccaagatctgagctctgacccgaggccgcctccaagggaaggcggggaagtccttccctaggtccagcctctgtctgtcttgttttgagagaaaggcagtcctggtggctgaggcccctttagaaagggcacaattgtgctgggtgtggtggctcatgcctgtcatcccagcgctttgggaggccgaggtgggtggatcacctgaggtcaggagttctagatcagcctagtcaacatggtgaaaccccatctctactaaaaatacaaaaatcagccgggcgtggtggtgcgtgcctgtaatcccagctacttgggaggctgaggcagaagaatcgtttgaacccaggaggcggaggttgcagtgagccaagatcatgccgctgccctccagcctgagcaacagagtgagactctgtctcaaaaaaaaaaaaaaaaaaagcggggggtgccgcaattggggctccctgttacatcctcacagcttcaggctgccccgcatccctgcctccctaccaggcctcgcagatggtccaggctgctgtgccacactcctgcggtctcatctcgctggagggagagggaatttgccgattccctggctcagtagccaccaaccaccctctgcccagtgcctgtgctggccccaagagccctgggcatacatctcctcacccctccagccgaccagctccccacaggcctgggttcggggttagagtcaggttgacttcccaggccaaaggcgtggtcaggctctgctcccaacagtatcactcactcccctccttccccagggtgcactttctctgccctgaaaccgccccccagtttattacaacatcaggcccacccagcatacttcccgctccagcacagcagcagacgttaccaacaggccccagccccacagtccaggcagtgccaaccagtcagagctggcgctactcacagacccctcttcctgttactttagtgaaggacgaatgttgctctgggaccaagggaagctcagcactggaagattgattccagctggggaacaagggagaaggatgggatggggtgttggagctggggttttgatgggtcgataggagttttctggattaaggaggaaaaaggtttagtaggcagagccagatccaagtcctcaagtacaaaggtcagaagttcagggaggcgggaggtgggggctggaaaaggagtaggagagagagaccaggacatcataagaacctcaaacttggccaggggctgggatttacctaaaggggggtggctttacagggaagggaaacggggtggtagatgtgctaccaggaggggacaggaggccggcaaggtgcatgggctgatcgtggtccctccgtcctgactgcaccccccaccgcccacccgcccgcaggtgtacccacccagctcaggtgaggactacggcagggatgccaccgcctacccgtccgccaagacccccagcagcacctatcccgcccccttctacgtggcaggtacatggcagggcgggggctcgccagggacggtagggcagggctggggttccccactcggcccccaccttaccagctcccctccacagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatggtaggacccagggcagggggcagggggtgggcggagggtggcagtgcccatctaacccaccctcctcctgcctgaccccccagggctaccagctgcatggagcagaggtgaacggtgggctcccatctgcatcctccttctcctcagcccccggagccacgtacggcggcgtctccagccacacgccgcctgtcagcggggccgacagcctcctgggtatggcccctccctgggatgcggcctctccgaggggacactgggctccaggcagggtctgggtggggggtggcgaggactccacgggaggcgcaggcgcgtctgctggccctgagagcgggttgttgtcagttctcattgtccgctgtctgcagggcctgccacgtgcgttgggcttgggatgtctggaaacagatctttgaggagcggctttcccgccttacagctgggaaagaggctcagagagggactcacccacccagggtcagagagggactcacccacccagggtcagagagggactcacccacccaggcccagagagggactcacccacccaggcccagagagggactcagttacccaggcccagagagggactcacccatccaggcccagagggggactcacccacccaggcccagaaggggactcacccacccagggtcccctgccagtggcctgtccccagtgcctcaacccctgcagaggctggtttcagggggtcagacagaaaccggacccgagtcaggctgctctccctggcgcagcagtgtctgtgcaggacggcagaacgcaggagagcttgccgtcggcggcagcacccaggccgggctgcgtgggcctcacctctcttcacccacaggctcccgagggaccacagctggcagctccggggatgccctcggcaaagcactggcctcggtgaggcgtggggcatggggggtggccaggcaagtgacctgagaggccggcccctgaccgcccatctctcctggtcctcctcgcagatctactccccggatcactcaagcaataacttctcgtccagcccttctacccccgtgggctccccccagggcctggcaggtctgtgagggttttggggggaggggaggctgaggtctgtgagggtttggggggaggggaggctgaggtctgtgaaggctttgcgggggaggggaggctggttctggtgtctgcaccttgctgggataggcaggcagcggggagggagcagatggcccccaagggcccgtggcatcgctggtcaggaaccgacggtggaagggagtcccccatgggcttgtgttccactgggcaatccaggaaagctgcctagtggaggcagcctccaagccagccctccaaggctatagcacataaccaggcagtgagggagggctgggaggtggcgtccaggttaggtcacagcacaggcaaagccaggaggcaggacctggcagttcacactgcgtgaacatgaggggacattggcgtgcctagcagctcccaggtccgatggggccagcatcgccagggctgtggcctggactctagaatgtgtgcgtgttgccatttgctcacccactgggtatttattaggtactgactgtttaccctgtgcggtgctccggcatgggagggcagaccctcctatccctgtgaggacgtgcttgcttatccgcagggggtcgggggcaggtacaggaggagggggagtgagaactggaggtttccagaaggtctgggtgtttaaaaacacccgtgagtcctcatctctgcccccatgggaagcgccaggaaccctcacttcacctcggcctgtctggtcccacctggagcttgccactttcttgcctgctgctggagcccagcgtgggtcagccagggtggggcagcatggggaggagccccctactgtgtgctgccgagccactttatcctctgagtggggagttggattttgtagatggggaaactgaggctcagagataggaatggcagtacccactgggcacccagcatccctgcctggcggggccgagcagctttgcatcagtgtggggtgccccggaatggccatcttgggcatcaccggaggctggacaggcggggtggttcatgaatccctccccatgggcatcaggccatgctcacaccccgcccctcgcaccccattcacgtccccactcccttccaggaacgtcacagtggcctcgagcaggagcccccggtgccttatcgcccagctacgacgggggtctccacggcctggtgagtgcctgccccgccccaccccacccttccccgacagaatttgcaggacagacgctccttgagaaggagaaacctttttgttagtttcttgtaaataagccccaagctgttattgaggcctcgtggccgccaaggcacacacattttgtgtgtgctcccgggcgccagatgcctggcatatgcagcttcctggggaaggggaagatgggaccaccggccacttgcatgcggaagggacatgaatggaggcctgtggggtccctcggcttgggcccctcaccacccatccccccaccctgcagcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggtgagcgctgggcgagggtggagctgggcagtgggcggggacccggctccccctgatgcacccgtctccccacgcctgcaggttggaggcagccaccccgaggacggcctcgcaggcagcaccagcctcatgcacaaccacgcggccctccccagccagccaggcaccctccctgacctgtctcggcctcccgactcctacagtggtaagcccttgagcttgggactgtccgactcctggttccagttggggaaactgaggcactctagtggtgggggtcagggtgggagcccagggcaggtgtcaccgtgggggcacctggtgacatgggcgccccagtcagcaacttcaggagggtgggtaagaccggcggggccggcgttggccctgggcgtgtgaggtggacagctctgggctgcctcttcattcgcctgctcccagacgctgtgtgcctggcagcgctcagcactggggaaggggcgaggggtgcagcaggatgcctctgcctcaggggagacagaccaggagctcgctgcacagtacaggtgccagggagaaggaacgaagtggctgcggtgggttgggggttttgtatggctttgaagatggtggcccatgaggccacaaggtggtgtttgggcagcatctgggaggaggcaagagtaggcaagtacctggaggaggagggtttcaggcagagggcgcagcccaggcaaaggccctggggctggactgcacctgggaggaacagccaggagacccgtggggttggagcagagtgaggagagggagagagggaaggggggagggcggggcagggcaggtcatgcggggccttgtgggctgcggggaggacttgggatttggccatgagaaaggtggcagccgtggagggctgaggagggatgggacctgacccaggtgctcacagataccctctggtggctgcttggaggacagactatgagtggcaccgggagaccaaggcagaggccacagggctggtccaggggccttggaggggtgagcagtgggtgggccctgcatctcctgaaggcggggcccacaggatttgtgatggacaggacttgagggtgagagaaggcagggtggctctgggatttctggcccgagctgtgggtgacactggggctgggaactccgtaaggaaggggacaaaggaaaaggttggggacaaatctggacctgggcctggggattgttgagtgtctcagacacccatgagaggcccaggagaaggtggggtcattgtgggcgctgtcctggccctgtgccttccaccagcccaggaatcctgcctgctttccaggcagactttccaagtaccttgattctatcactcctaggccagggcatctcaccgcagcggctctgcccccaggggacactgggtgatgtctggggacatctacagttgtcagggctgaggggagctcctggcatggagtgggtgggggccagggatgctgctcagcaccctgcagtgcccaggacggccccaccccagagaagggtccggacccacaggtcagcagtttccaggggcagccccaagcttagtctttcacccataggctcccctctgtttccttcctgtccttcacttcgtgtgctgaggcctgggctggtcctggtggctggcgttggccgattggagcagagttcactgtggggagcgggtgcatttctgaggctccccctcagggtacgggggtctcaggggatggcagctggtttgctccatgtgagccctgactgattcctggactccccaagcccgggttttgggggtggcccaggccctgctgaatgcagagtggccgcattcatttggggcactgtgtacccttaagccacatgttttgcaattattgttcttgagcttcatgaacacggcgtcccactagcgtgttctttacacgctggtttgctggcttatgttgtgtgtggggtacatgtgtggtgtgagcggctggggtcccattgtgagtgtgccgttggccctggcccgggcgtggggctgtaggtcattccaacatcacgctttcctgccaacctgctgatcaagggtgtgatacacctgttgtcaattcagaggaaaggctgatgaattattttccaaagcagccaagttgccctcccacaggcaagattttgactgttcaggtccctcaactttgctagctgactgggtatgaaagggtagcgcaaagccaccctaatttgcatttccttaatctcttgatgtgctgaagcggacttccacgtgtttctagccatgtggtttccttgtctgtgagatgcctttttggataccttgcttatttttctactgagttactttctttttgtcctttcccattgattgtgggagatcacctcctggttggctacatctgtggtgggtgtcttctattctttggcaaatgcttttcttttcctggtatctttgctgatcaggaactctcaattctgatatagtccagcttactgatttttgttttttcttttttacttgttttgttttgagacagggtctcaccctgtcacaccagagtgcaggggcatgatcacagctcacggtagccatgaccccctggcctcaagtgacccttccacctcagcctcccaaagtgctgggatcacaggcgtgagtcagccactgtgcccggcctgtgttctttcaaaagcagcgctttgagcacttgcttggacagctcttggactaaaatgagaatgataaagattagcatagcatctgcacaagggtgacgtggacattcctgaagtgttccaaagttttattcttttttttttttttgagacggagtcttgctttgtcacccaggctggagtacagtggcgcaatcttggctcactgcaacctccgcctcctgggttcaagtgattctcctgcctcagcctcccaagtagctgggattacaggtacccaccaccacagctggctaattttttgtatttttagtagagatggggtttcaccatgttagccaggatggtcttgatctcctgacctcgtgatccacccacctcggcctcccaaaatgctggcattacaggtgtgagctggtgtgagccactgtgcccatccgaagtgttccatatttttaagttaatgattgaaacagtttactttcaccaaaaaagaagagtgttcttttagcatcttagtagattcctgccattgagttgctgcagaatttctacacactttgttccaaaggtggtaaaactgtttccctttcatcttgtggtccttaatctgtctggcattggtagctacacatggcgtgaggtagggatccagttctggttgttggttttttgtttttatttttggccaagacctggtttttccaggaaagcccaagtccctcaccacaggagcacaaagagatatgtcagttggccctggaggccgacgcaggcccctgaccctaggcctgttgcagggctagggcgagcaggtgccacggcggccgccagcgagatcaagcgggaggagaaggaggacgaggagaacacgtcagcggctgaccactcggaggaggagaagaaggagctgaaggccccccgggcccggaccaggtgccaacccacccctcggcactccccaccctcaccccatcaggacgcacatgtgcacaggccacacgcacaccgcacccacactgggaggccgtcggcgggccccacgctcttcccccaacctcactgtctccctctggccccctcccggcgccctccccatagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgaggtcagtgggggcgcgggccaccagcgtccctgcagcgccaccctccctcgtgttcctgccctcgttctccttccccgcccgccttcctggagccagccctccctctgcagcagttgcctccttgcagtgactgtgcccttcacccctctgaccgcattgccatgactgtccactcctgactgccagcccttctccctgcctgcctcagcatcccctccacagtgggaggactggactctttctggacccctagtccttcaggcctgggctctgtggctcagaactgtatctcccagctccacggggctcccactcgccgtggtcctcctttcttgggaagcccagaacccagctcacagaggccagtgtcccccgatcccagagacaggagctggtgtgcaaaccaccctggccccttcccgtcaggcagatgccacgcaaggccacatgagcccatcccctgtctctgactcagtttccctatctgaaggtgatagggaaacttcctatcacccccatttcccagggccagggggaggaaggatacagacagaccctgtccccacccgcagatgtgagctgactccttccccccgctggcgctggcggctgcttccttaactccttcctttcctcgcctgcaccccgttaaccctttctctcctgcagcactgttgctgggaccggagccagagccccggcccggcccacacgctatcccctcagctctaaggtttccgagtctctgcagccgtgtgtggcacgcctcgcgccccccaagcccgcctctctgctgtctgccttccgccctcccctccatcccgcccgtccgtccctctgcttcccgtggcagcccctcctcacctcgcacttgctgcccgagcaccgggagcggctgggctgcaacctcagggcgtttcctcccccaaagccccccgtcagggcttgcgggaagaaaccagacccgggagcacgcagcccctggtcctgtcagtttggtctgtgcgcttgtcctgggctccaggggccgcccccaccacctggagggatcccctcaggcccctaaggcagggtgggcaggcaagtgggtgaggcagccccctagagactaagacagggcaccaggcatgctgggcactgggccagaccttcacccatttcatcttcaccacaacctagagcagtgggtgccctgatggggaccggcatccattctaccaagtaggaagccagggaacagagcgaggtcacccatgcagggccatgcagcacagaggcctgggccgggacccgcacccctgcggcagcagcaacagtgcccgctcgccagctgcatgctgctcggctggagagggggctcagccttgggcctggcacagaacaggctcttggaacctcagagctcctactgcgaccattcacggtggcagtgacaatggggttcctggaggcctagggagctggccttcccagccaggggcaggagctcagggagggctcatcttggggcagccggagttcactgtaggggacgggtgcatttctgaggctcctccccagggtgtgggggtctcgggggatgggagctggtttgctccatgtgagccctgatttgagtcctggactccccagtcccgggtttttggagtggcccaggtatttgcctgctgagcccgtgtcttcaaggcctcctctgtccacagtgagtctggccaggcctagctgtccatcaccccgcaagtggctgctctgagcagggaaagtcatcatcttgggagggaagaacaaagagaggagcaggcactgggcctcccctgcccccagccctgccctggggcccacagagtgagcagggtcaagggagaagcagttaccctgtgggctcccagacggggaagcagggccccatctccctccacagaaacgtctgggaacagtcagaccttgggtcttcctgggtgtgaccacatccacagcctcccctagagctgagtctgagggcacttgcacctgggcagccagtcgcgtacacacacaggcgccccaccatggggctctgctgcattccagggagcacattcgccgcgtgcacagagaagcacattttcacgcatgtgacaacacacacatcagcatgtggacccgtactgctgcccacaccaacaccagccgtgtacccccactgctgtccacacccacaccagccatgtacctgcattgctgtgcccgacaccagccgtgtacctacactgcagtgcctgacaccagctgtgtaactgcactgctgcccacagcagcaccagccatgtacccacattgctgtgcccagcaacgtaagctgtgtacccgcactgctgcccacaccagccgtgtacccccactgctgtccacacccacaccagccatgtacctgcattgctgtgcccgacaccagccgtgtacctgcactgcagtgcctgacaccagctgtgtaactgcactgctgcccacaccaacaccagccgtgtacccacactgctgtgtccaccaacgtaagccgtgtacccgcactgctgcccacacccacaccagccgtgtacccgcactgctgcccacaccaacaccagccgtgtacctgcactgctgcccacaccaacaccagccgtgtacccacactgctgtgcccaccaatgtaagccatgtacctgcactgctgcccacactgctgtgcccaccaacaccagccgtgtacccacactgctgcccacaccagcacaaacacaagtagctggataccctctccacaacccagccctgccctcccacccagccttggcgcatcactaacagaggcctcggtgctgtgacccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgaggtaggctccccggccagggctgccccagcaccctctcccttccccacacccaggtgcagatgctggggtcctcctgtgcttgccgcccccggactctgtccatgtctgtctttgtggctggactcagacccagtgatgttccccagacaccccctgatacccactctcttctttacaagcctccaccccatccccccagccttctcaaggaaggaggtgagagccggaaatacaggaggccacacgtgatggggctctgcccccacccccccccccgacatcctaccccccactcccacctcacatctttctcctccctgggaccgtctcccacagagctctcccccctccctccagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacg

SEQ ID NO: 37946 - DNA, 9282 bp, Homo sapiens; identical to SEQ ID NO: 37574

SEQ ID NO: 37947 - DNA, 2292 bp, Homo sapiens
gggtgctatagacgcacaaacgaccgcgagccacaaatcaagcacacatatcaaaaaacaaatgagctcttattttgtaaactcattttgcggtcgctatccaaatggcccggactaccagttgcataattatggagatcatagttccgtgagcgagcaattcagggactcggcgagcatgcactccggcaggtacggctacggctacaatggcatggatctcagcgtcggccgctcgggctccggccactttggctccggagagcgcgcccgcagctacgctgccagcgccagcgcggcgcccgccgagcccaggtacagccagccggccacgtccacgcactctcctcagcccgatccgctgccctgctccgccgtggccccctcgcccggcagcgacagccaccacggcgggaaaaactccctaagcaactccagcggcgcctcggccgacgccggcagcacccacatcagcagcagagagggggttggcacggcgtccggagccgaggaggacgcccctgccagcagcgagcaggcgagtgcgcagagcgagccgagcccggcgccgcccgcccaaccccagatctacccctggatgcgcaagctgcacataagtcatggtaaagccagcctttttctaaatccacgcgaccgcggggacgcggctctcggtcccccctctcttctctgccgccctctcccagtctctcttggtctcatttctcccagccctgcggagctctccttgccgttctccctcccctgccttcctccttcctcctcttctttgcgagcaccctgcgctcacaaatagtgggggaaatgggcgttctctgggacagtttagacgttggaagggggaggaagcaaaaaacccctctggaaccccacgccttgggacgcgctcccgggtcaggccagccgagcaaggcgcagagaggtagaggatggctgtagcagccgtgaatcgggcttgtcacggcggataatttatgaggagggctacgctggggaaacagcgttactaattacagcccccgaaaaggggcttgggggaaagaatcgaggcgagagcctgcaggattctgaattttgggggcaggagggagagagaaggaaagggaagaaaaagaaaacaggctccccaaccctgcaggctggaaacgggaggcggctctcggggctggaactttgagggagggtgacccgaaggccacttgggcgctcaggaaagggccttgcttcctgggtttctgtgcggtgggcagcctgggagggctgtgcctcccgatcggggcgcccggggcagggcggagggggcaggagaggggccagggaaagccggagtccgccgggacacggccccagcctcagatgggcagattgttcccagggtccaaatcgtattgttttctttctagaaaggaagagagaaggaaattcgggaggggtgtgcgggctggtaggcagaacttgttgagcttttcgcctgggttccctgctcatgacccaagcttgtccccctggcggactttggaagacaggagttggtggctaaaccgctgacttttctattgcagacaacataggcggcccggaaggcaaaagggcccggacggcctacacgcgctaccagaccctggagctggagaaggagttccacttcaaccgttacctgacccgcagaaggaggattgaaatagcacatgctctttgcctctccgagagacaaattaaaatctggttccaaaaccggagaatgaagtggaaaaaagataataagctgaaaagcatgagcatggccgcggcaggaggggccttccgtccctgagtatctgagcgtttaaagtactgagcagtattagcggatcccgcgtagtgtcagtactaaggtgactttctgaaactcccttgtgttccttctgtgaagaagccctgttctcgttgccctaattcatcttttaatcatgagcctgtttattgccattatagcgcctgtataagtagatctgctttctgttcatctctttgtcctgaatggctttgtcttgaaaaaaaatagatgttttaacttatttatatgaagcaagctgtgttacttgaagtaactataacaaaaaaagaaaagagaaaaaaaaacacacaaaaagtcccccttcaatctcgtttagtgccaatgttgtgtgttgcactcaagttgtttaactgtgcatgtgcgtggaagtgttcctgtctcaatagctccaagctgttaaagatatttttattcaaactacctatattccttgt

SEQ ID NO: 37948 - DNA, 47756 bp, Homo sapiens
gggagcgcgcgtgcgcgcggccgtgcagcctgggcagtgggtcctgcctgtgacgcgcggcggcggtcggtcctgcctgtaacggcggcggcggctgctgctccggacacctgcggcggcggcggcgaccccgcggcgggcgcggagatgtggcccctggtagcggcgctgttgctgggctcggcgtgctgcggtgagtggctcctcgctcccagccctgcggctgctgtcgcttcgcccccgcgggcgtgtgggctgcgccccagccagcccggcggcgccctgaagagggtggccggggcgcagaacactcgggccctgagcgcccgaagtgcagacgtgggagggccccacggggaatcgggcgccccccttcttcctcccttcctttccctggtcgtcttcttccccctgggtgagagcggggctcatctcctccacccggttctccatctccaaatgcacacacacaggaagactccaaaccgcgcacctcgcgcaaaaattaactagcaagaaagggcgcgatcagaggcaaggggctgcagctgctagggatccccttctttcgcacccctctcccttctcagtgcttagacgcatttggggttgagggagggagagtgggagggcccgggcctcttgcgatggaagtgcgcattttggcgaagtcggtgagaaggggtttctgccgtttgcctcccacatgaacataggagcgaagaggacgtaaaggacacaattaagtttcattttcaactcagcattcaatcagaagaatcttccggccgtgtaatttttgctgtcgtttttaatcctaaaaataagcttgctggaaactcttcctttctcgtgaccctcacgccccatcagccacttgcatacattctaaattgtacgttgaagtttttcccactttatttgggggaaccgttttaaaagtaatctggttttcgcctgaaataggaagacagtaacctccagtcaaaacatgtgcagcagaatgggatttggtgtttttcgacgccaaagaacctccacccccccacccccaccccgagcttttggaatccatttcgcttttgtaaaacgtgtgcttcgtctgtaaaaactgagcaaggaatagaaacattcgtagctctacagtgagtgcctgtcacacttcacatccatagagccttttgtgaacttttataagattcagaattcagcttgagcaccagtgacagcaattgttacatttattctagaatgctaaattaattcgattttaaactgattattagcctcggtgtgccgttcctaaaggcttgtgactttaggtatttccaagatgcccttaagtctctgcttaccactttcctccctccccgagcatcctggatgttgggactgtgaatccaggtctccgttatctaaatggttgatgttagtgtttcctgtcatcacgtttagtatgcttgttgcctttactatcattatagctaaaataatactgctttcagagatgtgttgtataatcgcataataatttcagaacgccttcatattgaaccagatatgaagtgatacagtatcatttattcaaactgcctaaaaagtaaaaagtataaaccatatactatttttaaaacaggtaggttagatttaaatcacgtagtttagaactgttggaatggtactttgagtgataggatttatgttaggccttctttagtaatagttaatatcatgtaattagcactcgtttacacacaattttaatgtgttcgaatccctagagtcatcgaattcagaatttatagtattttattttacttagttaatattaacctaaaaaaaaagcaaaatacaggcattatgcagttgagttgtgttaagtgtggactgtaaaacaggatagtatttgttataaaatatgtttttgtatgtgtttaatatatagcttcaaaaggacatgtatgaagaaagatgtctcagcacataggtagttataaaccaagggtttgagagactgactttagaatctagaatgagtaagaaagtgatggatctgtacattcatttgtattgaagtttgattttgctttcagtttcgttaattaagccccgggaatcagggacctttcctggcaccctctacagtgttagtggcctttgtggtaaaagaagttatctcagatactcatttcatgcaattacaggcaaactggaaggcaccttaatggtatgcaagatgtgaaatgaattactatgttgcattccactctgcccccactcatgtacaattatactttgtttaaaagtgcatagtttcagtggtatttattagctagcaaataaaactttaaataaataatgatggtgttgtgaactgtcttttcagtggttgaatgattcctctttgttcaaaatgagttgtttttttttttaaatcagggtacatatgattaaataaaatttttttccatcgtctaagtctagtagtaatttggcttgtttaaataaaaatgttttctcttaaagaatatattatttttaattacaagttgccattttaaggaagtaaatgcctatttaaaagtacgtatttatggggccgccccagcagtctagaggcagtgttttttaaagcattacactaaatgcctaccattaggacacttgctcatgctgtcatctgtgttttggcagatgttttatctttgtcactgagttgttcatggagatttgaaaggccaagttctaaagatgagagatagatgactttccccccaaattgatacatattctaaatccaaaataatcacgcatattcgcaaaactagatttgcatttcatagtatgaattcagctatagctagtatataggcattgcttttaatatagtaatgttctttttgtggcataattttcaatcactttccctgtcttaggtttctgcctacctttttatacaagataaacatttctattttcatatcttatctctcagtctgattttaataatatcgtcttgggttatcataaagttactttcactttgtatactagtgtagatatttcttctgtgataaaaagaacaagaataatagtgtaggatcagttttgttaaactcattgtagtactaaagtagaaaatacagagcacccaggaaatttgattctgatatacctagactaagacaatagaatctgggtttttcctctttacgattatacagtgttgaaacagaaatcaagctacacccacctctgaatatttcattccaaatccatggagcagttgcataagactcagaatctggtcaatctcatggtttgagattcagattaggagaattaatgtgcatatttgaatatatatcacacttgtaggttaaaaggtaaagcaaggggtttggctagttcaaggcctgtcaaaaccacttttttccatttcaagcaagtatgagcctatactacacaccaagcagtttgcaaagccctctttggcatatagacaaatttcagacagtatgtcagtatgtctcttaatgacttaagatgtagtatatagacagtagggatatcttgtttttattccctcatggtacttaggtgcttgttaaggccataattctggatgttattgactttaaactgccctgccctttttaattctaagttggcctcttccattcttataaggccacttttaaattcattagggggattgcgttgggtcagaactaagtacaacttgtggacaccccactctaccccagacctttattttagtgtccattgaggagagatctgacttcatcctttttgtacgtaacccagtgtagctagagactccagttcttcaagccagacactagttctaaggggcaaaagtaggtaggattgctttctggcatgtgtctttactgatgatctttgcttctttacctaagaggctgctgagacttcttactccattcctgaacatccattcccagcagataattaacttcctactctactgcaaaaaatagtggtgtgtggtttggactccctctgcttccctcccaccattactaaactgatctataacatcttagataaccttcgtctcattctcttccgtcatccagcttcagaagaaaacctactcacttttccaacgaaaggacaacctgtctaccaccttttcacttctaccatcttggagacctgctcagtcagcataattcttcagtcttgcatcttagatctttccctctccattgactccttccccgtagcttgcacacatgatcaaattttaccccatattaaaaaataaaacaaaaaacctcaagaaccaaaatgtccttgcccttgttcctgcctgcacattgtcagttgttgccttctctgctttcttacactgccaaatttattgtaaaagaatcactgccacttaatatattttaagtgcttgataaagccatcttgtttctctctcatttctcaaacatagtgtgcatcagatctcactagtccattgacagatggaaagatattctccccaaatatttaagcctcttttctctataattagcctaccatctaactagctacacatactattttggttcacaattttaattttcccctctttatctcccctgcttcccacaactaacttctgttgattactgtaagttttaggtcttctctccagttgttctttacctggactattgcagtagtctgttaacggatctccctttctcttttcccttgctgccctcagtccttcctttacactgctgtcaatgttttttttttaatgaaattaaatctgagtggtttacagttgtttatgttatcaagtctaaactcagcatgacattcaaggaagccctttagaatttttcttattcatcttttccaacctcatttcctagagctcacctaaataattctctgctttcagttcttcactttctttatctggctgtacacgttactctgcctagaaagccccttctttcccataacattcttactcatcctttaagacccagtttaaacatcaccctctaggaagatcattcatagacacattcttgtgatttttaaggaacttttctatccaaccatacaagtgacttgagattttccatgaaaatatgcagcttcatgatttcataatcaagtctatacaagtgagaagcagtggcaggttctcttgaaatacagaagaaaaatctatcttctcccacatgatttttagatttttcttctatggaatttatactttaaactttttacattcacaaggaaggtattgaatcctactttctggaccctgtgttagattcttaggataccaaatgaagacagtgtcttactttctgagcctggagagatcagttaagtaaaatagtaattacacagtagtaggtacagtgacaacatttgaacacaaggcaatgggagcaataaggaggggaagaatacaattgagtaatggtagggaaggggaacaagattgaacaactcaactgtgctttagtaggaagagcaaaagttagcaaactgtagctgccatttattgagtacttgctgtatatgtgaaaggtgatacaaaaacatgttatcttattaaatcttaacaatatctctatgaggtatataccatcactatgcacattttatagatgaggaaactgaggagcagaggtaagtaacttgcctaaggttatacagctaagaagtacatgaggtgaatcttaaactagggtcgaccccttaatgtgtgcacttaactattatacaccctatgtactcagtggggtaatagtgtataacagttaagaggctatttaggtttgaggaacagtatgtgctaaggcatggggatgagagtgcatttgcatagtcatggaattgcaataacgtcattatgattggagcttagtgtggaaatgagggagtacaggaggtggggctggaaaggatcttgaaggacctcgtttgtattccatgctaatgtacttagaatttagcctgaaaagggttgagggtgttgttaaagtatcttaggcaaaggagtgcacatttgcatttagaacagttattttgggaactgtagaaaatacatcagggccaggatggagaaaccttgaggatggaggcagggagctggttagaagggtatggcagtagttcgaggggggaggatgagtgtctaattcattcattcaacagacattggatttaggaactattaattaggttgaacctactaagaattctccatggctaaggagagggagtaatctaatgtgattcttaggtccaggtctggttcactggtagatgatagaaaatactttagcaaagtgatttaggctgagggtaagaagtgggggtacgtaagtttttggacatactgactttgaagtaactgtattacatccaagtggaagtgcacagcagacagttggctgtccaacatctgcagtttagaagaaaggcagtgcatgattcagttttttatttaaaagtttgcaggtgaagaaaaccatgggagtcagggaaaatactagggggcagagggtactgaatctgaagcccttagggacactaacatttagtgtgagtcaaggaatagatttcaacaaagaaagcaaactaggatggggtggacaaagcaggaggaaattcgtaatcaggagataccatggaggccaagagagaagagcaagaaagagactgcccactggctcaagaactgtggaaaagtcaagacagaaagtgaaccatgcatatttgatttttcacaagggattggtggtgactttggcaagagctgtagtaatgaagaagtaggggtgaatgggtggaggccacgtaacagatttaaggagtgaattggaagtgaggaaatgcttatagattgttaatttgggatgctagggagagagaaagtatgagggattttttttaagttggcaaatattcaagcaatttttaaagacacacacaaaaacaacaccttgtaaatggaatgggggatgtgggaggctgataatcaactaaggaaagtcgttgaggagactgatgggtatggaggcagaaatggaaactagctttcaggtgatgggattcatttcagaaaaggaagcaaaaaaaaaaaaaaggtgtggatagttggggttacaggtaggtttatagggaaggagtattggaagcttcaggattctcctctgaaggtttcagtttgtattaagaaatagggagagaggactgttggagagtatgggataaagggcagaagggagtaatttaagagttgttaaaaagaagcgaacatttacatgaaatatgtaaaatggtaaagattgaaggcccggaggagcagggactatgacattcttctgtttttgcctattagcaacatgaattttcttagaaatctgtaagaccaattactcttctgcccatccataaggacgttgtccatgcagaaaagataacacttgtaaccttgtattatatacttatcatcgcccatttgagaattgtaagctcctaaaagataataactatattttttcatcactatatccccacatcctatcacaatatttcatcacaggtaattcttgacaaatgttgattgcatttttaaaatttctaacctgaacttgtgtgctgtgaccaccatggattgagtcttctctgccactacaaagctcttttctagactatgatatgagatggtttgggctgatagtctatattcaccaatacttgtacagttccaatgaaggtttcaagtctaatacttttggcatttgatataaaatcattttcccattttatttgctaatttatctataactctggcattactcttggttacatttgtctgctgctatctgatttagactgctataagcatatcttgtttattcagagttttcttattcatgttaattatctgtgtttctttatttgctctctacattttaaatagtttcttcactttgctgttttatgagaagggagtaggcaaaaggaaaaaaccccaaatcagacagttttactacttaatagttttttaatgcatctttatagagattgaagttgtagttaacagctagagtgatatttttggcctgcccttatttattaattactagtgcaaaggttattcaaattgtggtttatccaggtcaattttactgttatttttactaatagcatttattctacttaaattgcttcagctataaaatgtttttattgtaacaaataatgcagtataattattgctttctgtattcctttgaaaattcattctctaaacatatgttatgaaatggtggattgttcaccaactacttcttacttacttaattaaagcctttgcaaaaagtttcataggatgactgagttcttcattcgtacctcttttttttaagaataatctcttgaaagtcaaaccatgattcatacaaatataaaatgaacatgtgtcaaagattttatttcactaattaattaacaagcaaactagcaagaaggcaaaacccttttaaaagaaaattggaaaaacagacacatttataggcaatcaagaatgcctaaatgaatttgctaataaatgcaaaattggtcaatatcctcagggcagtaaaatgtagtcttttggaatcctctcttccaccaggtggaaatcaattgcagaacaagatttatttttatctgtatggacagcaatccatttgaattactctcagttttctacaacttatgaaactgtaaaacagcccagtcaaagtcagtgaaaggcacaggcttctatagagtcagataattccaaagcgtctgttagacattgcccagcacttgactgaaaggatacccagtagtctttgtatccctttcaaaatcttcaccatattttctgatactttccttcctttataatttgaacatcttcacccctttattcttctctggtatactatgtcctctctccctcagtgtttctctctcaggggaaataattcacaattccaaagttttaaagaatgcaacggaagtccaggttttgccttgggcttcctagtatttgggtggctagaaatgtagaaaactgggaagaggtgagctgtggatgcccacaatataggttcagactgcaatttcccagaaatataacaatttggactagtcaaagagggcccatatcattacattaaaatgccagattatctagtttttatagtatcaccctacatttttacagcatagtattgtttagagagcacttgccgctatgttttccatgttaatgctcaacacagttctgtgaagtagcccggtgtttgtttttgatcctcctacttaagagatcctcctattttagagagtaaaccaaggcatagaaaagtgagttgcttaaggcagcatattaaaaaggggcagaaatagtatttttactcaggtgttttgaacattgtccagtacctatattccagtatgcatccttgcattcaattcatggggtatttattgagtaaacatagtgttcttacaatagaaacattctatgcctctgatttttattccagtttatgtagaagtaaatcttaagtgtgaactattaacaaagttgatattttatttatatttgttagtaatttgtgttttgtttttgtttatgttttgaggggaaggccaagtagctacttaggtaaaagagttgctgagtggctgaagaatatggaagacaactacaattcctacacattcttgtacattttagttgaacaatgagtgattacatttatttacccagtgcctcttctataaggcaacaactggtagtttatcctattgagaagcgtagataggatgcttattagcagtaactgctcttggtttcaacttgcatcttacttagctttttcaccgttttgtggtttcttggaggaagaatacccataatatacatttggagactgttgttctgtagtgtcaatgaaatgtgggggtgggaaaatgtcattcaagactcccatacaaaatgtctattgctgcctatattttgctatgggaaagtagccacagataatgttttttttttcctcattagtattttaagattttccatcctagtggaaagatatgatttgattcatcctatttactttgtatattaaagtacagtagaacctgccactttttttggaaatgcagcataaggataaagataaatttcatatcagttcagcaagttctatttagcagtgtgttgaagttgagactgaataaaatatttggtttggttttctgttcaaaattttaccttgataaggacaatatttttctacatatatcagtaggcagtaatgattacttcaaagcttccaaagccagatactacacctgcatgttccaacatagttgctgaatttattcccaagatgcatgtaatgtatactttgtattattgagaatgaataaagaaaagtcataatgatgccttccagctgtgcaagttaatattaaaatataatttgtttgcatatttcacctaataggtcttcttcattgctatactgtttacttaagtgaacaatggaaatgttgctgtttatcttaaggatttgtaacatgcctaagatcttacagtacagacttctataattaatgaaacatttttctttttcctttccaggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttggtaagacttctatgaaagcttctttttttatttgtcctggtgcaacctgatcctctttcgagaggaggccaaatggggataggtactcctttgaatcaaaaagcaggctgttattaataaatgttgatgtaatgtttagcaagtttaagattgtgatttctatcctatttgttaatctactcttcatggtaaaacacatttactatttaatttgtattacttgttaatttgtatattgtgtggttctcaaacttttggtctaaggaccattttatttggctgattggtcctggggtaatgtactcttcatttctgtttgctgccatccaagtgctttctttcctgtgactaattttcaagtctctttccaattattcagccttctgttttttgtgttttttttttttttttttttttttttttaaccttacactttgaccaagggatgacaagtcccagccatgctccctctggagagaatagaggagagtcaggagattaaatcacgttatcatggatgatttcttcagattttctgtgcttagccttactttggtcttctttttgttggccaaaatatgagagaactagagattcaaattcatttattcaaattcagacttgatgatagcaccatgattctgccctttttatcacaaacttgggttgctgaggtgtagaaggtagtaaaattagctgaagtaaatagtctcctctccttgctgtttcctgctgtgctagctgagttcttcaaccccatatgagtatgttctttctgttttgaaatctctatttagaattacctgtcatattaccgatcatggcttaaccacattttgagaaccttaactctagataggttcagttctgttcagttggatcaactatttgcctagcttttataaaataatctactaccagattaggaatggggtgtttggtttgatgaaatgtttgcacattacttaggattgagaatcaggaggtctgagttacagcccctgttcagcaacttactattcacctgtgtgatcttgagaaggtgcttaaccgagtccaagttacctcatgtccgaaatggagatgacaatagatacttgcttttatgtattctacagtctaatgagcataaaccaaagtgtgttgtaaatgttagttgttttcctgggatgtttattttatgaagtaaggtatcaagttgttgaagttagcctagagcattgtgagagggatttgtgtgcagtgaggaatgggcaagggatggctccgagtaggcaaggagaatttgaaaggtctttctgctcagaaatctctcttacattgtagcttttactattgatattaatttgggcaaaggagctttttttgttgttgttaagtatacctttaatgaagggtgtaatcagtcagtcatatccactgcaactaactggtattagatcatctaatacctagttgaaatttttctgaggtaatgtacaattttgtggaaatgaaagaataagatatgggggaacagtaacttttggggggtaatgcaggtcactgagaggtaaactggaaaactcaaaatatgagatttgaaaggccagaagatgaaatgaagatggaagagaaaggaatgccaggatctgagataaaaacagtttattattttgcgtgtgattgaaagactgttttatctttgtttgcaaaataccctataaaaataaaaactagacttattttgggagccattaaaaggagaaagtattgttttattatagagaatgtagaaaattctaccagaggtttgagacatttggctttgcatccattttaattttttgaaataattattgatttacaggacgattcaaagatagagagcttccatgtgcccttcacccagtccccccaatggtttcctcttatgtgacacaatatgaaaatcaggaagttcacaatggtgcagtgtgtgttaatggttcgctctcattttatcacgtgtttatttgcgtaactacctacacaatcaggacatagacctatccatcataacaaacatctccctcatgcttattcttactagtcataccgccacctcccactgtccctaacctggcaagcaccaatttgtcctccatatctataattttgtcatttcaacaatgctatataaatggaatgatacaagatgtgaccttttgagaagggctttttcactaagcacaatgcccttgagatctatccaagtttttgcatctatcaatagttcttttttccttacttttttttttgctgagtagtagtccatagtatgaatatatcacagtttgtttaaccacttacctatagtaggacattttggttgtttccaagtttgggctgttacaaatgaaactgctctgaacaattgtgtacaggttcttgtgtagacacagttttcatttctctgggataaatgctcagaagtatggttactgggctgtatggtaagtatatgcttagtttttaaagaaactgccagacttttccagagtggctatttcattttacatttccatcaacaatgtaagagtgatctggtttctccacatcctcaccagtatctggtgccactatgttgtaaccatttttaactgaaaaaaacaacaaacaaacaaaaaccagttaaaaagttatctgcacaaaaaggttaaatggggcaggactcttactatggagtataagttcttttctaataagaatacttacttgtcacggactttgaggatttaagcattagaaaccatttttactatgtcgtgatttttgcaaatacaggcataaatgagaaacagaatttgctcaatagagaagtgaattctacttaatagaatgcagataatagtgaccattctttgtgcctttttaaattttttggaggactaggactgaatacatggaaacactataagatatagttttatatacctctgtgcctatgtatgatatagtccattagaaggagcactggacttgaaattagaaagctgttttctagacttcactgtttaatagcttaagaaaagttggataaaaaactcaacctatctgtccctcaaattcttcttagtacagtaaagatggcatcaccatcatggaaatgtttgagatataaataatacctctcttacttaacaaaattttactaagtgcctaccatgtgccagtcaccgtactaggcatcacagattctgtgatgaataagacattattgctgatttcaaggaagtggttgcagtacaaatatgaagagtgaagtgacctaacatttatttgcacatgtgccacatactttatgtaagtcgtgtcctgttatcctctcaagaactctaggagatagatggagttcttaccatttaacaaatagggaagcaaaagagattcaaggtattgttcaaggtcagagtaatagccaagaattaaacctagatctctttggcatcaaaacccagtatttttaccaccgtaatatgtggttcatgtgaaaacaccttgtaaataactaaatactgaatgcaaatactagtaatcataaaatttatcattaatatttctgttctattagcaatacaaaaacttgaaaacttaaagtttatttttctctaagctattagagttttgtttagaaaggtcagttcaagttccgcagtgttgccaattccattattatcaacaggacatatggtctgtttataatgaagacatgaaggcattgcaagatctttgtattagttttctagtgctgcataacaactacaaatatagcagcttaaaacactacccattttttagctcaaagttttgtaggtggcaagcctggtcatggcatgactgggttctctgatcaaagtcttaaaagactaaaatcaaggtgttgcccagggcatactttatttggagtttggggtcttgttctaggctcacataattgtgacagaattcaattccttgtgattgtaagactggggtccctgtttctttgctaagtatctgccaaggaattgtagcagctcctagagattgccctcatttcttgccccatggccccttgcatatttaaagccagcaaaggagaatcttcctcttgttgaatccctctcacatattgagtttattttgccaggaagaacccagacccttttaagagaccacttggttaggtcagctctctctccctcaaaaataatctctctttcttaaagtcagctgatttgggatcttaattacatcagcaaactcccttttgctgggtgatataatcatgaaaatgaaatccaatacattcacagtcctagtctcccacacacaaggggagggaattataaaagatgcatggctagggcaggggttttgggaccaccttagaattctgggtttgattaaataaataatgggactgtagcctagcaagtcgacacatcagaaaagccatcacaatcctgaaacatcaagtaaaaatttggtttgcattttaggattgtaaatgttactgtggtgtatgcgtgtgtgtgtgtgtgtaacctggtgttccctatgtttgtgggagtttgaaggagacactttgttgataggaatggtgtcttcacttttttaggttgtctcatttttgtacagtgataagacaaatgaggtcctgggttttaataacacttcagcttgaaagcaaaaattaaacacttattcattgactacacccttgtaatatcacttctttgcctttccactagcaagaagttcattttcgtggaagccattctgcctgtccaggaattggaggagagtgatagacacagttgtcagccatagcttgggtagaataaggatgtgaatgtccttggcttatctttattaatcttgtgatggaaaaatatctgacattgttcttagtccattttaagcttaatttatgttcttagtggcatagaaattcagagctgaaagaagtatcatgtctcactctccccttgaggaacaagagttaacgtcatctgacagtactaccataacaaatcaatagcttaataggcatataagtggctttatataaaatgttggtttttttcccccagcatctcagttggttcttaaatatctaattccatgatcctcaaacttttcccactgtaacaaattagagagaggaggaacatgttcatcagtgactgtagttcaaatacagcagaaatgtgcagcagtgatttcaaactgagagaatcctggatgcccttctccattgtgtgccccccccccccacccgccccacatatcagggaacaatttaaaatcctggcacaataatgagaagggagagtgacaaactgataagttccagttaagaatcacttagacaggccaggtgtggcagcccacgcctgtaataccagcactttgggaggctgaggcaggtggatcacctgaggtcaggaatttgagaccagcctggccaacatgataaaaccctgtctctaccaaaattacaaaatttagctgggcatggtggcgcctgcctataatcccagctacttgggaggctgagacaggagaattgcttgaacccgggaggtggaggttgcagtgagctgagaccacaccactgcactccagcctgggcaacagagtgagactccatctcaaaaataaaaaaaaaagaatcacttagacagtattttttgttctgtaatcttcctctctgtcattgaaatgtctcatatttcttgtttcacatagaatctgggagtcatcaagtagtcatctagtctatctcatcatctaatttacgaattatttctatcacaccccaagtagctggcgattcagattttttactgaaagcttgacatgatgagacattattacttcccagaggatcttggtctgttatcaggcaatttcagttcttccttaaatcaagctaaaacttgctactattctcactcactgggagggctgtagtatttctctcaagtttatacctctctgtgatgaaaatctctgttcttttagccattgctcatggtttcgggatccccattctagtcatcttcctttggagcaattccctgttagatcttcaaatgtgatgagtaaaactgagctcaggactgcgtttgttggtcacacccttctcccttccaaatgactgctgctgtaactttctgacaggtcctgcttccctgtaatccattctccatgtggctgccaaagaagatttgaaataagtcaggttatttttcttccctatttaaagccttccagccgcttgtcattgctcttagaataaaatccaaactctcccaacaagcttttaagactctacatggtcttgccccagcaaactcttcccatttgatctcatcactgaattccagtcacaatggccatcctttggtttctcaaagttgccgttcctttggcatctcttcctccctgtcttcacaatgtaggctccttcccatcctaggcttagtttcgttcctctccctagaggcctttccttactgcctcagcttctcccactctgcacactcagggtcctctgcattgttcactgctggccttcaagagcctagaggagttcctccccatggtgggctttcaataagtgtttgtggaataagtgaaaaatgagtggtcacaccaggatcgaatgcacctcttacttttgttaatatattcaaattaatattaatatattaatattctattaatatatcctaaaattttgttgtgtataggggcagggaccaatgaaagaacatttcattgtcagctcatcttgactatgagatcagatattggctatattttgaaggtagagtcagcaggatttgctgtttaactagagtgggatgtgggagaaatcagggagtcaggtataactccaaggttttcagcctcaagcaactgaagaaatggggtcaccacgactgaaatgaggaaaatgagagggggagtttagtgggggatggggtgatgaaaatatcaggattcattgtggaacatgaacagttaagattaactgaagagcctgaattcactgttcctcagtttctacaactataaggaggggttaataatttctcacatcataattgtgaggatttgaggagttgaggtacacaattaaaaacaaaagcacaggggaagtaaggaaaaatacatcaattaagcatggctattagaccatacagccttaccaaatccattggggattagatacaaaaatccaagcatgatctccaaaattttttcctggtagggttttaggctatactgaagtgacttttctttggcataagaagatattcagttatacagttggaaataaaggtattgatttggagtatccaaaaacatctctcagtagagatccacaaccaaagaagcataaaaaaaagtcttccattcactcgcaaaactgtcttatgaccattgcaaccctcaacagcaaacatatggagtctctactacatatagaggaaaatgctagattctgaaaagctaatatctataaaacagagtttatgatgttgttatattctggggattgatgtaagcattttaccaggacttattatagcattataagcttaacacaagaaatatgtggctatcattatggagtgaaaggctggaaaattcctcacctgtgacctgagagatagtgcgtggtagaatttgaaagaagtgttgatttcagaggaatgctagtgcttgcttagggcagtattcagaagaactcttccaatcacacagccccttgtacaggcaaactccggaatactttcagtacatttacttggctttattgttagagcagaaacttcacagctaaaattatggtcttaggggtttataagatgcaattaaacttaatttttaaaagttctcacaaatcttatttgaagtcttaatatcttaatttcctttatataggatatgtggatatatttttatgataaaagtaacatgtgaccaacttaataacagcttcgttaatatcctaaagccactcatcttactttacatataaacagtccttctgaagcctaattatgcatggataattgcagagtgagtttgggaaaagaccaaccgggcacatctctctccattttaaccacaatgagaagagagtacctagtggtgcatcttcctcgcttaggttccctgagtctgtctttacaggaagacttcattgttacttgaaggtacattcttggaactttacacacccagccactcaacacatgaatacatacttattttagttaactgagtacttagtgagtgctaagctttgttttaagccctttgcatgtagtttattaactttgttaatagttacaacagtccttcaagatacatgtactgtgttatactagtgtaacagttgaggacaccaaagaacaaagaggtgttgacacgtggtcacggttccatagagtgttaagttagagttgggttcaaaccctggcagtgtggccacagagccttgttctcagccactgcactgcactacctcctcccgtgaaacataagaaaaatgtgagaaatgcttaagtaagtgtagtttttattcataaataaaatttacataagtacattatgtgtaatttgttttatgtatatgtgtgtatgtataaataaatacatgtaaaaataaggccacagttttaatttttttccatctctataataaagcatgtattatagaccattagcagaatttaaagtgttatagtaaatattaattgtgacttttgttttcttcttccccagtttcatggttttctccaaatgaaaatattcttattgttattttcccaatttttgctatactcctgttctggggacagtttggtattaaaagtaagtattatttctacttttcatttatgtttcagtgatgatatagttatttctacgagacattgtcagcgaaatatttaaagttgtactaggaaaagtgctattatgataaatatgagtatgtaatttgaatactactagtctccttgaagtatatgttgtcgcccacattttgctgcagttcacttttaattcctaagaaggttgttttcacttggtgtttttttaatctcttaagaatgaatagtaggaatattagtaccaacaccttaaactcatgtcacattttaatattcacagaacatctacacacacattatgttattaggtaaacaggtggtgacagcctgcattagttttaaggtaggacgttatactttggagcatttagattcccctctttttattttcccagtttgattttctctgtgtacacgtgttcacccttggaaaagtccagtcggaactatgttttgtcatcctctgcgtgcagttctgcagcctctaaagaagcagccaccagagagttaggttctttgatcttgctttcctataatagtaacgtaaccagacttctgaaggcagatcttgatgctgcattagatttagcttcaacaacacagaattgtcattactaggcaaataggtaatatgcattacggttaatgtttaatcaaccatattttcatattttggtaaagaaaatttacaaaattaatgaagttctgaggtgacagtctaaacttttaagctttttaaatacaagatttattccttctttccttgtagcatcctgaagaccagtaaacatttatataagcaaggaataaatactgcttatttaatttattctgcaacctttaaacacacaaaagctagtaaactattgcagtggattgccctgttgtatattttatgaattttacttttactcagcagtttaagctgtctatatctatggtggtgtataaacatggaagggagatgactgattgattatatgttttaagcgcttttctcagtgtatggcattctggaaatgcttagtgatttcagaaatgttctcaacttttgtctgaaaggaaaaaagggggaagaaaggggtggcagtggcaactgtcaagacattttataacttttactttcaagatagtgtctagacttcttttggaaattttcttataatctcttagttttttatgtcaagaaaaggactggtgtagcattaagacctattctggcatcaatgatattagggaaagcttttaaccatattggcagagccagactttaagggctaagtcatatgacttgggcagggaacagcctttttcaaagatcatgaaattatttcacatagtgcgattttttgagtttggcttgatggatgtttgctgatccagacgttatcattggtgacattatttttagtgaaatgaaccaggagtgagtttgttcactgttggctgtatttttacaaaatgagctttacaatattttttctgacttaaaaaagtcatacatatcactttagaacacctcgtacaaagtagggagttatttaaaaaaaaaaaaaaaaaactcatctgtagtccccaaacctagaaataaactattggtatattctggtgaatttcctgtttccctttctgtctttttctattcatttttgttatcttttttttaaaaaaaggtaaccataaatggactcgtacagcttatatgcttgtacgttctgatgttcccccatgtcttcagaaatcttgttatagctgcctgtgttctacttttgtggatgcactataatttacttaactctcatcttgatggattttaaggatgtttccaatttttttgatactatgaaaataactctgctaaagatatgaagcctggaattggcagagatattttaagactctagatacatactggcaaaatgttttccagaaacgtttgtatcaactactattgcagatgagaatacctgtctttcacctcagttataattctgatattataacgctaaaatctctgcaaatttgatgggtgaaaaagcatcttattgtaattgtaatttttgtgttagtaaggtggaatgttcttttttatattttttgtactggtcatattttaaggaacgtgcttataaacctaaagaaatattttggtgggaattttttgttttggctcatcttgaaacaggtagatgtgtgtgtatgtgcatggaagaggtatgtctatacatgattcacccagcctgcgctcacatttaaaggtgttgatgataatagtagctaaccatttgtggagctcttgctctgcttgacaggttctgtgcaaagtactctatatctgaaatgacatttatttctcccagaaactctatgggcatagacactgttgttattcccgttttgtagataagaaacaggcacagatagattaggcaatttgcccgcaatcacccagccgtttcctgatagtactgggatttgaactagtactgtttaccactgcactgtactgcctccccgttttgcatttattttgaggattttatttccatgaagggtgaacctatatctaagcacataatactgagtagctaaaacttattaggagagcagaatgttgacctgatttgtttacttattctgcaaatacctagtgacagggtgcctactgattgctggacaccaagctacatgcctgaaatgtgggtgtgatgtgcatattgccctggttttgtagcacccacatttaagccagggagacacgaatgtatgtgcatcccatgccttgtcacatctttgagatagtcatggatccaaatctaacttttctgttagtgcctctgttgatggcctgagcattccaccaaatagaaatagaaagcacctctattctccacctgcttagatgtatattttttagaatccagtatggtaaatcttctaaagcattcataataactcagacccatgacttttattttatagatttctagttctgcttaacttttcctgattaccatttatggtctgtacttggctacaggggatttctctcagtggtttttccagctctgcatgtgagtctttgtggtccaagacaaacctggacctttaccaggctaaactttcagtaaagacagcaggttatgccctcatttgctcactctgaggagaaagagtttctttataccagagctgtatcttgaaagatgtctcaggatgccattggtcctactgaggaagaagcctgagaagactcttaaactcccagagcccagccagcacttggtgagccctggaccacgtttcaaagataaaggcctcttacagggaaatgttcctaaataccttcacctttagcttagctttaacttaggaacttttaagcagaatctctatgcttagcaaacagctcagagattgctagaatcaaacaccaaggcttaactgatagtattgaatttcagacgctttgtttgtgttctgaaaactacaccaactcacagtttgccactctactgacaattaagttcctggctgattttcaggattcttctttctcactctgatatcattttaagtgctgtccacctagtcctccagttcctgcaggattaaggtccaactgtatgtaaagaactggctaacattttgaaattctttgagataggcctatctgttctttctttgcctttgtaactttgttttatacaggcaatactggcttcgcacaaaaccgcaagaccataaacatgaccatgtaagctgaaattctgcaaaacaatcttcatgatgaatgggaaaaactattattatattgttccatgacctttaaaattttttttgttgttaaaaccttaaaaactctgttattatcaataacaacggcattgggaaatgaaaaatagtaaagctagtatttagtatgtggtaaattaaatcattagaaacatcgagaatgaaagtgtgttatcaagagtagtttgaacaacacttgtgtgttcttcttgcataactttggatacagagcaagcatcttctctatggcttggtgaattgtcatacccctttctaagtttggatcggtttctaccgttttatcctttgcactctcaatgtcatgaaagaattcctttaatgtttttttgaatgtttaaagtttattttattgccagtcacttcctctgggacatctttattctttttgttacatcctcctcactttcctcatttatatcagtaagtccaccttcgctgagttcttctggcttcatctctagagtttcttgcattgcagtaatgtcgacattcgcacaatcagctatttcttctcttactccatttatggtctattcaaatttcactcctagcatttgtcagtttttatttctttactctttcatctttcttgcctagtttcctcttttgatttatccattataaaatgtcacatgggtttatcactgggaaacaaggaggtaacaaaactccatactttgctgtctgtgcatgacctaaatatcagatgtacagtgactagtcaccaacagtcttcaaaagaagtgacatggttgatcactgatcatgatgggacatctgctatttacatagttatttttgaactgaagaaatagcagtgaagttgtactttatgcagttactcagttaatatattgtggtaattgaaatttggactgtttatgagggatttatttgattaaaccatggtaactggaattcatatcagaatagtgcaaagtgaggactgctgtacttgattccaaatttaaaactgtattctaggcatctttaatttttttttttcaactttcccctccctgctcaaaattactccacagagattttggttacggctcagatgtctttgagtagatgttcctgtagaaatcattgttagaaaattcaaggaaaaaagttctcattacactaccttgagatcctaccaagtccttgagttttgacttgaggacagcttaataatgaaagtaattcagccatgaaagcatatttaaaataagtaatggaacaggaaatttcttcatagattagaaaaattattctgaaaaagtgaagacatagcctatcttggactaggaaatttccatccaagaaagtaaaatatacaataaatattatcacaaagaatcattctgtgacctggttgatggcccctggtaataagactttgttattaagtttactgtgaattctttttttttttttttttttttttttttttttttgagacggagtctcgctctgttgcccaggctggagtgcagtggcgtgatctcggctcactgcaacctccgcctcccaggttcaagcgattcttctgtctcagcctcccgagtagctacaggctactggcgtgcaccaccatgcctgggtaatttttgtatttttagtagtgatggggtttcaccatattggccaggctggtctcgaactcctgacctcgtgatccgtctgtctcggcctcccaaagtgctgagattacaggcattagccaccatgcatggccccttacagtgaattctgttcaataatcttgaactcccagtgctttcccttggtcctgtccatataatgatcacattctgttattaaataatgtgcttatgtgctgattttattgtaggaggaattgaacaaatctatagctcagcattttactcttttgtagaaatcccttgaccctttccaaatccagacatcacaaccttctccatatactcaaaaattgtgaaatccacaaggcagggaaagttgataatgaaaaaaaggaagtttggtctgttggacatcctcttctttcatcttttatgttcaaagtacttgatgcacaaagcctggactcttttatctctgtcctatagactgatgtctagtcagtattcattgtgacaaaattgtttcattagagcaagttggatagtgtatggagattattataaaatgatttaacttgtcttctgtcaagtaattttataattggtattaatgttcatttttttccagtaccagtttcagaagctttcatttgtgtatgcatgtgtgtgttaaataagtgtattagatacttgaaaaatagtaatttaaatttaaacaatttaaaaaatgaaattgtaattttatgtgtaaaggtgtctgatgtgctttattctgcactgaaaacaatattcatttacagctcaacagacaccaaatatattctaaaattactttcctagagttatcagaaaacagcactgtaataatgaaatcaaacccatctttctttatgatttattcttagtctgatacgcatcagcctggtaagccttcctgtctctctgcttacttaccaatcactccaaatgtcatgtctttgggcaggcattaaattcttgggttttgggttttgttggatggactgcagtctgtgtgagcctatatgggtgtgtcaaatccagtctttggggtgtcatggaaacttagcatgatagacttgattttatccccaagttgacttggtaatttcattagatttcatcagtcacaacctgcattttatcttgtatgtgctgtctattggtcacaaaatcagaaaaccttcttgtccattcataacattagctgttttttcaggtggctagagggacatgtcattgcttcatctgcatgaatttgaaagattaaatgcataaaggaattttcttagagtagagtaggccttcaccatctctttaactgggaaagaagttttgggagtaacatactcatcactcacacccccctcccctcaaacacacacactcacccattagaatgtaagggccttgaggcaggccttgtgtttgcttttcgtgttcactgtcagcatttagaatagtgatagtcatatagatggatagtgctcaatcaattattgtcaaataaagtaatctacttgttccttgatttagactagcaaaaggggctggtacattgtaggtacacagtaaatatttgtagaacagatgaatgaaccaacccaacagatttcttagaagtagcctgcttttggttactaattattttatagaacatataaaagaaaattttagaatacctaatttgttcacaaaaatgttatattgtctcccctgatacttggtattcctgtgtcaggctgagcactaaggttatacattttttgttaagcatgtaattactgttatttctcatgtactttattttgtgtattgatttcagtagttgtagctgagggtaatccttaagagcatgcagattttaaaaattacatagattgccttgccaagccgtctgaaagtcatactagaaaatttgataagagcctgctgttaacaacacattgagttatttttatcttaatgctaagtggagaattacttgaatttattttttttgctgcatttaatgttttgatacattcaataaataaggataaatccacttactgaaggacaagaaaagatcaataagagatccttgaggttattgggttctatggcatctattatatcaaattccttgccctttcactatactgagaaatttgacgactgggctagcaacaagatacctaccccacattagctgtggtacctgctgaaatgtgaccatgtgagcaaagaaaatgagccaaaagaaactctttctgaagattcactgaagaaaacctggagatactctttcattagtagaccccacagagacaggtggagtgtccgttatccagaatgcctgggaccagaagtgttttggatttcagattttttcacacttgggatcctcaacatgtgtatttgttggaaatggctacttaatttaaggaaaagtttaaggtggcctggaaaataagtagtagttgaactaatcaacaggaaccaaaactactttcaatatatagtgtacttatactcaaagagagacggaccattttatggtggaaccctgtctatggtagtattttgtgatgttttatttttgttgctattgtttgcactgttttctcctataacagctcttctaagccttaagaggataaattttatatgagattcaaactcttatttttgttaagaaggatgtaagtcaccaggcatggtggctcacacctgtaatcccagcactttgggaggccgtggcaggtggatcatgaggtaaggagctcgagatcagcctggccaacaatgtgaaaccccgtctctactaaaaaaaaaaaaaaaagaattcaaaaattagccaggcctggtggcgcatgcctgtagtcccagctactcgggaggctgaggcaggagaatcattgaacctgggaggcagagtttgcagtgagccgagattgtgccactgcactccagcctgggtaacggagtgagagactctgtctccaaaaaaaaaaaaaaagaaaagaaaaagaaaaatatagaagaagaacataagtcaacctttttccatgaaattatactgtactctaaggcaaattcttgttgcttgatcttagtagcttttttatgcattgacttaaacctggaagagtttcttatgaatgtttgattgactgtgaggtgcatttgaaacagcttctactttataaccctttgcagaactttcaagctctatttagataacaatatatatgggattaaaatggaaaatgtgacatatgtctagagaaagttcctttttctgtgtatgtgccttttgtgacttatacactcagtttcattctagccagcatttgagcctagaaaatagggaagttatgaaaactctgtgccttataagaaggcaaggctatgactgagtattagacacataagtccagggctgggcggaagtaatgaatcaaataaaaacttggggaacttgccataggatgttttctgattaatatgggtttctcttctctgattaatgtggatttcagttactcaactgtgtaactgaaatccacattaataaattggttatttattgcttaggacttatctccccataaagagactaaaattgaggttataaattatgggtagatagaaattccagaaatatttaggtacctgtcatataccttaaacatagatttttatcacaatcatttaggggcttatttattgcttttactttatttaatgtttgtcactgtagaagaaaaaaaactaaatgctaaatataacatttaaaatattttccccttcatgacagccaccaattgattactgtcatggagactatctctatgtggatgacacacagcagcatttcaatcacacgctgtttctttccgctactcagtttgcttttaggttgccttaaacaacttccttggtgaaaaaatcaacttcaatattaaccaaaatttaaaagattcatatatagtaaaagaactaatattcgcagattgacccattccattctttcagagaaggtatgagatacttgacagtggagctagcagcagaaacaataacatgtatgatgaatcccattgagtctttgcagtttatttttattaaaatattttaattgaacaatttaagctttttttcttcatcaggatttcacaagggtgtaatctgcccagttttattctgtcatttttttcaaaacaaaataactagatttccagattgtttactaattttttataaggtaggacaaaattctctttttctcaatattgttaattaacccattatttcccattagtattatgtacatcagtgttgtgttgtcacttggagtggttttgctcatcgggggcattgacaatgtctgaaaacagtttgattaacataactggcatctagttactagcatctagtatgtagaggccagggatgctcctcaacattctatattatgcagagcagtgtcccccctccccccaaaaacttatctagctcaatttattagtaatacatcaaccgagaaagactgatgtatagaacctcatttgttagtgtaggaaaataaggtgtcacctataaattcaccatccatatttatactgccgtgacgttatccatttgcttatgaaagagatgtgaggtgacttgatgatattaaggagttgttcctcataagttattacattatagtacttctgtcagtttgtctctgtaccttacaagttattaaaatggcttcacttgtgattgagttcatataattctttgtttttcttttttaagcacttaaatatagatccggtggtatggatgagaaaacaattgctttacttgttgctggactagtgatcactgtcattgtcattgttggagccattcttttcgtcccaggtaagatgtgcagttcctaggcaggaacgcaggaggtagatgagtgcattccaaggtgaggagggctgcattagtttcctagggctgttggaacagatgaccacaaactgggtggcttaaacaatagcaattccctttccatgctggaggccataagtctgaaatcaggacgtcatcagggccacactccctctcaaggctgtatggaagaatccatttcttggctcttctagcttctggaatttgctgaagaatgacagtgtttatcattccttagtttgcggcagcataactccaccctctgcctctctggtcacattgcctcctccttcctctatgtctttgcctctgtgtttttgttaaatctccctcagcctctctcttatgagcacatttgtcattggaattagagcccactcatataatccagggtaagctcctcctttcagatccttaacttcatcatatcttttgccatataatgcagtattcactcttttgctgtattaggtaatattcacaggttttagggattaggaggtagaaataattttagggccatcattcaactcactacagaggcaaacttcattggccaagacatgaaagtagaatgaatgtgggaaccaagtctggaaattggcagttgcatttggaggatgggaatgtgagtgggaaatgaggatatgtagcacatgtaaagaaaagcaaaggaaggctgggactcaacctaataactatagcacaccatcgtttgtggagaagaatgcagtgcaggtgtaatatttaggaacatgggcttggcagctctattggtatctgaagttagtgaagacagcaggaagaaggaggtgaattcagaagacaacttgaaggaacaattgatttgactttggggcatactgaatacagcagatgaagggaacagtaaaagatgaatacacagtttctcactggaattctgtaaactagttaagaaggaggcagagccaattcaaggtttcagcatgttgaaacttaaatgttgagatttagatgtcttaagtttggtcttaatcaaaaaatagtcactaattttgtgtgaggttttcagggaaacgtatatttttaaaattttcacagttgtcaagcacagaatttagattagtacatttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagttaacatctaccgtcaaacaatgaactccagagtcagtctttggtcttaggagatccctgattataccaaatgcaagtggaagttattgctttttaaatactcttgacatgcttctgttacatccttttccttcctccagcgattggattaacctccttcgtcattgccatattggttattcaggtgatagcctatatcctcgctgtggttggactgagtctctgtattgcgggtaagagtcatctttctgtagacctaatttgggttacttttggacagagctcttcttcctttttctttttctttctctctttttaaaaatatatagacttgatttttttttttagtgcagtttttggttcatggcaaaattgagtggaaagtacattcacatggatatttttatgtggacataagttttcaattccatttgggcaaataccaaggagtgcaattacgggactgtaaagagtatgttgaaataaactgccaaactctctgtatcaaaatagctgtaccattttgtattatcaccaccaataaataagagtttttgttcattcatatacttgacagcatttagcattctgagcttttctttttaaacttccaatttaccccagtggtaatagtgctttcctcctcgctacaaagatattagctgtatatatggcttggtggctgattgttctagcacccaaactgatatgcctgtatttgtggaagagcttttaaaataactgggctcaaattggttggagccttagacttgaaacaccagttcccatttcttgatatgataaggtatgtgttatgcaaaggagggctttgttcttctaataattttgagtcattttactggttaagttaataaacatatatggataatttttgttttttgatcgttagaataactctcttaaaacttgggattattactgttttttagtaagttatttcatatgcttttctaatacagaattttatttgtttttacagcgtgtataccaatgcatggccctcttctgatttcaggtttgagtatcttagctctagcacaattacttggactagtttatatgaaatttgtgggtaagtcaatcttattttcattaacctatgccaataatttcagatatatcacttagaaaatgctttttagtttgttcttccagtttaggaccaaaaatgagaaaatacaattggagtgattcgaggataattaaagagggtagaagacatataggatttttagttggttcttccagtttaagaccagaagtcagaaaatacaattggaatgatttgagggtaattaaagagggtagaagacatataggattaatgaaaatttggtttccaaagtagtttaaaggaaaatggctttatctattagaatgtgtacctttttatactaagtaaaaggggagagatctttgaggatccattttaagtaatagaataggatttttaattgttccagtgtttctgtgatagagctgtcctgcacagacctgtttgtttgtcacttgctctttttcttgcagacatagacaccccagacaggaattaaaattcacaatctatcaattttgttcatttaaagagcagtgacctctaatgcatgactttaaaacagttctagttaaaaccaatataatgaaaacattgagtttcaaaatttaggcttttactccttttaaaatcaattattagtaagtatggaatttacttcattgtttctaacttgtatatttaatctgccaattttcaagtaacatttctgcataaattcttattttttattgagatatatgtacacagagagatattttcaattgtgcctgaaactaatgttatcttacctaagctcaagatgttcccaataatgtaatttatattagtttccgttttttaaaaaaattatatttttatgaaataaaacatactcttaaccacctatcaaaataatcaaaagttataaattaatggagtaaaaaaatagtgtttctgctttgctttaggtaaactttgctgtatgtgtttctaaaacttaatacgaaacttgaattgttatagtcaaataatttctcatatgactcacataatagtttcaaaaaacttttacctttatttctgaactttggttcttgatgattgttaattgaattcaattctgtcatatattctgtgtctttctttaattaatgcttattagataaataattaaaatacttaactaaaatctgcgtatccttagcatatgagttcataagtcttagttgttgctcaatgaaattttctaattttataccacataatgccataaaatacaatggagacatctaaagcagaatggaattcatgtggtagctacagtgaacatcttgaatgttggtgcatattctatttttgttacatcttccaatcaccatgtgtctggttctggaagatgacactcctggttttgttgctccccacaaatgcctgagaatagtgtgtgatttgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataagatgagaaaaaggactgggcacaataacttaatgtgaaagcatagaaaagattacaagaacctaaccaaactcactaaagttgggcttgttgtttgtagagaacgtttatataattataaggatcaatactttctcatttttaaagccattaccagttagttcaatataagggcatatagtgttttgatacaaatcaatctggtagcagtaagtaccatatttaccacaacatcccagatattttagaatgatgcagatgcagaatatatacgtagaatttatatctatgtatagatacaaattcagatattttcttgttcaatttaaggagaggtaaatttggtatcaatagaaaaaatgtttctgaaaaatttaaaccctggaaatgtatttatggcatggagtcagatgtttcagggagagaagaacaaatcaagaagcattgcaagtatgctcatatggaatgcttaaggcttgtggttaaaaaatatatatatatggctgtcaatgtcttaggctcatggtagcagcagaaatcgtaataattcttttgtcacatgggttatatccatattggagagaattaactcaggtgaaattaacttgtacactgtttggttttataatatttagagggatcacaactgactgatgtccctttgaagtaccattcttcataaatctttttttttcagaatgggccagccaactgtgacatcccttggatcggagatttagaactagaaagtattctttctacattattagggaagaaaaggagttacttggcggttagcaatattctattttgttttgttttgtttttagagacagggtctcattatgttgaccaggctggcctcgagctcctgggctcaagcaatgctcccacctcagcctcccaagtagctgggactacaggcatgtgccactacacctggcagtgtttattctgataaatacatttatgagctcaaaaatgtaactctaaaaccttatctctgaacttccatattaccatcagaaatttagatagttgtttagttctctttttctttgtagaacatagatataaggcatggtttcattgaagtcagttgtatatacatgtaactatcctgatgttcccaaataaagctctgtatttctgcttagtttattggggaggctgctaaatgtagtgcatcccaacccattttaccctgttctactttaaaaagaggttggcttcttgtttggatacaaggaccaagtcactcccccaggttcctccacagtaagggaggcctatttaaagccgcccatggcactaacagaaactggactcctatgagctcagatacataactgggcctcacaggggtgggacagtatgtagtctaggaattggaaggatccattccatatcaaagaactgaagcatcgtgttgccctctcagcagcaagagtaaggtgatgcccctgtcagttatagttcctgagttcctctgtctttgattctttgcctattagccagctagctcaccctcttgtttatgccactgttttttatcctattcatgccttctcacagacaacttttcttacctacagctttggactcatccttgtctcctttctgtttctttttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaaaaaaaaaaaaaaaaaaaaacactccagtcatgcattggtgaacaaagtttaaaacaacgtgtattcagcatggagtcacagaatgatcctacttttgtatgtttgtgtcacagcctttaaaagcatgtcttgttatataagccattaccctcctaaaaaagactatagttcacaggaataagttaaaagacataacaaaacataaaatgactagtaccaggaattgtgaccatggtttgttctggtaactgtggcatggcatggtttgttccaggaattgtggcatggtttgttcatgtttacattctgatgtcctattttttttttttaatttctatgtcctttccttttccttggtggtgtcattgttctgtagctgtatgaagaaactaaacttttctccattttcaggaaagcaatctaagaatcttgagtgcctcttcctttgttaatttctcttaagatgtgacttttttaaactactgcatcaggaaatattgtaaaacagttttgccttgaatatttgtgatgaaatctacgatgatcttcaagattctcttaattttgctaatattcagctgatcagaatttgtttttaaaatgtctggctggtgggtacttcccactgacaactgcttattgcttacagtatgtctgccttgtcaatgaatgaggttcagggtgcttcctagggatcagagtcagtaccatttttctctttcatctacagctgatcagatgtttattttacttacattaaatgaatgatggagatccaaagtgaatattatagaatattattctaggatcaacatcttttgctttgaaaaatcaacatctcttggcttttcctcagccaacccagcaaacagagattatcagactctgttgattttttactttcatttggcattggcctttttcttactgaaattaaaaaggctaatgatttgcctggtttctgtctctgacctttgcaggtctattttcttaatttttagatactatatatctgaaactttttttaatgtgtcaactttttaatggatagaaaatagacacgaatagtgattatgtgttcatttttcaattttccagaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagct

SEQ ID NO: 37949 - DNA, 14238 bp, Homo sapiens
ttttttttttttttttttttggaaagcaaggatcacacttccccctccctgttccttaatcccttttctaaaaaggggggaaaatccggatggattttagggattggtctggtgtcagctgtgttttattgcacacctaaatcctgattataggcttttcatttctccgcaaagcctttattttggcagttaagccaaatgtgttttccagaaagttagttattttctcctctttctttcctttctttcctccctttttcccgtctgaccccaaacgttattgtccaaacatgactggacagcagcttttgtttcttgaccctgtaatatgacagtctgctaatattgacagaaggtgcagtttttgggttatagtcgtgattttcgctaatcaatcatattagcaggaaaaaaaatgacttgtttctgttgtacttgagtcttaagaaaaagtgcccatagtttagtgacaatttccaaaggctttagtaccacctgtatttcaaaatgggggacccaaactcccggaagaaacaagctctgaacagactacgtgctcagcttagaaagaaaaaagaatctctagctgaccagtttgacttcaagatgtatattgcctttgtattcaaggagaaggtaatttaaagttcttaatggtgaattagcacaagtaatttttgtaagtgtatattatttgttactcttaaattattatgaatattaggttaaagagtggttgaaaaaaagtctgctttgtatgctctgttttttcacccttaggggtgattctgtgaattgagcagttgcagcatgcgaaaagacccttgagcgttctttggtttggaaataaatttgagtctgaagcttagtagtagtatacactgagttgacatggggtgggcaagattacaaaattttatatggagttaacatgggaaaccttatgatggaatttaaagattatctaatgtagagtataaataagatggttgaaagtgtgaaattgtaatcagactgtttatatgctaaagtttatcctgtttcttaaactgcgtaatgtaggtaaccttttctcttacatttaatgaagtagaatacaccttttaggagcaattaaatactgaaatggttaatttgtgtttagaagtgtgattttcttttttacttagagttcattttgccttgtatagaagtacagtttttaaaaactcaaaatgacctagaggaagtttcatttttaggggcggtggaggtcttaatcagaattagttccgcagttaaatagcaaacagtaagttgtgagtagtcaaggatgggatgataagagcagtattttttgcaacttaaaatgaacattttcttaaattatcagcaaggcttatttgaccaaagatgaggttatgaatgtaaggaagtgctacttggattttggtgcttaaattgttagctaatttcagatcagaaatacaatcttagtgtggtatctattaagtatctggaagttttccaggtttccccctactgtttaactcttattatttttgttgctgagacaggcctcactgtattgcccaggctagtcttgaactcctgggctaaagtgatcctcctgtcatggcattttaaagtgctgggattacaggcaggagctgccacgcacagccccaactcttaactcctaaaaggttatttgtatttaagaacattcttagctgctgaagtatagcattgtgaagtgatttttaagtaatttttgaagtgactgtcccaagattgggtggtatcaaggacttacatctccacttttgttttgttgacaagctgactcaaaattgatgagattggattttagttgaagatgatacagtgtatgctctttaaataaatccaagataataagtagtgagaccatatctttgtatttaatctatatattgccccaaattgcaccatcttaattctttaacaccaacgataatctggttttattctgtgaatggacagtgtccatgcagttgccctgaataattcatgatatatacttaatagtacagaattttaaaaagtagtttagtgatgcgtacttggtcttgagtagtattaaaagagaacttggtgtgcttctttttagtctttcaaatattgatggttttggctgggtgcagtggctcacggctgtaatcccagcactttgggaggctgaggcaggcggatcacttgaggtcaggagttcaaggccagcctggccaaatggtgaaaccctgtctctactgaaaatacaaaaattagccaggtgtggtggcgcaggcctgtaatcccagctactcgagaggctgaggcaggagatcccctcgaacccaggaggcagaggttgcaagtgagccaagatggtgccactgccctctagcctgggcaacacagtgagactccatctcaaaaaaaaaaaagaaaaaccagaaatattgatggttttgataatgtaatattgagaaagtaatggaaattggcccatataaggaataaaactattcatttgtctgaatagcgttgttttaaaactggtgagatttttaattttaagaagtattgtccaaaatagtgctatggataccattatgctataaaactcaagcattaaacattctaatgacagtttgtacatgtatggttggagggggaggtaggggaagaacagaaggaattacctatctgaaaatgtgttttcagtgtataagttactgcagacagttaagaattttgtggagttaatgttacatgacattgtaatatgaactgagtgttaaaaggctgtgctccctgtgggttaatacaccattttcttttcttctagaagaaaaagtcagcactttttgaagtgtctgaggttataccagtcatgacaaataattatgaagaaaatatcctgaaaggtgtgcgagattccagctattccttggaaagttccctagagcttttacagaaggatgtggtacagctccatgctcctcgatatcagtctatgagaagggtaagttctgccttaagtcttgacttgataaagtttctgtggattaaccttgcatttccccgccccccgaaccccccttaaagtggatagttatgatagtgaccagtctcttcaggtaaatttgtctttgtgccatgttgataactgggatcatgactttaaagcattgtgtttataggattagaaaaacacgtttttttacgccagaccattcttatgtggatgaagtatataaagggatttctttaatctgtgttaggtgttgatgatctcggacttttttttttttttttttttttgagacaaagtcttgctctttcgctgaggctagagtgcagtggcatgatcttggctcactgcaacctctgccctcgcgcattcaaatgattctcctgccttagcctcccgagtagctgggactacagttgtgcgccaccatgcctggctaattttttgtgtttttagtagagatggggttttgccatgttggctaggctggtctggaactcctgacctcaagtgatcctcctgccttggcctcccaaagtgctgagattacaggtgtgagccactgcaccctgccagtagccaactgtttttaataatttaagtgttatgcagaaagtttaaaaatttttgaagtaggtttgtttttgaaaacttgaccttgagtaaaacatggacaactttgttgtattaggctcataatattgtgtattattattgtggataaatgtcttatgtctccgtttattgtatttccttttttggggggaatatgaatataaggaagtgcttccagctttgtaaacttctgcaacatgttaaaagttaatctgggcatacctgaaccaagagatccccacagttacttggggagaatgctggagataaccagatactggtctggaagaaattatggaccttcaaaaattaatatgctggctacaataatgaagcagaagtcaggaatggagaaaagtagttttctatcaaaataaaaatagcatttcagctataataggatagtgattcatattaggagttctaagacatctttttaaatagattgatttttaaaggtggaaataaaggttcagggtctgacaatacaacagatatcagagattttgttggagttttcaccatgcactgataagtctaggtcttggtgttaggagcattggactgagtgtatgtgactctctgtaagataaaaattaaaattagagccaggcacagtgacttagcctgtaatcccagcacttcgggaggctgaggtgggtggatcacctgaggtcaggagttcgagaccagcctggctgacgtggtgaaaccccgtctctattaaaaatacaaaaaatattagcggggcatggtggcacacacttgtaatcccagccattcgggaggctaagtcacgagaatcgcttgaacctggtaggcggaatttgcagtaagcggagattgcaccattgcactccagtgtgggccacagagagggactctgtctccaaaaataaaaaattacatcatgagctattcagattataaactattatgtttacttcctaagatataaaatgatatatggtagatcttttgtacttataaaatgtttttataggggaaccctataatttgtgacatggcttgatgtagctgtttctttaaaagtaaacttttttttttttaatcattttataggatgtaattggctgtactcaggagatggatttcattctttggcctcggaatgatattgaaaaaatcgtctgtctcctgttttctaggtggaaagaatctgatgagccttttaggcctgttcaggtattttggtctaaagtgtgatgagtatttcaatatgtgaaaactactagaatataatagggtctaacttgagaaattctttgggaaaatggtttctgatagttttatttcacgagtctcccctatttagaatattgtgatgcaagagaagaaagcgtttggattatagaatctcttgacagtgtggtggttccacctgcccagtgtggctttgaaattatgactagagaaaatcttttaaagtggacatttactgatttatagaggggcccacagatgagcttctgagatctgtaactcttgaagccttcaccacacatccttctaaaaccgtatatttaactgctgcttcccaaaggaatgtgatctgaaatgggtgaagaaatcattttgtagaagttgatctgtatataaaattatagaagaaagaagtaaatttagtagtcattcttaaccttaaaatcttgctgacttttgactgtttgtcatggtatactagacattgctcaagtgaatcccccctctagtgttaagggcatttactcatgttgaacctagttttatttacagtatatttgtatgcatagaagatggaggtccaccaaagtgttaattatgcttagttgtaggtcaggtatagctaactttccttttttaatatatatatttacatttgtgtttcctttataatttatggcatagattgccacgattttcttaagtatacttttataatcagaaaaatgatattaaggactcattttaagtacactaaatcaaatattagaaggcttctttattttaagctaattgtgaggattatttgtcatttaaaacttttgcttctacttattaccctgaagtatctttgtggtgcttatgtttttcacagactgtataaattgatatactctcccgccccatggtaatgttgctacacataagctctaataattatcatttttaatgttttaagattaattcaactaagttttaaaaataatccattggttacatacataagaaagtactgtatacagattcccctgacttataatggttcgacttaagattttttcaactttaccatgatgtgaaagccatatgaattcattgtgctcctcgatttatgatgggactacatccaggtgaagtcattgtaaattggaattgttgtaagttcaaaagtcactttttgatttaaaatacgtgtaacttacactgggtttatcaggatgtaacatcacaagtcgtggagcatctgtatttcggtcatttaatggatgatatctgactgaagggagaaaatgaatataaaaggcatgaaaacaggaatagaaaaggcatgtttaaagttctcagcgcagggctgataactctagctgctctctggaggtggtgttaggattttgttgttttttagttaaggatttcccactggaaaaatgtaggtctgcttattacagtatgttttcaaatttctaataccctgcctttcccactgggaccttatttgaaatagttgagttaactttagtcttgtgtcaaatagtactctttgaagtcatggctgatgtttattgagagttgactgtactagtttcagcttttttttttttttttttttgagacagagtctcactctgttgccagattggagtgcagtagtgtgatcttggctcactgcaacctcctcctccttgcaacctctgcctccgcctccctggttcaaatgattctcctgccttagcctcccgagtagctgggtctacagggacatgccaccacgcccagctaatttttgtatttttagtagagacgggttttcaccatgttggccgggatggtctcgatctcttgacctcgtgattcacccgcctcggcctcccaaagtgctgggattacaggtatgagccaccatgcccgtcctttttttgagacagggtcttgctctgtcgcccaagctggagtgtggtggcgtgatcttggctcactgcaacctctgcctcccaggtttgagccgttcttgtgcctcagcctcttgagtagctgggattataggcgcatgctatgacacccagctaatttttgtattttttttgtagagacggagttttgctatgttggccagggtggtgtccttgacctcaagtgatctgcctggcttggcctcccaaagtggtgggattacgggtatgagccaccacacttggccttagactttctcttactttatatatatttaatctcagtccttaaaataactgggtagataggaagaaactgagacagaaattaggtaaataaggcccaaggcagttaaataggataaaagcctggactgactgtgcttttaactcactaccctgtactgtgaaaatttacctatattaattatagaatcttaaaattctggactgagtgtaagcagtatgatgtaggtaatgactttagaattcaactgcagtaagtaggttaatattgtaagaactaatttgcttttctgaagtaatttaaaatgtgtgaatatcctatatgaggggccttaaatataactcactcagttctttctcaaagaaaatgagaaaaggaatggtaaatgttaacttgcaggcctcttttttttgttttttgttttttgactcttaaagcactttacttatttttaaaatttaattaattttttgtagagatggggtctcactttgttgcccaggctggtcttgaactcctaggttcaagtgatcctcttgcctcagcctcccaaagtgctgagattacaggtgtgagtcaccgtgcctggccttttgaagcactgtaaaacctgaatatatgggtagtgaggatataatcggaaccagaataaggattgtttttaaatactgagttcttcagtgtactgtgaagtgctgggaggtactactaaaatgtatctcttcttttctcttcattattaatgctactgccaaggttagctcctcccctgactgttagaatatttcgttacttctgtgggaattacttctttcatgctgcttatgagaagttgtgtgtgtgtgtttgtgtgtgtgtgtgtgtaccatttcttttcagataagtggatattcaatatgatagaattgaaatgctaaagaactataaggaaggcctttttcagtctcactcaaaccttttttcagtgtggttaccggttcttgcacccaccctggttgcttaccatattgcagctttgttacttgaatagtatttcagtttttaacacatttgtttttgtgttggttctgtttcctagtatggctgttttttttgttttgttttgagatggtgagatggggtattactctgtcatccaggctggagtgcagtggcatagtcatggctcactgcagccttgaactcccaggcccaagtgatcctcccacctcaacctcatgagtagctgggaccacaggtgtgcaccccatgcccaactaattatttttgtagagataggatctcactgtgttgcccgggctggtctcaaactcctggcctctagtgatcctcccgctttggactcccaaagtgctgggattataggtctgagccaccatgcccagtcagcgtttatcagattacttaccattactactttgtcctggggaaatcctcttaatctttaaaggcgcaatccaaaatcataatgttcccgtgttacttactgttacttttttttttttctcctatagtggtttgatgataagaacccaatttgggccgggcgcggttgctcacgcctgtaatcccaacactttgggaggctaagccagatggatcacctgaggtcgggagtttgagaccatcctgaccaacataaagaagtcctatctctactaaaaacacaaaattagctgggcgtggtggtgcatgcctgtattccagctacttgggaggctgaggcagaagaatcgcttgaacccaggaggcggaggttgcagtgagccgagatcgcgccattgcactccagcctgggcaacaagagcgaaattccgtctcaaaaaaaaaaaaaaaattggagttttacagataaccacatcttattctgggaaaggatttgaagcaagttgggttttatatttggctgtacttgtcctcttcagcagtataataagccccttaaggctgaagtaaccttattcctattgtttagtagctaatagcatgcttttgatatgcttatgatcatactaataatttaatatttgaattgtatggaagtacaattcagtatcattttacatatggtatattgtgatgctgtatcatattttatgttacggtttataagaaaagctcctaggtataaaatgctacatagcaggaacttggtttttcaatgttattatttcctactgtttttgacgtaacggcaataaaatttgtttgaaccaaaatggactaacaattatttgtacaactcagtattgtctaaatatcatattgttaaatctaggtttcttgaattctccatcaagcctggtcatgtcatgtagcatttggtgtctcaccatgcccaacagatattttgtgggaggatggagttgatcttcctcatgttaaaagattgaagggagtgttctgacttaattgataacagtctttcataacttcacaaatttttgagaatgacccaaggctaactgtgggaaaaattcacataaaaacatagcctatctatgaggagcaaaactatatttcagttgtgggctttacatttcatttaaccctcttaactgtcctgtgaaatgggttacagccttattttatagatgaggaagctgaagtttaagggatttgcatacggtcacgtaactagtgagttgtgcagctagggttagaataaacagatttattttttttttttcttagaaacagcaattaacaatgtgactcctaatcaaaagaaaagagatgtccttggggcttaaagtactatggtgggagtcttggactgagtaggtttgaaaatacaattttatgatcgtggagtactaggatttagtcattttgatgcagagcatttcctgatcaactgctgttgtggagtgtactgtccaatagaattctctacaattaaggaaatgttctgtatctcaagagattgttcttaatggtggccagtagtcatgtgaccgttgagcatttgaaatgtggctagtgctactgaagaatggaattgtaaattgcttttaatctaaattttgcctgtgatattattggctgtgggtttgccaaaatttgtttttttaaagaggaaaagataacggactgttggctgctttattggacagcacagctagcatatagatgcagataggtagtataacttgtttgtagtttaatataaatgttgtattttgtaattaggccaaatttgagtttcatcatggtgactatgaaaaacagtttctgcatgtactgagccgcaaggacaagactggaatcgttgtcaacaatcctaaccagtcagtgtttctcttcattgacagacagcacttgcaggtaagcagcttttttgaaaaccacttacaggctcattcaaaaacttattggttagtaaacgttttatatacaagttacttaattgttgtgtcccccaaacactgcattatttttgaagttatttaaaaagcaaaaaataggctgggcatggtggctcatgcctgtaatcccagcactttggaaagccgaggcgggcatattgcttgagctcaggaattccagaccagcctgggcaacatgacgaaaccccatctctacagaaaatataaaaactagccaggcatggtggcgtgtgcctgtagtcccagctactggggaggctgaagggggaggattgcttgagcttaggaggctacagtgagatcttgtcactgcactccagcttgaatgacagaacgagaccctgtctcaaaaaataaaatgaatttttaaaaaagtatttcccaggcctcactgtagaacaatggttcccaaattttgctgcatgttacagcaacctggcaagccttttttttttttttaaacgggaaaaaacccacctccttcgaagcttttaaaagtcatgattctagtgaacagtagtgagaactattgccctaaagcgtgtctaccagatgtgtgggcaatggatgaacatcacttgagaacttgttaaaaatatagactctcaggctctactaatcagagtctgcactttaaacagaaccctcaggtgatttgaaacacactttgtttccagaagcactgacctggacgtttttttttttcttgagagggagtctctgtcgcccaggctggagtgccgtggcgcaatctcagttcgctgcaagctccaccttccgggttcacgccattctcctgcctcagcctcccgagtagctgggactacaggtgcccgccaccacgcccagctaatttttttttttttttgtattttagtagagacagggtttcaccatgttagccaggatggtctcaatctcctgacctcatgatctgcctgccttggcctaccaaagtgctgggattacaggcgtgagccaccgcaaccggctgactttttaaatctaaaaggatgagggacatatatttaaaagatccacatttatttcaaataagcacttccatttgggcacagtgtctcacacttgtaatcctagcattttgggaagccgatgggggaggattgcttgagtccaagaccagcctgggcaacagagtgagacgacatctctacaaaaaatcaaagaaattagccggacattgtggcgtgttcctgtggtcctagctactctggaggctgaggcaggggagaatcacttgagcccaggagtttagagttgcagtgagccatggcaccaacacactcctgcctgagtaatgcagcgagaccccatctcaaaaaaaaaaaaaacaccgccaacaacaaataaccacttcccagttaagcagcaatccaagtattgcaatttagtttttagatgcagccacttgctggctgtatgatcttggacaggtaactgctgtgagcatgttgcttctgtgaaattgaacaaatgataatcctaaggttgttaaatttaacgtaaggttgttacatttaaaattaactaatacaagtaaagtatattacatatgtataggtttatttacatttgtaggctacttcagacatcttcaaagtcagagtccttattttgccttttagaggtgctagatagtgaagaaaagatgaactttgtaattaagttggatgttcaaatggtaactactttttaaaaataagggttttgatttaactggtaatactttggcttttttctagtcccttaccccaggatatgcttaaatcttttatttattttttgagacaaggtctcaactctgtcaccacgctggagtacactggcatatggatcatggctcaccgcagccttgacctcctgggcgcaggttatccacctcagcttcccgagtggctggactacaggcgtgtgccaccacatccagctaatttttatattttttgtagagatgggttttcgtcatgttgcccagaatggtcttgaactcttgggctcaagcaatcctcctgactcagcctcccaaagtgctgggattacaggtctgagccaccacacccagccttaaatttttacctattccttcatcctctcactagcttctattcttaccacatctgctttatcttcctctatataaaaatgacttcaaacttctcaaaatctgtccccatgaaatgcctttagctttaatttcttctagcaagtagtctctggtttacttccctaactttttatcttctaattctgcataaatttttcctttatcttatatggcaagattttgtctgtctagaatatggatagggactacaatttgtcccttactctgtatgttaagatgtttaataaattgtgggaaatggacttcatgtgacagttacgctaaagtcttatttttaaaaaatattaaaatgttttccccttccagactccaaaaaacaaagctacaatcttcaagttatgcagcatctgcctctacctgccacaggaacagctcacccactgggcagttggcaccatagaggatcacctccgtccttatatgccagagtagagtactgaccagcaaaatggagaagatcagagaatgcagcagcagttttttttcttgttttcttaccactttattctttcagagtttaaagaaaatggactcatgcacagaacactatgcattttgaaacttgttcatcctggatttttttaaatcatttttatctcagaacttaaacaaaaattagatgtcgtgcacggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggtcttcccatttgtgctggtttttgcctctttgacatctgtcatcagtatttagagggtgagaagtgaatgtaacaggtataaataacatttttaaaaacaataactttgctataatcacagttgttccagagcactgtcagatacattctaatgaccagaactggtttaaaaaaagaaaatacaaccatgggaaagaaatcttaaatgaaaaacgcatctcattgtaggcatttttgcctcatattttactgggccatgtttgtttcctggtactcatgtattttttttttccagatctctttccccaagttgctattgtaagagtattctgctgcgtgtggatgcagttatacacattaaagcagatctggagtctgaagtagctataaagcagctataaaacagaaatacatgcatagctgcagaaaccatgataggtagaggacttttcttttggttttgttttgttttgttttgttttgtttttggttttacagagaagagatttttattacaaagaaaaaaattccagtgaattgtgcagaaatgctggtttttacaccatcctaaagaaaaactttacaagggtgttttggagtagaaaaaaggttataaagttggaatcttaaattgtaaaattaaccattgagtgtcaaagttctaaaagcagaactcattttgtgcaatgaacataaggaaagactactgtataggtttttttttttttctccttttaaatgaagaaaagctttgcttaagggttgcatacttttattggagtaaatctgaatgatcctactcctttggagtaaaactagtgcttaccagtttccaattgtatttagcttctggttggaatttga

SEQ ID NO: 37950 - DNA, 7202 bp, Homo sapiens
cgcggagaaggggtgcgagcggcggcggcggcggaggctgccatggacgacgaggaggagacgtaccggctctggaaaatccgcaagaccatcatgcaggtgagccgcgcctggtgttgggggcgggggcgcgggcggcgggtgtaggggcccgaggtggggtcgagcacggcgtctcctcgtactctcgtcggagcagcagcgatgaagggccgggccgatacgggaggcccagaggtcgccggggataccaggcgctggacccgacctgagccggcagcggggaagggagggggtttcgagacgtctgggtgcggtgcttaggggtgggtgggcggcttgggctggtgcggcgcgcgtggcggcgagaggaggaggaagccgcgaatggggacggggggcgcccccagactctgcccttctctgtgattcagcgtcgctatttgtccttgcgtcctgaaccccatggagtcttcagcatccgaggctggcagagttggtggttgggaagcagcgggcgagctggggctttcgatggggacgtggagctcggaacccgtgccttggggtctggggcagatggaggccactgggtcgagtccggtttggaagccgggcacaggcctgaggacctgcggttcagggtattgcctcagccattggggccgtttgagagcttttgctttgtcttgcttcccaccctttgcccttgtcctcagcgaagccccccgcagcctgattcttctttctccgatcctcaaacattgtcagcctgaagtcacatctgtttcggtccctgtcattttttttttttaagagatagggtttcattctgtcgcccaggctgcagtgcagtggtgcaatcatagctcactgcatccttgaactggcctccagcaaccctcctgcctcagcctccctaagtactgggatcacgggcgtgagcctccgcgccccgcctttgtccctgcctttagggtagctctgcaaagtggtttggagggctttgctccctgccaggtttctgtgaggctgggtggacagacggtcttggtcaaggctggacatctctgggagcctctcaggatcatactggtcccatcctgtggtgtgaggctgtgggggccggggtggctgtcatggagcacacagtgagtgttcatcccgtttgctgttcacctctgtcctctgcagcagccgcaggtctgacttccgggtcacgagctttggccgccttcctctctctgccctggggtcagctggttctttctctctgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccaggtgagcagcgggtcccgggggagttccggtgaagccaccagagcacctgccgaggagccggtcgctagcacccacccccactcgcctggtgcccagcatttgtctctctgcccagtctgggaggaaaactcccctccccttccttgctgtgggtgatgccgttgatctctgacccctctcatgctcagcttctttctagtttccctctcagtccccttctctcttcctgccaacgaggagagtcacaagggcctccccactcacccccagccccccatgtcctttgccctagtgtcccttggctcccccatcctggccgttgggtgcacttccagcttcttggcctggcccaggaggccccgtctgggtcagcgcagcctccttgtgagctgcggcccctgcccgccccagcccattcctccgcaccccatgccccctctcccctgtcagcgtccggtactcgtccctcgagcttgtgctcgggcctcttttcccaggacccctgggaccctcggtttcagcacctgctttgcggaagtctccgcacctgtctgcctccctagtatggctctaaagccctcagcggttgggggattgcaagcgccttaggggcgcagccccacgcccagaattaatcagtggggtgacggagcacgtctgccaaccggacctggtgacgctgctgggtttttttgttttttttttgtttttgttttttgaaaaagagtctcaatctgtcgcccaggctggagtgcagtggtgccatctcggcttgctgcagcctccacctcctgagttcaagcgattctcctgcctcagcttgagtagctgagattacaggcacccaccaccacgcctggctagtttttctttgcattttagtagagatgaggtttcaccatgttggctagactgctttcaaactcctaatctcaggtgatccgcccgcctcggcctcccaaagtgctgggattacaggcgtgagccaccgcgcccagtctttttttttttttttttttttgagactgagtctccctctgtcacccaggctggagtgtgcagtggcgcaatctcagctcactgcaacctccacctcccaggttcaaacaatccttccacctcagcctcccaaaaagctaggtttacaggcatacaccatctcacctggctactttttctttttgtattgtttattaattaattaattaatttttttgagacagagtcttgctctgttgcccaggctggagtgcagtggcgcaatctctgcccactgcaagctctgcctcccgggttcacgccattctcctgcctcagcctcccgagtagctgggactgcgggcgtgggctaattttttgtatttttagtagaaacgggatttcaccttgttagccagggtggtctcgatctcctgacatcgtgatctgcccaccttgacctcccaaagtgctgggattacaggtgcgagccaccgcgcccatcctgtattgttaatagagaccgggtttcaccatgttggccaggccggtttagaactgttgacttcaagtgatccacctgcctcagcctcccaaagtgctaggattacaggtgtgagccaccgcacccggcctcaggtgatgcttcttaaagagagcgtcctggggtgtgaggtctgcttgttggagaggttggtgctgagtcacccgcctccccagaactgcccagggtgggagcctctcagagtcgaaggtctctgcttctccctggtctctgggtgactgaggggtgtcagccccctgtccctgtctccgggtgaatgagaggtttcagccctctcttcccctgtcctgggatcctgcaactcaggcctcgttttgcaaacgcggaagccgaggcccgagcaggagagacacctgtgtggaatggggctggaacctgggtgctctgggctctgggtgggcgagggccacgagggcccaggctcgtgcaggccagcacactctctgtctgcagaggagcccaaggtgggcatcaagaccatcaaggtgtactgccagcgcatgcaggaggagaacatcacacgggctctcatcgtggtgcagcagggcatgacaccctccgccaagcaggtgggcacccctgccccaccccgccagcctctccccctccccagcctcctcccgcaagcagtacccacaggcggcccacgtgccttgggctttgggccaggccagccagggtgccctggaggatgtggccgggatgtccggcaagccccgaccgcctccctcccaccgcgtccatgggccccaccccaggcagccgccgtcctcccccagctctcaggaggggcgtcagggcggagggcactgtgcctctcgccagctcctgtgggctccagccctcggcctggtgcagattccaggagccggaggttctttatcctgagctgatgtccagggggacttgcagaggaggcccggcacggggtcctccaggggcctatccgtgttccccgtctgtctgtcggacactctggagccaggctgctgtgctgtgacgggcagtcagcagagcagtttagtccctggcccaccagctgtggggttcacgcagccacacagagcagcacccctgtatggggaagaggtcgccctgccagctctgagggccgcccctggaagcgtgtgatggatggaaacacatccgagtttccacggccacttcactgctggatgaggctctcgatgagcagagaggctggggaggggcgggctgttgaaggctcctgggctggcggtggggttttctgattcacgacgtgggtgtgttgttggggcacacgagtaagccccaggtagcttgaggcaggaaatggggttggggttgtctgggcccctccgggccgtgccttagagccgctctcttccagtccctggtcgacatggcccccaagtacatcctggagcagtttctgcagcaggagctgctcatcaacatcacggagcacgaggtgggcgcgcgccgcggaatcccgcctgcgtggggccggcagagatgcagcgtttgtgggtggccaggaagatgtgggatctggggcccagggcaggtgttcctattagtgcatggaggacagggttctcaaagggtggccctgggcctgcagcagccgaacccgggagcttcctagaaatgcagatcccggccgggcgcggtggctcacacatgtaatcccagcactttgggaggccgaggcgggcggatcacgaggtcaggagttccagaccatcctggctaacacggtgaaaccccgtctctactaaaaatacaaaaaaattagccaggcgtggtggcgagcgcctgtagtcccagctactcggggagccgagattgtgccactgcactccagcctgggagacagagcaagactccatctcaaaaaaaaaaaaaaaaaaaaaaatgcagatcccgggcccaccccagcctgtagaatcgggactgctgggagtgtggagggaccctagtgctgggacaggaggagtcccagcaggaggtggctgtgcccagcccgtctgcctcagaagccccaggagctgtgactccgtcccccgcctgtggagccagggtggggtgggtgggctccctgagtgccggggatcggggtggggttcagggctcttgtccgtctgaaggcgcaggggctgtggtggcacctgggagccacgtggggtctcaccagcccttggtgatgcctggtggcttcctctctcggcagctagtccctgagcacgtcgtcatgaccaaggaggaggtgacagagctgctggcccgatagtatcctttccagccccaccggccccgcccctccctgtccctcgagacttccgcgttccccccccacacacacccctgcccccccaacggccctgtctggcattttcctgacggtgcttcgcagtaagctccgagagaaccagctgcccaggatccaggcgggggaccctgtggcgcgctactttgggataaagcgtgggcaggtgagccctgtggggagaaggggccctggggctgctctgagctgaccactcggagaagggggcttctgtccctccccgacagcccctcccccttgatccagggcctggaggggacctcgagaccacacccccaatatccccctcttaaagccagggccactgggcccagagaagagcgtgacccaggttcccagggagcgggtcccacagcccagggtcagccatctcggacccctgccggccatccccagcccgtgtgctgcccgcctgctgtctggtgactgcagtgagacccctcaagcattcgcagcccctgctctctgtctctgcaggtggtgaagatcatccggcccagtgagacggctggcaggtacatcacctaccggctggtgcagtagctaccgcctgacaggtgagacggccgagggacaggcactgaggtggggtcagaggcaggggtgtcgtcccctccgtcggtgtgcagggctgttcttgctttgtccggcagcaagaccctcctagcaccagcccagctgggccaccaggcgctcccaggacacccccagacccccagaccccacccgaccgtaggctgcagctcttggggctgtgcgcctggacgggagagtcctggtacgcggggcgtgcgtctctccgccgctgacccaccttagaagcaggagacgttcacctgcagggcagttgtgcggcgggactttccagaagagggtttagaaacctgcccagagaccccagagctgagagaggaggcacagcttcaggccaacccttccctgagtgggcaccttgggagggactggccggagtctcaggagcgggacagcctctgcccatggcgagagcctcccagcttcccctggactctggtcatggcgagctgctgtcctgcaggccgccccacttcacactcagcccaggggtggggcttggcctggtctgacgctggcacggttcctttgaggtcagagctactgcccacgcctgtgtgaccgctgggcacaagggagccgtccggcctctgcactgcggcctgggccgcctcctgccaggcctcccgcaccccgtcacgttcggtgggcgttgtgctgtcctgggcatactggatctgcccctgtcgtgtgaccactctccccctttcctagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccg

SEQ ID NO: 37951 - DNA, 2500 bp, Homo sapiens; identical to SEQ ID NO: 36368

SEQ ID NO: 37952 - DNA, 262053 bp, Homo sapiens
gagggagatagcgtgcatccagaaagacaaagacattcctgcggaggatatcatctgtgagtactttgagcccaagcctctcctggagcaggcttgcctcattccttgccagcaagattgcatcgtgtctgaattttctgcctggtccgaatgctccaagacctgcggcagcgggctccagcaccggacgcgtcatgtggtggcgcccccgcagttcggaggctctggctgtccaaacctgacggagttccaggtgtgccaatccagtccatgcgaggccgaggagctcaggtacagcctgcatgtggggccctggagcacctgctcaatgccccactcccgacaagtaagacaagcaaggagacgcgggaagaataaagaacgggaaaaggaccgcagcaaaggagtaaaggatccagaagcccgcgagcttattaagaaaaagagaaacagaaacaggcagaacagacaagagaacaaatattgggacatccagattggatatcagaccagagaggttatgtgcattaacaagacggggaaagctgctgatttaaggtaacattttaattactgttaactacacaggcttgtctgtcaagaatcatgagtacctaagatatccggtactatctaataacttctggattacgtaggggcacaacctaggatgagctacccccaaatttaaggcttctgagcttgtgtgagtttctcggtgttgtttctattgtgtccacatttaggccctgtattacttgagttattttgattttcctttcaaagtctggagcatgagcaattcttcatgaaaagatactgcttcttctctatgtgtagacagtgtcgtttccctataatagaaaaaaaaattgcttaggggctgaaatattgggattttaaattcagatacttattttagtgagctaatagaaaaaggcatagttgtaatctctccaagacagcattttcagaattaccctataaacaaaatctgctctaaacaacaacccagggagctatacctaagaataattttcttgcacattgtatataatggaataactccctccagagaaggaaacagcaaccagccaaaaataaggtaagtagagggtattgaatcatgagtagcctcattcaggaaacatgtaactaattagcttcattttctagacagaaattatttaacaaattatctttgggtacataatgactatattatgaaaaactatctcatgtatgatttacttattgtgaaaataattttcattgaggattatctgaaagacatgatgttctctgggtattttgaattttgctcttggataaaccagaccatctgggagtggcttatctggatatttgcataattgctttttcagaaatatttatgcagttatgatttggattgaactgaaaaaaatatagtaacatcagtaagaattgtatatcagatttactgtagaaatgatattgaaagtgtcatcaactctatcacacagtctattctcttgattaaaaaacatataagacaaatttccctgaagtttcgacctctgcgcttctggtgaacagctggattgtttttcttatggcctctggaaatcttgtaacagaccacatttgcatgttaacttcttctgttaagaacctaaataggactgtgtggcatgcatgttgtttattaacatatctttagctttatttagctttattttttttctcacctgatttttttttcaatctattcttgtctactgattttgctatgcatagattttgaaatctggtttaaagtgtttttggaaaaggatatagtttaattagataaacaaaaattgattggtctgtctaagacaataactttctctcatcatagagttctggttactgttttttggaatttttgctactctctcccctctttgtattgacacgattgcattttatttcagctgtacggtaatttgccctttttccattctagttctggtcctgtggccttgaatgaaggctgttgttctgccttcattctccaggtttcctacaactccttaaatgtgtgtgtgtgtatgtgtgtgtgtgtgtgtgtacctctgattctgtatcatgtatattttcaactcaattcctattttgttcttttctgactatccttattctggtgattttcttatctcttttcctgaagtatattacagttatattagttacttggctgacatcaaataattgaatgagtctccaagacaagttgagttgtttcctgctatcactgggttagcatgctgtagacatttaatttaacgttgactactcaattaaaagtgtaattaggttagtagctaccattgcatagagcctaatattctcatccagttgtttgaattaaacaaacatatttaaaactgcagagtttatttgtcaggaacttgtatcccattagaaatagcatatataacttccaataaattgatagttgcatatattttctgacttattacagtataggttaaactttatgttaaatatattggctgtgaatatttctattatatatgaattatcatgtgtgatcaagaaagtcctagagaagaagagataaaaatcagatattttgacctacgttttgctcagatattataccatgatatcagtgaagccaataaagtgaagagtgaatcaatgacatcaccaaagcacagggccacaaatcaagaacttagtgatcaaatttaaaatgttttagcttctattaaatccagaaacaattttaccatgtaggagaataaaaataatttaatatggctaaaaattacattatagtaactgcataagtttaactaaataaaaccaagaatctggggaggcagatcatagacaaaaataattttagaattactgctcaaatgtttaagttaacaatgatggatctgccctgctttccactttccaatagaccaaaatcaataagaatgaaaaacacaaatgaaactctattctgacagcaggaaacggttacagtcccaaaccacagttgatacagaaatttggctaatgtggtaaaattagacacaacttagggaggacacttagaagggcattatgtgttacagctttcatgaacactcagaatctctaagagtagcctgaactttctgaggggacaagccaatgacacttccttagcatgacatggtctgtgtcaatgaaaagggctgctgaagcatacttgagttctgcttgaaatcagaatagcataataggcaggaagcccactatgctattattgccaacaaaagactatcagtttgacagactgagggattaaagttttgacaactagtggaagagaattctaaatcactacacatacactaggacacaggaagcttccctgtaaaccagtgacttccagccaggctgggtgaaatcttagcaggaccaagagatggtatgaaagtataccaggtgtttctccaagaaaccaaagatgttaaaggaaatatggttttctgaatccaaaacagaaagaatttaaaaacagaatgagtttaaaagtgatctgttagagctcaaaaaagaaatggaggagatttataaaataagaacagaaatgcaattcacattagaagcaataaaaaatggaaaaatatttggtggtgaaaagagtcaatgacatagagaacagtttgagaacatcaaataaactaatttttaaaagagataatggatatgcaaacaaaggacattactatatgaaacgctgatgttcctgaagatagaaccagaaaaattaaaacagaaaacacaacaaaatacaaggataagactttcctgaaattaaaagaagaccttgattcacacatcgaaattgtacaagactaatattctgcaagaagaagttgaaataatgacctaatgggagaactaatatagatcaacttttatggagagagataggtgaagagacatcagactgaaagctgggacggtgctcaactgtgaaacattagaagcattctctttaaagtaaaaaataagacaggacagcagattatctgtaatgataagaccttttcattctaagtaccagtcaatgtacctgaaaagagaaggaaatgaaaattagaaagcaagtggtaaaaataagaccttttccctcagatgttacgataattctggaatactccagctaatcaattgaaaatataaacaataaaaaaatcaataaggttgatgtacacaaatataatatccaaaaatcaatatattccctagatgcttaaaaaattaaatattataatggggaaaaagattaaaatatctcatttgcaaaaggaaaacttaaaacaaatatgtaaatatgcttaactataaaagttctgcacttaacactagacttggaaaaatagaaaaggatgtagttgtgcttgtctagaatatttagtaaatataccaactgtacattgttactgtgaaatttataagggaaaaatagatgtattagacaggaaaatactgaaaaataaagagagaggaaaggctaacttcacaagataattaagtgcattatactctatggtaataacgataacaagtaatataataaattatatttatacaaacagattaggcacagccactcatcatttacagaaattttatatcaatgtaaggaactgtttaccaattaagttcccagatcccagccaagggcaaaccctccaagcaggcctttttaaggatagaagtctcagcctgcagtactaactcttatgagtgttaaataaaatttacaggaggccattggtcaggattgagcctcctcctcctgcaccaggcccaacagaccaaaccaaaatggtgttgcttatctaaaagttccagtcaccaaactgaaaataagttctttatctgccttctgagaaatcaggggagagagaggtaatagccaaatccccaaacaggccaatcctagcagacacgataaggattttttgtttgtttttgtgtttgtttttttttctgctgtaacctttacagaaaagtaactttgaaatgaccaatccacgttttgttttctgttttgctttcctcagccctttactatctataaaatcaacctcctctgctcagctcatgggaatatttattccaacttgtggaatgaagtgttgccaaattccagaattgcagataaaacctattaacatatttaaatttgttatgatttttttcgtttgacatagacaaaatcatgcagttattaccacataaggtatgtgatttggaattaaacatgaggaagtaaaggcaattttactccactcccctgccttgaaatcacccagtaaccccaatcaaggaaataatctacagtttaaaaacaaaaaaaggaaaatggaaaactgaaaaaacgaagtgtctatatgataaatctgtgcctcagagacggaggaagctagaacctgaagcatgaaagagactcctctaaagcacccagtggcacaatccataaaggtttatccaaggctcttcttattggattatcccaatctggtggggggaagggcaagacacagggaatctggggaaggtcccttaagagccagttccccaccccagaatcacagaagtgtagctgttggggaaattaagcagaaatgttattttctggtcttctggctgaggtaagctgtcaaaggtagaatggaggaggagtagggagaggaggcagccatctccagactgcaacaagcatagcctgtgattgccattgcatcctcacctctggaatgctctacctgatgcagctcaccttctcctcaaatgaagaaccaaatctgcgtattgaagagcaaggaacaaggatgaaatctgctctaagtaatactagaaacatttaatggatgtagtgcctacttttgaaaatatcttccatttgaacctatctcgttttgtcgaattgtctgacaagggcaattaatggtaattataattccaggagaagcatttccaaaaagtgtgggaaattcagcccagtgaattcctgagggaataagacagatttaggattttaaacagatttctgttggctaagccaagaaaagtagaactatccagcttctagataactccataaagcagatacttcaggcacaaatacatgggataaacataactgggtaaaacatgaaggggtgaatattataataacctctagaaatattaacatcttggagtatttttatctcatttctgttaccaaattcatttttcattttaagtctttatataaattcagccttagcatttcagagagtaatgaataatacttcttaaagtggatttctgatttttgttttccaggcccagactttctggcatcccctctcatcttcaaatttaaaactgttgagcagaaaattgtattttttctcaacacagcttatctctttttgcctggttcttattttaccttagaatactagttgttaattactccaaacttctgttttaggattgctttccagaatggtgatatcaaacttgaatataaagcatttgctttataacagttgtgaagctggctgaatcaacaagaatggaatttcagtaatggataattgggataaataaataataaataagaatagtaaacctatgcattcatggctacagagtattgaacaagtcatttacactttctgggacccagctttctcatctgtaaaccatacgtgttctgggataggcaatgatgaggtagagagggagagagcctaaaaataaatctctaaaagcctttcaacttttgtgattctaatgaaccccaaacaaacaccatacctaaaattgcagacataaaatcctatatatctttcttggcagagagttaattaattttcaacatggcctacagatcagttcatactgaaacatcagggtgaatttctatgcagtgcctatagactaaggcagctctccgcagtcttgggagtaactgcaaggttatcactcagttgatgagctatatggttcctgagggcccatccccacgctacgactttgtgaatcagtaaaattgcaaatctaatcctaaccttaccaaagagaaaggagaaaattgcccactatttaaagtaacactccttttaggttgttcagaatccatttataaaattactacttctaaatagcaggcttttagatcttaaaactttctgttatatccaaagcgtcgagttgcccgccagatactcatcatcacgtctcgcaagcttgcctcggctgcctgttggccacacctgactaaacagagtcagtatgcccatattctttggtagatggtagatggctaaaaaggacattttagttttctcaaaatgtcgagctgaccaggcagtatattatgtttgaccttagaggtccactatcacctcttccccatcctgctcgtgtgtctggatgctgacctctgagcagtgtattcataggcttctgagccttctttctcattggattctaccaatgggagaaagcagcagtatatcagatggtgggaagagagactattcctgtctgttcctggctgaatttctctagcaaaggctcctgcctgtatccagcagtcctctccccagctctaggtctacctcagattctagtaaaatcctttcccttgattcctttatcgccatagggtaataatcttcctatagttaatagctgcaagatgctataccactcctcgatgcctacaattttgttaataatccttttacgaacttttctgaattaacccctgtgagtttacattgttttctgctggccctgattgagaaataatagctatgttaaagtacggtgtcagaaccagagaactgcttctatgtcattgttagtttactcattaactaattaattcactatgcatttatttacttatttaccttttcattcaacaaaactaaaggcatcaagacattctgggcactagaatattcagacaaaaagacaaaacaaagatcataatctcaaggatctacattttattatagaaataatgtcacaaaagaaacaataaaatattagaggtgctatgttttgtctacagagagagagagagaaagtgcgtgcagataacaacagagataatgagttcttcctggaaggaggttggcaggatcaagaatggcctcctagagaaaatgctgctagcgttaaggattagaaggcatgcaccaggtctaggatggagatggccaaagaatatgggaacaaaaagagcaaaggcactgagaattgcagcagtaattgttccgtgtggaaaaatactgtttctgtaggttgtttcacctctggaggttagattacaaagggaagaggaactagcctagaagagaaatggagaaaacctataaaggtcttggaaacctataaagatcttggaggtcaagtttaaatgtttagactttatatcctgcaggtctaaacatttccacatttattagtaacagggtttttaacacgccccaatgtatgtttatttatttataagttatatacatttgctattataaaagtatattgcatacattttaaaatcacaataattaaaactttaacataaataaataaggaaataatattttgccaatcactatggctttatgttatctttagctaggattgtaaggcaaattattcatgaggaggtgcattattaatgatagtgattttagcttattttatatacagtattttattttttatataaaaaataaactatctttttccaatcagttaaaggggagcgcatacattttcttactcctaccaaaggtatttatatttatttcaaaatgatagagcaactaggcagtcagaacatattcttcactaaaccagcactgagacccaagacagctggtctgaccaaaattataattcaaaaataacttgacttctattttgttaaattcccattgaacatccctcattaactatgacatctttatcttcaaacttatgcttcagtttatgtacatctcccattctgatctgttcacctgttattatcaaaatttgtttctatttacttctgctcttttcctcaacttaatttcattccttaaaaaagtactttgcatttatattatgtcaggtccaagatttcatgaaaaattgttaaatattgaaggttttctcaggaaatgtgtgttatattatgaaaggctatataccaacacatatatatttatatgtatacattttgtatgtatatatttatatgtaggtatattatgtaaggctatataccaacacatatatatttatatgtatgaatttataatctatgtaataacaataggtgaatgactagacaaactttctttttttaagtaaatatgatttttatttaattttttttattttactttaagttctgggttacatgtgcagagcatgcaggtttgttacacaggtttacatgtgccatggtggtttgctgcacctatcaacccatctaagaaagatgcaacgttaaccttaatcgcttacattaggctaagacaatgcctagaacataatcagctcccagtaaatgtttgttacagtattaaaatttaagaaaatcttttagttttaaaacctgagtcttttagtaactaacaggaattcaactgaagccaatgagaaaatggaaccttctaaggtcatgacaaaaaataaccagaacatgtaaaagaatatcctcaaaagatatgttttattcaattaagataatatacatttatactgattccatttaggatacaacattgagaatattatttcaatattattgttcctggttaacactaaataattgctgttgttatattttctttataaatgagaaaatataccattattaatatcataaatgtattccaatagtctctgagaatttttaaatttagtgtcatcttttgtccatttataagtgtccttacttatatcagtcactcctgtttttatatcttcaagccacaaagctcatcactatcaattagttggtgtcagtgatggcaaattaagggctaaaattgtcaatgtctacctgtaaacttctaacaaattcaaaaatattaaagtgaccaccagggtcacttcttacatcccagcgtatgattatctcatcatggacaggatgtcttcacctctccttttacttttcaggagtatttttaaaatcacattattggggtatgcttgatatatgaaaagttgtacatattaaaggcatacaactcaaggaatttgggaatatgaccttgatgaaaatgatcaaggtcataaacatattcatcacctgcaaagatttctttctgctccttttattattattgcataattactattatttttattattttgtgttgtaagaacacctaacataagacctaccgtcttaggaaaattgaggtagacaatgcactgttggttatttttgttttaagtgaggaaaattaaataaaaagagggtcctaggtagtattttaaacctttgatggatttggggaagggactaaacttaagtcagataatatatgtcactgcctaatcatcctccacatgaacttgaaataaggtttatatcactttcatcacttttcctgggagttttagtaatatctcccatttagttgttctatttagctctcttgcttgagacattgtgagagcaagtttcctatgggagccttgctgctgatcggggcagtgaccttgcatttccttggcagcaactgtgatcttacccattgttttcatttatttgctggaattctactggcttgatgtgggtagtattgagtttcgctctgactcaaacaagaatagttttaaataggaggaaatactttcaaaagaaaatacaaattcccataaaagagggaatttaataaatcattaatgcattgtttgtttgtataacctaattaagaatatgctcactcttttagagtctgctaacacattatattagtaattccatgtgttttatcttattttcttctttttaggcctctactcacactttcaccttgctatgttctttattttttttaaaatctcatatcattgtattataaagggattatctagctttttcccaaaagtttcattgagagatgctttcttctctacttagtacaaatatgtggtcactgatattagataaaagatgtgatgatgaaaaatttgtttgagtagtatttaccagtatagtaattgaattgtaagtggacaaaatactgctgtgcttaatacaagaagccattgtacagtaaacatcttggaatattgacacaagcacttacaatgtaacatactggaataaatgaagcaagtttttgaaaaataaaaattaattatgactaaggttgagactatgcaacaataacaacaacaaaatcattttaagatttcaaaagactacatataacagatcacaaactaacctacataaatatgaatatacatatattcccattaacagatgggtaagaatggagacagatactgaaacagagatgtacatcctaactctggaataataaatatgaatttctcagaaattattttcagtggtataaaattggaatacatttgaattttatacaatatacgatatactgatacattttggtttgtaaaatggtgttcaaatgcttttatcaaaaatatacttctctggcattctaatctatcaaggatcccatataataaaattaaatacaaaataggtgaaggagaacatagtagtcactacctagttccaattctgtataaagccttatccctaactttgatgtctttaattctgtttaggaaagacaagagaaaaacaaataaataaaattactttaaattactgtaattctgggttggcccagagattttgtatcttttatgggttgcataatgtagagttcatacttggtaaaaaataaatcattgatgaaaggataaatcttacataaaaacaactaaagtttttgagagaaggactgtacctatatttattaaggtaatttgataaggcagtagaatttgaccagttcctccccagaaatgtatagaacttacctaagtagggtatggtggaaagactgagcattccaagtcaaacctcatttttaaaaaatctgagaagtcgaatgagcaggttatctgtaaggggcagtcaagatgctggtatgacttgaattaaaggagcaggtggcaaaagagcagtaaataacttttgaaaagaagcctaatgaccttgatggtaaggcagaaaaatctggccttttcttcagtaaactgaggcaaaattatgttcataaacaggaatgatatgcagaatggattggaggggtcaaattctagagtttggacagccacaagtaaggtcgtggttataatccaagaatggggtgaggaagccctggatcaaagtagcagcaatggaggcattgagaccacatagacaatacaggatcaactcaagtggaaattcaatattggcagttttcatttaaaagtttgattgtatcttctgatgtctgcctataaccagcctccaacctttggagttctgatagataaataaatggcaaaatgctgggatgatttggatagtgctggcaaatactagaaacagaaggaaaagaagttgcctgccctattttgtttctatgttatttcatctttctcaaataatatgtatcaaataattggtcattttatttggagtcccacgtcctcaatagacgaaagtcagggaaactctgagatgatttcaggtggccagaacactaaagctgatcccaggctctgtttgttctaacctttcatgatactaacaactgaggttctcttctattccttgttcaacctagacacatgttttcactgtttatccttgtatgtgctagccaaactctacatgttctaggtttgaccctgccgaagagggagagatgagtgagaaaggatatttttaaataatcacttcgctctactcacccccacccccacatttacttactttctctaatcctgaactgcaatagaagaggaagtcagccatggggtgtggcatagcattcttttcttttataatagatgatgaatcaggaagtctgccctgagagtgtggcatggcaattttttcttttagatgatgaataaggaaggaggacttctaatcaaggaataatatggattagtgggggtgggaacagggtaagacgcaagagatgctactgagacacaaaatttaatgaggcactcacccccagggtcatgcaagtgcgttcttaaattttgttcctaggtacttccttgcttttcctagttccgccctaagtgggaagaggagtgagctgactcatggactgaggaatctcatgttctctccctgcaaagacttcctcatctgtttctgtatatttattcagcaaatatttagtgatcatctatcaggtgcttaatttttctttcctgagtcctaatagcactgacctggatgatagctaccttctaatttagatagtccatgaatgtagcaatattttaggcaagtataaagcactgaaggataaattttgaccaggttacaaaatcatgaattactttttctttgagtgtaaacatctccccttgtgggaaaatatttaagccttcaactctctgcctttattttctcccacaactatgaagatatctctaaagcctttctaagggatacctatgttataacattttggagattttatttagccaaaacttaacttggctcttactttgttcctctatgcttactggttatttaaaaaaataattcatataatctattcatgacattaatacatggcccttcactatgttattttagaaattaatattgagtgggacaattttagatattcagccaggttgataagagagaataaggcaagtgaaaccctggtggtcctgtttaagatagagcttttaggtagtctggagaggtagtgtacctatctgccgggagcttagaaactaagtcatatttgacactagaagaatcgttttacacaactgatatgacataacaccagcatcagattcagatggcctggattaaagtcagaactttacaacttatttcttaattttaaagtaggtataaaatccctgctttacctatgtgtcaggattattgtaaagatacaaaaaaatcatgaatgtaaaattgccatgtaatttgataatggctgaggaaaacatgaattttattaataataataaataatggccttaaaataattagatggtaaagataattgaaaacaaaagagaaaacaaagttcttaccttcttaagttttttaaatctctttcaaaaaagatggggttatattgaataatgaggaaaaatctatatgtgatgtatgtacaatttggaaaattaaaataaacaccatttttaggtatatgtacctttaaaatgttaagacaagaccaatattaaaaagataaatgtttactttgtaaatatatacattttactttaatatgtctttccattaacattacaaaatcttttcctactcacactagccagaaaaactgctttaaattctggaagcatccaaatatcactaatatgacgttatctttaatacatcctactaagcacaaaataagactgtccttatgtagaagccatgtcattatgacaaacatatttgaaaattagttttgtatgatttgtgacattcaacaaatctgatacaaatctgcaacagccaggccattgagtattttgatcttcaaataaatcatggagctttccttggagaaaaaattactgcatcactggtttccattacaaaacaatttatgaatgcagaattttataattatttttatccttaattattaataatttatatcctaactagtaagacacggaattcaaaattacagtagataggaagattctttatgcttttctttctttaagtgccaaggatttatgtctatttgtgtctacaggaactctatgacaaagactaaactctgtgacttagttcagaataatgtgaggttttctatataataaaaaagataaatcagagaaaaaaagtaaggtaaaccaaatctgcaatttaaaataaaatatgaaaatgaggattgtgttggaaattctggagaaatagttattaaagggatgtcatcgtaaactcatataaagtttatatcttgccagaaagaaagcaaaaggtagaaagtaactgaaagaaattaaaatcaatagaaactagtttaaactgatgatatgtcgtgactgggatacagtgtcatgatttggaaacgcagtattgagtgaaacgtataatggattatgtcatgtaaggttaattttgacaactgtaaatcagactaggaaacactgtgaaatcgtcatgaatgatgcatgttctctgctgtgtcatcttaattttagacttgcaaatttgatttctgaaactgcatttgaacaaccaaagcaatgtgttgtgaaacagatcaatttgaaaagaaaacattgcctaatgtgagttgtgaggtttcttggtaaaagtgcactggtgacatatctatgcaaagtttcattttacctcccatttcattatgaggctggtagtctagagccgagggagccagaggaacacgtgaagctgagaataaattgggagtgagggcagttgtcctatattgttgctatggatagagctgaatagtccatagtgagcttttattgtctatcggggacatttactgagagtgcctgatggaaaagtacagattgaatgaaaacaggctagttctaccctgttgggggcaaatgaagtgcttcggttgtgctagattaatttgattgtgataataagcatgtgttttttcatatcattcatgtgtaggattttgttaactagaccatgaactacttgaaagtgtctttctgattcccctaccctttcctcctctgtctctgttgagaggactgtgaggagctgctcagccattggaggttaccaaaggatgagaagggtgttgtcattcaatatccagaaaatacagcctgtgaaaccatacccattgttctgcattggtcttctctattataaatgatcatgttgataatgtctttttttaaagttggaatttcagttatgtctttatacttgtaatcccctcacaggctttgtatttattatttcattagtgaaaaatgaatgatacttcttctacatgtaattaaatttatctacaaaagtaactgcaatgccacaggtgtatcagtaatttttaaagtgtttgtgaaatttttctagaaatgtttttaaatgcaagatagatttaaagaaaatactttagacttacaaaaaatgctttaaaaatattaagagacaaatttacttcaatgaaagaaaataattgttgaacattcaaggaaattacaatttagggcatttgtagaggaggaaagatgtgaagtaagaataaaattattaattacttaactagttttattgagacagttcatcacattattgatcacgtttgtcaaccccatggtttatcattgccaacttattctttttatctgagagaagtagactagatgctaaggaaattctagaccaaactagagccttcttctatgttaaagatgaacagcaccttatagagacatgttttatcaggaatttttaagaaaggacaataaaataattataaaattgacatattattctagagaggcatcagagttaaataccaattataaagataaaattataaatatttaaactgatttagatagcaggaatacttgatatttatatttctttctacctttcttcatattgtctatcattttaaaagtatgtaaattgggcgggttgcagtggtttatgcctgtaatcccagcactttgggaggctgaggcagtagaatcgcttgacaccaagagttgaagacgagcctggacaagatactgaggcctctatctctacagaaaataataataaaatttaaaaaattagttgggcataggagcacatgcctgtagtcctagctactccagaggctttggcaggaggatttcttgagcctggggtttggaggctgcagtgaactatgattccaccgcaggagtccagcctggggaacagagcaggatgcagtctcttaaagcaaaaaaaaaaaaaaaaagtacagtaagaaaagaaattactgtttattcatgtggctattttaatgtaaaagtttagataaaatacataaatcatatcaagatttatcttggaaacctagttgttcatgcttagataaagacaaagatcatagttaaatcacatctgggcatttcttgtagtcattgatatacaaaatcacattaacatttatatctgaaagctttgaaaatccagtgtattttagtaacaaatgtaaccagtttctttatatttcttatttgctgataattctttatctttgtgtcctctaggttagatataaatattgcctaatataatgatgtttaaaaaagtttttaaacattgcgtactctttatacacaatggaaatagacttttttaattatttaaattttatgtattactatctttattatctttggattgagaacgattcattaaaatataaagaaaaaataaaagccacctaaaatcttaccactctgaaccctattaacatttaggtgattatgcattacattatatatctaaattcatatgtgtgcataaattggattgtatattaatactaaatttattcttctccttcttttttttttttctttttgagtcagagtctcgctctgtctcccaggctcctgtgcagtgttggcgcgatctctgctcactgcaagctccgcctcccgggttcacgccattctgctgcctcagcgtcccaagtagctgggactacaggcgcccggctaatttttttgtatttttagtagagacggggtttcacctgtgttagccagtgtcttggtctcctgacctcgtgatccgcccgcctcggcctcccaagatgctgggattgcagtcatgagccaccgcgccccgccctattcttctccttcttacatcatattaaaacatcaagcacatcctcattccccaatggagtgtaagttatgttaataaggtgtattcatatcaacctacacatactgattttacacatacacacaatttatcttgctcatttttagaaaatgatttctattatataaaatatacatcttacgtgtatatacaatatgtgtgtatacaatatgcatgtgtatacaatatacatctgcatcttatttttgactaaataaaaccctgtagaaacccctccaagttatacagaatagctctaatccattcttcttaaattctttattgttggacattaattttatttctgttttatgattaccatgatcaagcccacaataaatagccacatataagtgtccatatgaattggcattttaatttctgtaggacatattcctaggtgtgggaattactgggtcaaatttatttttaaaagatatttctagatgctttcacaaaaggtggtaacacttgacattttcttttttttattgttatactttaagttctagggtacatgtgcaaaacgtgcaggtttgttacatatgtatacatgtgccatgttggtgtgctgcacccattaacttgtcatttacattaggtatatatcctagtgctatccctccctcctctccctaccccacgacaggccccagtgtgtgttgttccccttcctgtgtccaagtgttctcattgttcaattcccgcctatagtccttgtgatagattgctcagaatgatggtttccagcttcatccatgtccctacaaagacattaacatctaatattaacatctaataaaaggtaaatctaacgtaacaacaaaggaatagatgattgttgataacctgtgtaagtagaatgctagagtgtgaagtattagtgttatttgccaacaataaaatattagaaatatatttatctatcctaggtctccgttagcattcatgtaatatagttaaaatttctgtacttccaataagaatttgtaggtaatttacaacaataaagctgaatgaatgaaagagtgaatgaatgaatcatacatacatacatacaaatatacgtgcaattagtaagatgagaggaaggaagatatatgaagttttaggagcacttttgcaagagggctatagtaattgaaaacaaaagttagattgatatacctgagcagcaaatagaaaatatgaaagatgatttgtctttaaaatgtgtatgcatgtgtgtatgttatgcatgtattgtacttttcctgtcagtttctgatgaatgttgagaacataagcttatataatagttccggtaaaacaattcaagaggggccaaagtactatggaccaaccaaataaaatgttacttttggtttgaggaagtcttagttcctagactattatgctcagatatatttgtgtatacaacttacagctattttgcaatgcacaaatatagcatcactgtgatatgtttttaaatattgcttatactctttattcacaagttttcttctgtttatccttgaataataagatgataattacatttttaaaataaaaacatttaaatgaatgattctgtacacaataaaatcaaaaacttgtgaggattaacagcctcacagttacgatttagtaattttccctgctctttttgctatttatcactttttttctgagtagaataaggggaaaagctacaggatgtgccctttcaagaaaaacaattaaagcaacaaaagagctagacttctcaaaagtcactgggttatggtaaaagaagacactggggagagctaaggaagggctgggcaacgtgagaacaggagaacacaaggaaccaagaagaaagggaactacttcctggcacttaagtgagtaagagaaaactagcaatttagtcagtgctgctaggaagcagattttcaattttagctatgcttttatatattaaattattcttggactgtgtaaagcaatacactgcaaaaaatttctttctgccactctaaatagttttggatcaaaattgtcagaccttattgctgttacaggatatgtactttaatctgttattggtgttcaaacctgtgtcctcttaacttgattttgttgtatgtccaacacaggaagaggtcaaagatgaagtcagcaccacagtctgaatgaaattttaggtgcattttgtgataatgggtcttcctcctggaagcagagagattgagaaccataacaactttatgaagaaaggagtagcaaatgagtcaaatatcacagagacattaataatgttgaaaatttgcctacactggtatagaggtgtatataaaaattaagggattagaaaatattatctatttaaaactttagtatataacaaaggaaatatcacaaaccagtaaataaaggaaaaattattcaataaatagcactatgacattagtaatatataaaaatttggtgacataattgtttttaaaaattactttagaatcttactctgtacacagtaaaacaaaatgaataccagtgagatattttttaaatgttacataatggaagaaaatagaagacataaataaatattatctaaatctgagtgtgtttccttcattaaaacaagacaatagaggaaattaaagaaggcaaaatcatataatgtcagataaaatacacagtgtgagaccaggaaaatctggattaaatcaatgttcctccacttatttcagacagatgacattgactacaattgcacattgtcattggaaattggcaattaaaagaaaaggttgtgctcttgtactatagaagggattgagcaaaaaagctgaccaccacttataaataatataaaatgagtacactatatatccaaatatatagtgtagaatttagccaaagcagtaattatagacataggtgaattcattagaaaactagtatattggttagttttcttagctgcaagcaatagaatgcacaacagctagtttaaagtaggaaggggtttattactgaggataggcagagtgcagaattcctgggggagtcaaggaaacaagtgtggatgccacttagccagaagaaatacaactgggataattgcccagctccacgaggagacagctccagcagaggtcatatgcctctgctcaccactgactgttcaatatctttagaaccagaagctgcactctatctggtgaagaatagccatgtacctctgtggctgcttgtcttcaagtcagggtgatcatgtcccttggttgcatacagttgtgtttacatcccttccaagatgcacgcagttgcatacaccttatgaagcttaggccacatgtggaactcaagctgcaagggagccagagatatgtagtctgcatctttccagcctgtgattcataagaagacatgctccaaggagattgaaatagaatggaattagacagtctatgaaatttgccataatcagttccctcctttggatattcgatgtttataaaacattggttccaatccaatatttcaaatatcaataacatcatcaacatattattgaaatttcactttcttttttacaaaggaaaatatattcaccttctccccaaagtctcattagtcactgcacttcatctcttcttgatgtttattttttctctaacttggctataatccaaaatttatcttaatgtgcattatgttattcaccaccaacatactctatataaattataataggaaatagtgagtaaaaaataatgtaattaataaaaaaaaatactagaacaagacaagctagcacagtcccaatttctgtcattgataacaaggctatagttgtgataaaacataattctttctgtgtgtattcaatttttctttagctttcagctagaatatccagctattcagtattctttatcttgggaagtgaccccaaactttaatgctcttgatttgagcttgtagatccgccttcctaacaccagctacagcagtactgggagacacatacattctggatcagccactcaatttgcctgtgatgatcaccaccaatcaccacatccaaataagtaatcaccacatccaaataagtaaatctcccctttttgttgccatttgatgtagaggcacaaagaaccacagacagcttgttggctgcctcagctttcaagttacgggaagtattgtctcctagtggaagcgctcaccatttatgaactaaaatctctaaggcaggatgtccagagttatagttaaagggcaaccaagaattttccagtggattattaggtgtaactccctatcctaccctttgattcctggaaatatatcttctggctctgagaagaataataccatatatttgctgatggttcagttaaaacatcccaacttcactaattatttcccagttggcaccttaactgaaaattcttttgaccattttatctttccacagggtcagttactcctggatgatgggttatgtgttaagaccagagaattccattatggtcatcgtattgcttttgttcatttgcaaataagttctctattcagaagcaataggacatcatgactgagaaaaggccttgaataagggtggcactgacagaagcatgggagacataataggcaaatccataagcaaaataattgttaattcaggggagatcaaactactaccccttctaggacaaaagagttcagtgctcaatttactgctgatcgtagaattgttcacccagagtgtggcgctgtgccagagtttagggttatccttcactgctgatgggaaaaacacttgaagtgattgtatccagttaactttggtaaaaagaagtgtatattttggggcccatacaaatcttcattcttactagtctgactactttttccatgaacgaacactgaaatgactgtagaaagaaactgactgacgttcataggagtgagaggtatatttcagaaataaaggaaagatatgactctgcacaacaacctgaaagccccatatgttattatcacatgactatgagttccactgagccgtaacagccaggttcagagctgctggtattaaaccctaaatgagctgaaactactttgtatgttttgctctgagattcacccagggctgccaattagtttactttgtaagtggatcaaatcaaaacacttaaatgttgtgtatgcttctctaaaatccagagagttccatcaaatgttttgtctctttcttagtgttaggaaaagcaaggtattgcaatttgtcttttactttgaatgtaataagtccaagattgtgggatacccagaaacctcaatgtggtgggaatcccctgaatttttattatatctatttcccacctctaacactcaaatattttaccaaagattctagggaacttactactttctggttttgagattttattgacataatgacatctatatagatgtcctatgggataatgacataaacaaaatccctgtagatgaaactgtgacaaagagagttgatgtagcccaaaggtaagatagtgaaacggtcctgccctccttaccacatgaaagcaaagaggaaatacaaaaggtcaacaggtttataataagatattcatcctcactaataatcagagaaatgcaaagtaaggcaactaagagttaaccacttatcatccttccagttttaaaaatatatctataaaagtttgatagcattaggttttggttaggatatgatgaaatgagactcatacactgcttatcagaatataaattacgattgtcatgttggaagatgatctggtaatactgttaaaatatactatattaaaatgtctgactcaataacatcgcttctgatactttctcagtaatttgtatacatgaatttaaacaaatattaatgtctaagaatgtttacttttgaagatttgcaatgtgtctcaaggaaacacatatatattcacaagtaagtatctggtcacatgtgtgacagattttgactgtcatacctacttcaagaatataaaaaggaggcaaaacactgagaaaggatgtgtgacatgacttctttgacgagaactgtttctgcattctttatttgtacctaatgaggagactttccatgagacctcttcatctcctgagttctgggaacctagagagtgagagctgggatgattactttggtggtggtggtgtcagtcgagcttgctgtgccctgggatgcctgcagcatgggccctacactgtcacggtcagtcatgactgtcagaatcagttaggccgtgctatggagagggagaacagcatggggtcatcatgggtgcgattcagtagaacctttggagggacacggaatcccagaagccagaatctggactcttttccttatgtaattcaggatataatagtttggagttgggggcaatgtcatgaagggctcaagccttctcagagagctccatatggcagcaattagaaagctagagggccagtagcagcaattctatgagtttggactattacttgatatttctgggtctcagttaccatatctttcaggggagcaggaaagatagacagatagatagatagatagatagatagatagatagatagatagatagacagatgatagtgtgtgtgtgtgtgtgtgtgtgtgtgtgtgtgtgtgtgtgtgttttatggtactttatggctagttgtagcaatgcattctggattaacctacaaccttcaaaacactcctgtgttttcatatattacttagttttataaaaagtttaaagcctagtaaattataatattattaaatttataaatttaaaatatgaatgcatgagtataagtacagtattcatagtagcttttctggacaaataatgatgtttaatgcctaacaaaccattaaatcaatgatgataggtattattaatattaacaaaattgaccattaatatttattactttgtaaacatttaatataattattttcacaagtaatatactagatctcttgccttagtacacaattatccattaatattagaattagtacactctgaagaatagccttattaagcagttatcataaaatatgtagctgatttaataatgatttaaaaatacattgtaatagatcttcccttcccaaaatgaaaatccatatatgtaaaagtgtcatctgcatatacttaatacattgcttccctcttctaaaataattggattcatttattttattgcacattaaatattgattaagttagatcttctctaacacttgagatatataaaagaaaactgtattttaacttaaaaaaaatttccagattatcatagtattgacaaatatgtaaaatagaggttgaagcaaggtcccttaacatctgtggttatttcccatttatactttaatttataacttgaactcatgcttgtcttatagcgtgtcaaacaggcatttaaatagagaatctggctgttctttgtgttaatatcccttcggcatcctcttccttgtaaattcaacaaaagagatttctaccattaaagagaaatagctttcagtttgtgaagtacacatcttggaacatagtgaaaagtgtaatgagataaaaatatagccaacaatgggcacttttccattaagttgaacaaatattctagcagaaattccatatagttgtaatgagttttcatttttcctatttgttgcaatttatctaaagatgttggttttttaagacctatttctgagtttctttgtttcttccttgagcctttgaagcctttgagaatacattatagaatagtaaatagaattatcttcttttaaatgatttagcattcccatttctctgagtgcagaaagaactgggcaaattgtgttcatcctacattctacatatttcaagcatttattaaggagttattgagtagtgggtaggatcttttaaaatactagttctcaggaactctatctcatcaactgtaagctgcttctctcgttttattacacataaaatactctttactaactttacctacaacattggtattttcttcctgtttggttatctacatcatgcttatcaaatgaatgtacattgtatctttcttgcccagtattgaggcaaaataaacaagtgaataagtaagacaaagctccaatttgggggagtgaaagtctgataggggactaaatagcattacacatgcaaaaattacagaggaacaagagtcagtatataatcaagtgtcgttttctatgtcaggggaaataacagttttaggttcacagttttaggtggcttccagagaggaaagttactactaaaaaagttattaatatcttaaaatatttatattttcttatctcaatcttgctatcatcttcatatcaaacatttgtaggcattaaccattttcgagttgtttttatgttagttgttttatgtcacataattttcacaaccatgttataaaatggaaaatggaaatgcttctctccctaatttagagatgtagagatggtcagtgattttctcaagatcatttaacaaaggacagatatgcaggtctttttactctctccaggccaattgtttctttttcttccagtgattaaaaaaaatgattttagcagcataacatttgattcaataaaactgaatattaataaccccacacacaccaatatgtttttaaacagattgaataagcttctctgcatgatctgtgatgagtatctaggagtactgcttactaaagtcccttccacctccctgcctgtggtcacaatacaggatcctaatgaatattcacctaaaccctgcttcagttcttccgtatctcatttctttttaggcagctcttcttatgttgggcaacaataatatttaggaattctttcatgtgaagcagaattgcccccagttctatctgaaataaaccagttcactactctttgtcagcctcagtaatcctctgttcccatggaacagctctgcctcttgtcaaacagattactgttaaagtgggtcctcccagttctgggtgtctcatttgctaattcaaatttaatgttttagattttcttttattacattgtgtcccatgaaggtttcatgggccggggcaggctttttaaagatttatatagtgaaagggaaagggagggatccaggagctgtaaagataatgatgttctcagcatgccatgttttattctttgtgagaagctggggaagctgtaaagaaccctgaaattcagaaggaagggctcccactgggtgaagttgactctgagccagacagtgtaggttcttgagcaggattaatataaatttgtcagaaacttcattctggcagagcaatgtgagatgggatattcaagggcaaattagagaacaacggcagtttatcctcataaacctgtgatgacacatagaatacttggtttggagctataaaattggaaatggagatcaccagatgatttgaaaatgttctgtatagggatttgtaagaacttgttgcaaattacatacaggagaattgacagtgaagaatcgggagaaataggaaacatgtgcagcaagacattttgaggggaagatggcgaattctgtttgggaaccattatattggatttaaaataaaaataggaatcacttctgtagttattttagtggaagtcatggttgtggatgttcatctaagggaatgaaagtttagaaaaaaagaggagaccagagaaatagcctggaatttgaataacaggagcaggaaagaatggcattattttatgataactgcattgctttttcttatatttttacgaattataaattacattttatgattaggttctatatgaatttttacagagtaatcactgggacctccaggttgtccaagcaatggggaatggtcaggtcaggtgaacgttaatgtaacccaatgttctagtcaacaggagtgcttggcaagaggttcttgcctttaacctctatcctttaattgcagatatgttagtgttagtttctctctccctctcatttttcacaggagtatgtaacagttaatcaatttttaaattggtacttggtaattctccttttaagttattgatatctaaaacatcttttggttacctttcctaatcttcttgtttaagttttaaaaacaggcctcttaacaggcaaaaattccataatgctaaaaaatagctttgatgaaacaaattaggaaaatcaatcatgccacttagcatcatttttgaagtgtggtaggtagtatttactcagtctcataaacccacctagagttttcacttgaggtgggcttgggtttgtgtcctgaattttcaccatggttcactgcctggaacagcatgggtgataagtaagcagctgcatgcaagcattcactgtgtgaaaggatagaaaatctatgtactggctctttcagggaggcctcattaccgtagcagtttatcccattactaaatatgtgccatgctgatatcctcacattcagctgctgaccagcaacatggccctcagctttcatagggagcatatgatcactccagctggcaggtgacaccgtttggcaatgttccccagcagctcaacaaaagattttcaaatatcaaagcaagggaaaagacctctgtttttacaaggaaaatggctttaacatgagtgcattttgcctccaacagaattattgcttctaacttgctgaattccatgaaggaatgggcacacttagagagtaaaattcattcagggaatttgtaaaacactcatttgaattgataaatgaataaataaataaataattataagaaatttaattttgtattcaagaaagaagtgtgacttgaacatagttaaaggtggaaaagtcttttttttttaaaggttcaatctgaaaacacaagacaatcagaactgaggttaagttataaaaacttaaaatgttgaacaattttattgaagaaaggggcattactgatcttttagtaaaatatcatttcaccatatggaaaaactgtgggacagaatgatcactatctactcagggtcatgtaattcaagggcggcagtttaggaatatcttaaatctcttgactatgagcacagcagtcatcgtcctctgtcttgctataagtaacggtctcagaaacactgagaaatcctcctaccccattcattagtattgaaaaagcaaacaatagatttgtcggaaaacatatatatttcctactagcgttatattctagtactaaatctgagtataattttaaatataatctttttacatgaaagcataagagttgggactacagacctgtcaatcggctgatggctgtcttagcatatgtgaaaaatgcatctaccttgaaaagcttctcatttcctttttcttttatatatatatttttttattattatactttaagttctagggtacatgtgcacaacatgcaggtttgttacatatgtcaaaagagttacagtaacagtttgcatgtggtttaagtcccattactcttatattttgaaggccagtatttgaacagccattttcattcttgggacaaattatctaattaaataaatctgtggccatgctgtcattacaaagtatacaagcctacaaatatattttgctttacacaaaatgaatattttactctactctgaacactaaattgtttgttcacattacaaatattggggaaatttgttaatattgtcaagtgatgtcaggtaatatcattaatataaaaaagtattattaaatttatttgtatctttacaggaagaaaacatttttgtaactcaataagaatattataagtgcttattagagacattctacagaggctaaaaatgaaatattgctatggcttttgtttacagataatatattcttaagtgctaaaatgctttatatttatgaaaagtcatacaagcttatcacagtacaataagcctcataaaggggctaggaattgaactgggtttaggagggtcccattcataggttgcgctcatcaatcatccaactccaccagtgcagagcttctgaagctatctggggcaaagggtcacatttttggttgcttgttttcatttgatttcctactcttccagtgacatggtcttactgtgcatgtctattatgtagctcatgccacatgccactcaaagtagaattcaacagtaacaaaactggcctataccctgttcatcgagttgagtccactgatcatgcacatggatgccacagcaatttcaaattgctgtaaaattgcctcagtatttattctgaattcctgtgcttagctcattgcacaccccaacaaacagttgccttcattcatggatcacattttgactagcactgcactagtgggacttcctgaactacaaaggcaggaaactaaaattgatatttcccaaagttgcttgcagccaggtgcctggatgtgatttagattccaacaattacatgttctggagctgggcttagattctgaactgaggtcagtagggagaggcagagtacccatttcatggggcagtgtgtgccagcagcaacatagcttcctgtagccacagaaaatagctttatgaaaaagctttagagaaacagcagtgcaattctgagggctggaagttgctctggaaacttggcttagggctttttcctccagcctatccaattattggtaaactgcctaatatgtggtaataaattctatctgtgtgatatactgaatttctgttgtctgttacaagtagggctacattgatgaagattaagtgtaaatgttagctggcttatattttttgagtgcttgagtgtttttcaaactttattgtgcatgtggatcttctgggaatgttgttaaaatcagattctgatttgtagcatggagcgggggtctgacaaggtcccagttagtgctgatggtgttggtccacagccccagctctgattagcaaaactttagattagactaagccagtaggaacaacttccactccagtgccctagactgcagatgttaaacttcagcaaaatgatgagaaattattgggctcattttcatgactttccctggattagaagcagtggacctatggtgacatccaaaatgcaaccatcatttgtttttttccatattaggaagaaaagtttaaaaaatgttttttcatatatctgtgtctatatctatagatagatacatatatacatatatacatgtacatatagagagaggagggataaaggagagagtttaaatatgtcaattctaagtaaagcattttcaaacatgatttacaggtgacagttcaggttatgccactacagtgaagacatacaacctacccattttcaaaatgaaagaaatgaacattacagtcctcatggtcccaccgaggtccactttaaggccatgtgtgtatgatgcagcagtaacatgagtcccagtgtgtgagcgctcatctactcctgtggccttggctttgaactctgatatgcttgtgatttctaagaagcatatatgccatcctgagctttcaaataaattccagcctttacttctgcatctgtctgctcaacatttctgcctactggatatatgctggatatatccacatcaagtcaagaaattaatgttaaactcatttataaactgccagaaatttgcttctcattctgtgttctgcatttcagagaactgcattgtcattcgcaagattgccaaagttagaaacatctgaatagtttgaattccaggcctgctaatttctagctgtatgacttggagaaaacatttaaatttcatttccttgtctgtaaaaataaatcatatctcattaaatctgggaaaaaaagaaacattttttaaaaattgtgatgttaaagaaagctttaattattaaaaatatgtttttttaaagtgatgcatttagagaatagttcctggcagtaactattaaaaacaaatacatggatagatagagtggacctctgctttacaaagcagttttgaggattatctgagatattctaggtaaaactcaacacggtacccggttctttgtagacattcaatgatggattgcctgtattcatcataatacctcactcagtttgagtgcttcgtaagcaagaccttgggaaaactctttaacctccttgtactcagtttcttcatcagtactaagttgcaataataataatacctacttcatgaaattgttctgaagtctcagattaataattcaatacattttatatacataaacattagaacagtgtctggcacatagtaagcactaatatatgtttattgtaaatactaatgttatcatcatcttgagaatcttttttttttggcattttttttttattatactttaagttttagggtacatgtgcacattgtgcagattagttacatatgtatacatgcgccatgctggtgcactgcacccactaactcgtcatctagcattaggtatatctcccaatgctatccttcccccctccccccaccccaccacagtccccagagtgtgatattccccttcctgtgtccatgtgatctcgttgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctatcgtgaataatgccgcaataaacatacgtgtgcatgtgtctttatagcagcaagatttatagtcctttgggtatatacccagtaatgggatggctgggtcaaatggtatttccagttctagatccctgaggaatcgccacactgacttccacaatggttgaactagtttacagtcccaccaacagtgtaaaagtgtgcctatttctctacatcctctccagcacctgttggttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttcatgaggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtgatgcctaggttttcttctagagtttttatggttttaggtctaacgtttaagtctttaatccatcaacgttagacctaaaaccataaaaacctgagaatcttcttatcttcaatcttgtattgtaataattcattttcccacctcaccaccagaatctacgtaaaatacaaatatcatcttctttttgtgccacatgtttcaatggcattatcacccacaggaggtcttattctagacttacataacagcctggaatcagaccgaggccttcaatttccattcttattttcactgctcacccaaaactgtctaaattgagaccaaggaaaaatccattttctcccatccaccaataagcgaacaaaaaaaggctatttatctgatatttccattaattaccttcatctcaacatgacaaattctaatacgtaatttgaaattcaccatagtaacctactactttatgtaactttctgtacctcccctagcaaaattacatgcttccaacttaattgctgtaatcttatctttgtacttctgaagcccagtattaagtagagttacttaatacacatttgttgaaaggtttggggtattgaaaaattataaaaagataaactacatatatacacatacacacacacatatatgcacacacatacatgtatattatatatgtaaactatataatcatataatatcatatttttctttatgcaattaatttctcatatttaatacctgtgttgaaaattgttaacatttattagaaaaatatatctggtttgtcttttccataattcctaagttctcctttgggcaagcagcacatttgcaaagtgcatagatagtacaaatcctgtgtctttgagacagtgataccagttgatcacaatatatcagtaactttggcattggctaaaaaagcagttgctctaacaaacagatttatagccagtttaaactgtgagaagtgaggttaagaaaatgggccttgcttttaggaaatccaagtttgaattccagtcaactgcttactctgtgtgaactttgccaagttttctaacctcttgaaggctgctattctatggaatgggactaatagtgatctccagataagaagattattgagagtattaaacaaggtaatgtgagtagttttacattttgggttctaccaaacattcaaattcttaagattcagacgtctaccataagtcacaccgtcatcagtctgcttagaaggacacagaacaggaactggaatttgtcgttattgtagtatcacacattgctcgtctggttgaaattctcctagatgtccatgcagcacagttcagatgcaagatgagttgcatatcaggtaggtccaggagctctcctggcttaaaagctttatttcccacaagagctgcatctcttgaagtgatcctacagtcatagcctccaaggttgccacaagagacaagctctgttctaagagttgccacatgcagagaagcccaaagctgcgactgcttaccaggtgttcacagtgtccccagtgcaggtgcaatttatctcaggagatattttatcataaacaatataatctagtaacaagttgtcattcttcttttatcaggttaccagagtaactaactagaggcagtcaaccaatagtcatagtctctacaaaaagctgagattgttaatcctttctctgcacatacaatatgagcttaataagtatgaaaaagaggataatgtatacatatgaatacgaaaaaaatattaggaagaataagaaatgtatctaaaggaagtgaaatatgtagagttttgtaagagaggaattacagaagatgtcagtcattattttgcatgactttcattgataaactcataagtataaaagtgaaatcttcctcatcaaagagaaagtcttgcttcatggttagcatcaatacatgacactgagtagcaatgggattttggtcctctctgttgtagggaaaacagagctgactcacagagcccttttaccaccactctcagatgatcttcttcccagacccctcaactcagacaaattgactgtgatgctttgagctgtaattgtctcctggaaatgcaattttcatacatatgccagtaggattaagaagattgaacatgagttgttgcattaaaatggaccagcatctctatggttgattaccacagttaaatatagcaactgaatgatgaggcagaagaatcagtgcattttcccattggaccagatggctcttcatggcgagagctccctgtgtcttgtaaatatacactattgattattgagaatgcgcaagagttaaactacaaatcaacacaagtccatccaatttcacgaaaactcttcaaagtatatgtaccaccaattgatgacgtccataccatcatcttcatcttcatatgtaggcattataatttagaatccaccatccctttaattaaagtacaagtagatagataaaagtttgaacataaatactgataaaataaatattaaaggtatatttagtggatatctctacagtttttaggtaaatagatgtatattattaatacttatgttatatttaattaggaaacccacatgtatcctacgtgtcaaagtttgaatagaaaagtggatgtacttgaataagcatacattataattataattgcctgtaaagtttcaagtgatattaaaaagaatgtttaggcacatattaattttttttctattctaaacaatatggtgttaagttattatattagtcaagattctctagagggacagaactaataggccatatatatgagtttattattaactcacacaatcacaagatcccacaataggccatctgcaagctgaggagctaggagagccagtccgagtcccaaaactgaaaaacttggagtctgatgttcgagggtaggaagcatccatcacaggagaaagatgtaggctgagaggttaggccactctagtcttttcatgtttttctgactgctttatattctagactcactggcagctgattagatggtgcccaccgagatgaaaggtgtttctgcctttcccagcccattgactcaaatgttaatctcctttggcaacaccctcacagacacacccagcatcaatactttgcatccttccatccaatcaagttgacactcggtattaaccatcacagatccaccccttgtcaacttgaacccatacacatctccggagatgatacataatcttaaaataaagacaatagtaaggtcataattatgcctaacataatacaactatccttcgtacaaccagaaatgcaccaatccccaaaccaaatactattacataaagttaacaatacttaaatactgatatgaagtcagtaaatcttatgtcacatgataaagggaaaaggaaataaaatgaagacattttcttagtacaagtgtatacataaacaaacatgtttttaacaaaagaaggaggaaatactgatgacaattacggtcttcttttctgcagctggccacgtggtcgtagctggtattgatgactaccttcttctgctactcattctgtattccctttgccttcagcaagcacctcagcagtctgtggtatttttcctggtggagtgacccaaactttcatttctgaagagtctgggccagttgtagtcctgcctggatttggctgttgtagtttcccattgaccttaatcacagggcatggtaatactaagagacgccctaattgatctcctgtattccatgcatacttttccttatcctatccactttccttcctattgaccttaatcacagggcgtgacaatactaagggacgccctaatggatctcctgtattccatgcatacttttccttacctctgttatggagtagtaaactgatttcatcttgttagtctgggtcaatcaccccagccaacactgtaactcccttcttagcctgttgagttaaaggtagaaggagcccaaagtgtccaggtagcaaccttaacttccagtttaatggaatcattgttgtgtctcctggtggcagcattcctgtctctggaactaagacctctaggtcaacagaacgtaatgttgcaggaacaggaagcaaaaattttgctagtggatcactagggatgatggtgagtggagccacttctacatccaacccttgatgcctggacccatgaattctggctatgggagaaagagtaccatatattgcatgctgattcagagcattcacggccgtctggagaactttgccccagccctgcaaactattgttaccttgtttacgttgtaattgtgacttcaaaaggccattcccccataagtgctggcaaattgggcacttagcagtggccatagccaggtcagccttggtgagtggaagtccatgttgctgagcccatccataacctccatctgtgccactatggcccctttgttcgtgggcccactgggcgatgacaggggtggctggggaaagaggctgaatggtgtccacagaacaggtcatcctatccacttgattattaaaatcctcctctgctgaggtcacccattggtgagcactcacatggaatacaaatatcttcacagttgttgaccactcagagagtttcatccatacacctcttccccaaatttctttgtcaccaattttccagtcatgcttcttccaagtccctgaccatccagccaaaccattggctacagccaatgaatcagtatgtaatcacacatcaggccatttctcctcccatgcaaagtgcaccactaggtgcactgctcgaagttctgctcactggtaagatttcccttcactgctgtccttgaggggtgtcctagaaaggggcttagtgctgcagctgtccacgttcaggtggcgcctgcataccgtgcagaaccatctttgaaccagaccctagtcttctcttcctctgtcaactgatcatagggaactccccatgaggccatcggtacaggctggggaagagaaggcagggtggcaggagtggagaccatgggcatttgagccacttcctcatgtagcttacttgtgccttcaggacctgttctagcctgatcacatttataccacgtccatttgatgatggaatgctgctgtgcatgatccactttatggctagatgggtcagaaagcacccagtacatgataggcagttcaggtcacatggagacttgatgacgtataatcaaacgttcaatttccaccaaagcccagtaacaggccaagagctgtctctcaaaaggagagtagttatctgcagaagatggcagggccttgttccaaaatcctagaggcctctgatgtgattcacctatgggggcctgccaaaggctccaaacagcatgcctatctgccactgacacctcaatcaccattggatatggggggtcgtatggcctaagtggcagagcagcttgcacagcagcctggacccattgcagagccttctcctgttctggaccccactcaaaactggcagtatttcaggtcactcggtatatgggccagactaacacaccagttgaggaatgtgttccctccaaaatccaaataagcccactagccattgtgcctctttcttggttgtaggaggagccaaatgcagcaacttatccttcaccttagaaggaatatcttgacaggccccacaccactggacccctagaaattttactgaggtagaaggtccctgaattttagtcggatttatttcccatcctctagcatgcaaatgtctcatcaataagtctagtgtgtttgctacttctagaactagatctcactggatctaatcagcataatgtcatcaatgtaatggaccagtgtgatactttgtggaagtgaaaagcaatcaaggtctttctgaataagatgatgacacaaagctggagagttgatatacccctgaggtaggacagtaaaggtatactgctggccttgccagctgaaggcaaattgcttctgatgggccttatggacaggaatggagaaaaggcacttgccatgtcaatggctgcataccaggtgtcaggagatgtgttaatttgcttaagcaatgaagccacatctggtatagcagctgcaattggagttgccacttgattaatctgacgataatccactgtcattctccaagatccatctgtcttctgcacaggccaaatgggagagtcgaacagggatgtggtaggaatcaccacccctgcgtctttcaggtccttgatggtggcactaatctcctcaatccctccagctatgcgatattgtttttgatttaatatttttctaggtagaggcagctctaatggcttccgtttggcctttcccaccataatagccctcaccctaccagtcagggagccaatgtgggggttctgtccgctgctaagtatgtctatgccaattatgcattctggccctggggaaacgaccacaggatgaatcccgggaaccactggacccactgtaagttggacctgagctaaaactccattagttacctgacctcaatatgcacctactttaactggaggaccacagtgatgttttgggtcccctggaatcaatgtcagctccgagccagtgtccagtaatccccaaattgtctgatcatttccctttcccaatgcacagttacccaggtaaaaggccagaggtttccttggggaaggatggaagaaagattaacagcataaattgtccataatgtagtggtgttcttccccaaggggacccagcctccctttcattcaagaggttctgggtctgtaaactggctcaagcctggaaattgattgaggggccatgattctctgtttttataattcaaatgtcttttgtccatttgacctagaagttttctgcctatataaattaagtaggaatacggtaggcttcctatcaatttcacttctaggaacactatgattaattaaccaatgccagagctctacatgagtcagactattctgattgctgctttgcctctgctgtccattacgatagctatgcccgccttgcctttgatggttgagtgccgccacttggcccttgccacctcaggatccaattattctcattgtatttaagttttgtagttgagtgactttggtttccactgttagatctgacatacagagaagagcaattactggacttttcaaagatgcaggtgctgccctcacaaatctattttgcaaggcattggtcaagggtatgtattctggacctcctagctgggatgagtaggtataaagtgactaatccacttcaccatcccaatctccctaagcctttggatcccttcctctacattaaaccaggggagatcaggcatttccagctcgctcacaatgggccatcttttatccatattttagctaaccaagcaaataaaccattagaacctttttttaactccccaagctggaacattaaatgcagaatccctacttagtgggcccaaatcaataaattcagcctgacccgactctatcttccttccaccattaccccacactcttaatatccattcccatgcctgttctgcagatttctgtttatattaattagagaattcaagcagttctcaagtgtagcacacctcctcatgggtcacactgtcaaccccacctctaggggcctgccaggactttagtctagttgtaggtctagaagcaaacaggggtgttgggggtggctcctgaggagaatcaacattatcttgcctggcaactgcctcaggggaggccatcactgttgcctcaggcagtgcagggtttatctcctcagacaaaggtggaaaggctgatggcagcatgggttggggagtggatgttgtcactactggggatggggaagctttttcttctggcaaaaaagattcatcagagtttacaaactcagtgtccccagcttcatcagggtccccccacacgtctgcattccaagttgcagggtcccattcttttccaatcaatgccctcactttaacagtagacacctggtgaggctgtgcatgcatctttccttgcagatgacccactcacatgataagagcttgtgtctgtttttccacaatttcggctccttctcaacagaagataagtctttcactcaggacaatttatctagcagatttgaggctcagtatctgcttatgaagctaggagttagaatccctgagtttatcattttctttcatcacttttccattgaacttaggagcaatggactagcttcattatgtttcttggttctccatatatggtcaaaggtgttatatatagagtctctaaactccttgccttcacaagcaatgaatcaggagcgtcaaatgcatttattttgcataactccctaaacagttcacaccaaggactatgagtgttctccatactattagaagtagagtccttagcattttggggtctaatattaagcagccaactccagaaatcccaaaaccaatgaaagaattccatccttaatattctgctcctgtagaaccactcctggtaccaaaatctgtcttagtcagggttctctagagggacagaactgataggatagatatatgtataaagtgtagttattaagtattatctcacatgatcacaaggtcccacaataggccatctgcaagctgaggagcaaggagagccagtatgagttccacaactgaagaacttggagtctgatgttcgagggcaggaagcatctagcacgggagaaagatgtaggttgagaggttaggccagtctactcttttcatgtttttctgattgctttatattctagccgcattggcagctgattagatggtgtccactcagattaagggtgggtctgcctttcccagccagtgactcaaatgttaatctcctttggcaacaccctcacagacatgcccaggaccaatactttgcatgcttcaatccaatcaatttgacactcagtattaaccatcacacttacgcaggcatatttacttgattccctaaacagaatggaaattagcatatgttaacagttcttggtttctcattttctaagttaaaacaagtctggaatgagtaaaatgaacagtatggtaaacttagctttagctaattttacttaattctctttattttctatttcctatgaatggtttaacaactcttagaaaacagaagaatatgcaaatgttagctttgagtctaactgcttttccacatcataaatgttgatgtattttcgatgaaactggaatcacacctccaagtagaaataaaaatgcccaagctgattcactcttgagcgtagaagacaaagttcataactgcctgtgagtctgtaatgagaatatcaatgctcttttacagcttttgccagcaagagaagcttccaatgaccttccagtcctgtgtgatcaccaaagagtgccaggtttccgagtggtcagagtggagcccctgctcaaaaacatgccatgacatggtgtcccctgcaggcactcgtgtaaggacacgaaccatcaggcagtttcccattggcagtgaaaaggagtgtccagaatttgaagaaaaagaaccctgtttgtctcaaggagatggagttgtcccctgtgccacgtgagtaaataaagaagggtatagcgtctgccgaaactacatttgctcagctatttgattttgactgaacagtactctaagcaacagtaatttttacacataaaaaatatctttacaaacagtatccttaaaaaaaactttttttacagaataaaagtgtcctgacaaactaaatctccatgaaatttttagcaccaattctatgtttatgtattttctataataggagttgccaaaatttttctgtaaaggggtagatagttaaaacattaagctttgcaggccatacgtgtctctattgcaatgactcaacactgctgttggagctagaggtaatatgtaaacaactgagcgtggctgtgttccaatacaattttatttatataaaaaaaaaggtggcaggttgatatgatcttgggccacagtttgtcaacctccattccacaaggtaaaataaactttccaaatatagattatcgttaactattaaaattcagtactttgtataacaaatcctattcactagagtaaaatactacatcaaaataatgatactttaagttccatgaggacaaagattgtgcttactaatatggggaaaagggttgggttttttgcttgtttgctttttgtttaattgctagcatatatcacaatacctggtacaaaatatgtgttcaataaatattcattgaattcagattaaataagactcattctgaaacatttggcagtatgacagtattaaaatataatttccaagttatcattgtgaattattttggtaatagcaatatttcagcttaatctgtatataggatatttataaagcaacttatattagtttttcaatagagatgtgtgaacttcattgagagcatctctggattattccaaacatttaaagaacatgcatatagctagatctttatgaaccagtggggaggcaaattactactactactattcctataacaacaacaaaaaaaatagtaatgttttataccagatatataattctgcagcactttggactcatccattgtgttctaatgtgaaaagtgactgaaacctccacagagaatttcctccccaatgtctctgcctatcccactgattgttctggttcctccccacataataggctcaaggaagttgccaggatttcctgtattttctctcctatgagtttcctctatttttgttgcaagctaagtgctttattctttttcttctcagatattcaaacacaattaacaaaataaacatatatccttgagtatctttctccatgccctttttggggggaagcatttttcatagaatgtgtaaccaatctaaattattgacaggctattcctctcattggactttttggcgtgacctaaatcagaacttcaatttatttagaacaattattgcagctcccttaacaaatgatctatttggttttgcttccttccccttcaatccccaaaccaggcatcaattattcgtgtttctataattgacctgagtgctgcacttcctttataaattaatgtcaggtgttgtttcttcatgacccagtcccacaattcgttaagcaacaaatccccacttataaaatttaaaaacaggcatgaagttcatctttactgtcacaaaaccttaccactgacagagtgaagcatctagattagacatctgagggccgtttaaccttctgcctgattcagatgaatatttgcacatccatttgcacctatgttggctgttcatctgattactaaggaagcatcttcgttaaagtgacacaaagtgctacatgagtcatgttctttgtgcttttagaacatccattttccttgaggtggagaaatgccatcacttcctgtcttcggtggcatcgagaaatatttccctagctatctccttcaatcacgtgttggactgacaatcccctgacatttttctcacatcataatcttgattggagctttaattgagcatcatagatcttctttcctgtgctccactgatgagaagtgccagctctttgcatcatgcatccgcactcattaggaatgctcagtgctaccaaaaaaaaaaaaaaaatcttattcttgacaataaagagaaaactctgatttattgtcttataatttttaaccctaatatacaagcataatcttgctacactgtgcagttttcatttattttgtaaaaggcaaagcaaatgttttggttcatcatcactcagaatgtttcccattttcatattcaatccacctttgtttataggcaacaagaaagggcaagcctgggttcagcttaattgaacataaaatttcatgttttcagcattgtgctcccttttcataaaatatttataagtaacttccagtaattgcaattgaaacaggatcaccctaaatttaacccctcgttaaatggagcactgcagagcataaaggagttgaaaccaaatatgcaccatagatgtagtctacgatggattctctaggaaaatgattttgagactaattttcgttaaaacaaagtatgacaggagtagagaaacacgtcattcaataattatggttgctgctggtggtgttgtctttatttaggtatggctggagaactacagagtggactgagtgccgtgtggaccctttgctcagtcagcaggacaagaggcgcggcaaccagacggccctctgtggagggggcatccagacccgagaggtgtactgcgtgcaggccaacgaaaacctcctctcacaattaagtacccacaagaacaaagaaggtaacctttgctttcttctcaaggattcacttatgaagactgactgagcatgtgattgctctgaagggatatatacacagccatccaggttatgagggctgcatttctgttcacattgtggttggtattcactatggtaaacagtaatccacattatggttgtgaaaatatttaacacaattccatctttggtcagttctggtttactgacaagtttctttaaaattttgacttaaaggccttcttgactcaacctcttcatcaaagtttagcaggaataatgtaaaaactagacgaaaatttatctgtaaatatacacatatcatgcaaatatatattctaaattccaaaattatataagaagtaaaacctgcttgtcaaaagaaatcttatttggataaaatgtggttaaaaataagttaattatgatattgaataaaattgtcaatttcaatttaaataagtacagaatagaaactacagtaaaagaaaactttaacccaaaggcattttttaaaactcttcagttgtttggcagataaatctttttttaattaaatctgtttcaggaccagatataggaagtgtacaaaagaataagtgaatacaaaatggcccaagctaaaactatatattttagatattaatatgactctaaaattatcataattatttgattaagtgtatattgaattagtacatcttaagttcacacacaaatatgaacatctttaagcagtactgtaagcagtctttatcctccttctgtctgaggaatagcaggacttctttcactgacccattgaacgtatattaacatatacaatttgtttaagagagtgaggatagaaataccaatacagattgcatgtcatggaagtcctcaaagtcatcaggagagcatgtagacaaaccagtaattaaaatgcaatatgccatgccatacaaccaagtttcagaatgagcgtaagggagtagtagaaatagagccctttatggagggagtggcacttgagctcaatgacgacagagacactacttgcagggaagcatggcaagagtgcaagagggagttcatttcaggcaagggaacaatgtgtatgaatgcacaatgctaaagaaaagcaaaaaccaagggtaaatctcaccagtaaagatgggcgtgttgtatttggcaggttgtagagacgggaggggaggaaaggagatgagaggaaaggattggatttcctagaaaataccttggtagaaaaagaacaaggataaaggccctatttgataccaccagatgaaataccaaaaaaggagaatattttgggaaggaatatgagcaaaaaggatcagaaaataaggtaaagaaccaagagaaatgaatgtttttaaaaccaaagaagagatggcttctctgcccctcccaaaaaggactgacaccagtgaccagtaattcatggaagaaaaaaactgaagttttgcagttgcaactttcaaaatttaattgttctgtatccactaactttacacagcatgtcaactcatttaggagtctagcctagggatacattttactactaatgtatcttgaggttataaggaagtaacataaaacatgtaatgttaggacattaatattttcttggccactttaatggctgcattttaacactcttaagtagatttattatagcagtctttccagggtagtataatttcattgctagaggtagatcagattttagttttggaatgtcaattatgtcctgtaggttattgctttccaaagatccttcagaattctgaattgcaactgggtattttttttaaagcattttcttttagagctccccccaaccactgctaaatcactgcagacaccaaaaacagtcacagaaaaagaaggaatattgcaagaatatcattattaagatgtagttgttagactaaagcaaatgccaaagcaaaggtcaatagatatggaggtaactaattcacctaaaattaatatttatcatgtaaatatgtaacatgaataatttaggagtgtgtgtcctttcatatcaaataccaagaatactaacgaacttcttaaagtctttgcaaaaacagttaattctccctaaaaatgtagcatttattccaccaaatttagactatgttagtttctccccgggagcacttaacatttcccaataggaaacatactcagtataccagcatcccaggggtgacatgcgaagtctataaatatgtgtgaatggagaacaattaggctgtgggcttgaagattattcacactcgatgttcagtcatgttcatatgaaagaatgtaaagcttatcttataaaagagagaaatccctcaaaacaactcccccagctaataagaagacactcatttcaagaatccatgactgtgtaaccatgaacaacctgtactatgaacaactcagttttacttaaagaactatctacactgttctctttgcagtttcacaccatgtgttctctagatgacttgttttcacatataaccaaggtgtgaaaaagaccctaacacaaaacaaaatactttaactcaaaaataaagtgtattagtacaaaaaaatactgaaagcaagtgatatgaaatttatgtaaacttcctttattaacttggtgcattgtgttacacaggggaatgatactgactaccttagcataaaggcaggaagcattaataacttttttactcattggtatattctgtactactaagtgacacacaccataagggacagaaaaattcttatcctcggagttaatacatttaatttccaaaataataaaatgtatcttattaaagtactcacaaggtctttagtaaaatattcacaatttagtatgctatttgtgtcagtagaattatatcatcagaacatatcctaagttggagatagcacctgtaaagagtaggaagaaatatatctcatcaatattggagagtgtctatattttattattgcactgctcttagctgtaggtaaccctcccaatcctgacaactattcccccacaatattcaggtgagcagaatttctactatatcatttccgtagaagaaaggcttgacaagttccctactgacagtgtcagtagtaaaacccttgacagtttttgttcagccagctgatatgtgaagaatgtccagcttatgctggcgtgaaatctacccttatcagaatatgacaggaagaggccttgcctgtggggaggttatctgtatgagtcctagaaagttgatgaacatcttgctgatcattggatgcatggaagtaaattgatttttttagagttcaaagtaaaatgaaagtagattttacctacagtaactcaagaaattcttccatttagtacagattgaacatgtttttaagtgagggaagctgaaagtattggttataagacaacattaagtttacagtgacttataggaaactgaagagcatttctctgtagaaaacatattaaaaatccacactaaaatctggatattgtctgtgggattgagggttattaagaaagacagcctagataataagcctgtatgatgacatagaatgagatatagcaacagaaaggattggaggatcaatgggaagataggcggagggatggatgattgaactgtgaatggatagacggaaaggtaagtaaaaaactcgcatttcctcatgctcaacaaagaaataagaaaataaaatagtcacaccattgctaaatggaaagtaaattatttatcactatattttgtctacggtttccacacataaacccactttagaaaaagctttttggaaaaagagaaaagaaaagaaaggctatgcattacggtgctattttcctgttattttagaaagtaaatatcagagtgtgttgaagtcttgtgctgtgtctttcctgttcctcacttttgaaataaaaggtaggtaagaatattttacatgatagttccacctgaagtgtgtataagggaaccatgtgtcgctgatacctaagagagtctccatagattctcagatgcaatccttaagtcgtttaggaaagggagtggtttatttttactttctattttgctaaaaatatatcaaacctgtcccatgaagaaaaatgatttcatgttttttgactttctataacaccattatgtagatgtaaatcacaggaaaacaagatttttaaatttactgacttctaaaactttcactagtatactataattatacaaacaggcatataaagtttggctatgaacactttttgagaataatataagtataaacactccataatttattgtatttctaagcataccactttctgctcatcttaatatggtaaatgaaaaaggactagaacccatgatggctacagcttggaaacacaatgcactgtaaatacagtgggatgtaaaaagcactggaaaataatacggcaggtcctcaaataatgctgttttgtccatgaacattttgtcataacattgacgcgaaaaaaaaaattgattcccagctgaggaatgtggagtctgcatgttcctcccatgtctgcatgggttttctctgggtattttggtttgctcacatgcctcagagatgttcacatcaggtgaattggcatgtctacggagtccctgtctgagtgagtgtgggtgtgtgtgtgagtgcaccctgagatgggatggtgtgttgtccagccacagttcccaccttgctccctaaactgacggaataggctctggccacccacgaccccagactggaataattaggtaatgaatgatcttacttgtttttaatctttcttaagtgtatgtaagcttagatttatttcagtgtttaatattaaaagtgttttggtctttatttagaagtttagtgatgtttttgtgaccagacgtatgcggtgggaacttaactctcttgtttatatcaattagcctatggagaaatgagttctcttttaacgatcattagtcaaggcttccaagaacctattggtgacgttaaatgaggacttactgtatataataattaaaacataggaatccccaaaggaatcagagcctccttgttagccagtcctctgtatatcttgtgggagagaacagcttttaccctatgaaattactctgtgatcactggactacaaaatggaaagtgagatgtcaagaggttcagctgttggggtaaaaggtaataaaaactcatgctgggaattagattaaggtagttagttgtctacccagaggtaatgtaagagtttttattggagaaacagcttactgatgagacttcaggaagtattcaaccaaaaaggcaaagaaacatatcatgaggcagctcagaagtcagataaacatgagtactgtgctttgtacctttgacttggtaggtttttaataaacatttgctgtttgatatatttactgttccctttataaaatggtacaatctcttttaatttgtctgaaaattatctcttgaatatttcaaatatccacccccacttccttaaattctgtttcacaaagaggctatattcgcactcacactgccttttatctctgaatatagaactgtttacacctctgaatttgaatagaggacacatgatctagtccttaaatcaaatgacatgagtcaagattcacacaccttgttttcagtttggacactaatttaagggaacagtttttatttcttttatcttttctaaatatagtatatactttaaaagtcttttaacttctcatcttaaggctattttcaatagaaccccagataggaatcaggaaacctggttttcatttctgcttggcatgtattcttaggcacattacttaactttatttgcctgaagataactatttataaattactcttctgttcccattcaagctatgtgacagactagcttacacgaaaaaacagcctttatataacacctagtcaagattcacacacttggaatatattgtttggggaaaaaggtagaaacattaaacactcttatattttattaactcattatgcatgttaaaaatttaagagtaattatgaagtaaaaatacatatttttgtttaataactactaatatatttgtataattatgtattatacagtaatataatcaattattaataattgcatatatattttttccaatgttgttttaaatgatcttaagggcagaactgaggtcttgactaactaaatgattccccagaacaaaccagcaaggctgagctgctgatgctttctgtggttgcccttgggtggggatggtacaggaaaagtgttacacattttgggaacctaggaggagtgaagccaataaggagcatgacacagaaactttagccagagaaagagaatacaggcaaaaatactgcattacttcattaatctcaaaggataatcaagtaagtagagaaactcaacttacctgtagagggagatgacaattaaataggtcagcctcagtcttaacttaggagaaaaataagactcactaagaattccaattatgggtctgtattcatattggttttagtttcaaacttatgcttacttccatgagtccaaaaactgcaaagctgagaaattaatataagaaattatatcattccactggtactactagaatgcctgaaataaacaaatgcaaaaactctctagataaaaataccttaacctaaggcacaggatttacccctgtaaactgcaccatccaaaattatgaattatgcaaggaaaaataatccatcataaacaggatttaaaatgcctaacaagcagtaagattagactcccaagattgaaaatactgtattagaaatagcagatagaggccaggcatggtgactcttgcctgtaatcccaccactttgtgaggctgaggcgggtggataacttgagtctgggagttcgagaccagactgtgcaacatggtgaaactgtctctaccaaaaaaatataaaaactgccaggcgtgatggcatgcacctgtagtcccatctacatgggaggctgaggtaagaggatctcttgagcccaggaggtggagattgcagttagccaagattgtgccactgcactccagcctcggtggcagagaaagaccctgtctcaaaacaaacaaaaaatcacatagagaccataaaatgctaaaaacttattaaagatttaaaggaaaaactttacaagattaaaaataatgagtcagatttaaaaagaccaattttttaaaatagtagttttagaactgaaaaacacattcactggaaataaataaatgggtagtttggacagattgaactaaagagttattagcaaactgaagacaaaaaaaataaggaaataattgaatatttaacactgagaatagaagttgacaataaaaatgaggataatagtcatgcagagttgacaagaaggttcagaatataagaatcaaaagcaagggagagaaaatgctccagaagtggtaaaaaaaaacacagatatacagaattaggaaaaacaagaattttcaagcaggataataaaatacccacactagggacaatgtagtgaaatttcagctcaacaactacaaagatatgttgaaaggaatagagacaagaaaaacattatttacaaaggaattagcaaattaatagtgaaattttcagcagctacagaaaagcaaaacaacactaattatatattcagagttctgagaggaaagtaactggcaacgtagaattatttacccagctacctaactttcaaaagtatgggcaaaatttagacaaaggtgaaagggattgccttcaataaactctcactgaaagattgccaaaggatatttaagaagaaggaaatcaaaccaagaaagattgattaaagatgagaaaagaatttggtaaacccatggatagtctaattaagcagagatatgtatgaagcaatactaatattataatgtgcatttagttgatgaacaaaaataatataggataggaaacaataaggagagtattgcttaggaaaaaggtggaaatattgaacacccttctattttactaacattatgcatgttaaacatttaagcataattattaagtaataatacatattttggttttaataactattaatatattattgtatacttatgtattattatacactaatataatcaagtattaataattaagtaatgtgcatatatattgttccaatccaatagaaaaaatgaaagaggctggataaaatttaatcaatttaatagaagtactaaataagaaaaaaataccgatttttttacacggactatctaataccaaataaagactagaattggagctttaaaatgtcagagtaaaagattattacagaaaattattttgttctaactataaactgcatctgagagacaaatcagctgtattacaaatgtttacagtgaccaaactaagagtgtggactattgagtccaaacagtcaccaccgctggaaaatatgtaagcagactaacagatcacactgtgtattaatattttctagtcaataatgccaactttatatacaaagcatggtaaaaatcatattttttcaaggaaataacaatattagtttgccatatatgtgtacagtgtgtcaaaactattcaggagagtaagaggttggatcaattaaatggcatttgatagaacattttcttagataataaaaaaaaatgcccagaattttctccaatatttttagagtgaaggatgatctttacaaatgtaaaattcagaagcaatcatgttaccaaattgatattgttcaatgaagcatgaaagcaattgccaacttctaaaattgaaggatagaaacatgtgaaaattcatgagtatttcaaacctatctctctttttatcattctagtttttcccagtttgctaatggaaaagacaaaaatgacattggcaaagaaattattacccagacaggattataaaattcatggtgtatattggtgtctggtacaaagtcatggatgatgtactaataaagtatatgagtcatattaagctaataataaaatattggataataatcttgtgacacaggaatattttaatagactacaaacaatagaatatctctaacaatatgaagaataatgagtacgtataaatacccagttaagtcccaaatgcccactattaaaaagtagtaataacaatgatgataatgataataacaatattaattacatttattaagacattatattaattatttggttgcttcaaagattaaatgtgtatgttgggaacacacacttgcaaggatttaatattaaactcattctatgttcattctcccaagtgttatttttctgaccatcaattacagtagaggaaggattgcaaatttaggtatctcacttattattctttcattcactcaacaaatacttattgaacaattattaggttacaccactgatttagatgttgaagatataattttttatgtttttattttattttaatttgtattttaagttcagggatacaagtgcaggttcatttacataggtaagcttgtgtcatgggggtttgttgtacagattgtttcatcacccagatattaagcctagtatccattagttagttatttttcctgatcctctccctccttccaccctccatcttccaaaacaccccagtgcgtgttgttcccctctatgtgtccatgtgttctcatcatttagcttccacctataagtaagaacatgcagtatttggttttctgttcctgtcttagtttgctaaggataatggtctccagctccatccatgtccctgcaaaggatatgatttcattcttttaatggctgcatagtattttctggtgattttttaaaaaagtatacttgatacttgtcatcaggaagtttatagcctgataaaagccttgaagttatagctttgtgtacttggagtttagactgacccttcacaaggctgacatagggtgacttgtatggatctgtcagtttggggctgtctaatccctgagagtgcactacaccatggtccgtccttaataacgaacctgtacccttattcctcaggtgaattttttttctctaaagcatatatcctcaaaatatagtttaagaatcacctgcatgctttaagaaaatgcagacattcctagatattacccactggggctgtaattctgtaggtcctgaatgaggcaggaatctgttttttataaggattgtcattgattataatcaagagttgattttaccatgcagctaatgagagtcttttgggacccaaagcttatgcgatttagagaaccctaaatgttattttaaaaaaaacagccagatttcaaaattccaaattcaaaatcactcactaacatctctgccagggccttagaagggcccaaaccttaagcttcatgggcttctcaataaatctacccctaattctaacatagatttttgtcctctattacagccagtgagaatgactactttaagatgagaaacagaaacacatgcattgtttcttgaaaagccttgttttccccatagttctagaggtacgactgggaagaatggaatgactagaaaaagtcactatatattttccaaagtgaactggacctttcagtaatgatattagtcttttctacattctttgaccccccagttttagatccctgagctctaaatctttagaaactcacaatactttgctagtatttaagctgggaaattagggaaggatagatactgtttcatcttacttcatacctgtaacctgagatggaaagaagacatagcagttaatacagaccttccattaatgaaagaaagatggtggataaaatgtcatctaacctgacactatcaagggactatagtatccgtgctttttgtaacccttaagcacttatttcatcgagttcgttgtagatgaatgatagcgccaggaggaattttgaaatgagcactcagggatgtgcactggtgaatgagtagcattttttcagaggcacactcctgctatctaaagatgtaaaagaaatggtttgtggctagggctggttgttccctgccttgctgatgattgctcaatagggagtagctactctctccagtgttaacagaggagtgcaaactacattgtagaactcattaatatttattccttctaaaagcaatgggcaataaaaagggaaataaaccaaggagaatagcaatgggaaaagaaaactgtaacaacagattcatcttggaaaggtctcatcatttattgcacacaaaaatatgctcaaaatacaaggatacagctcatattctaagtttgaaatccactaaaattgcctcttattggggaaattaatttaagaaaaaaatgcacattgaatgcaattcaagaactcaaagtagtaatctatattcttgtaattatatgcactggttgtacctcttcacaattttacattttctgtatttgacaaagttacatgtcctcagtgtcggaagctgttttgtatttgtggatgcacaagaactctctctaagctaagcatcacctatccattgaagcaaaaccagtgctatttcagttccttttcttttgcttttcctctattttctgccttgtaatgccttcaaccattgtcccaattatccaaatatctcctcttttaaagaatatttttcaaattacaagaccttaatcatcttcctttatccaaagcctgtatagcccttttctgctatatttcttgatttgccatttgatttcatatgattatattctattcatgccaacttcccaagattttaagcttctgagagagggcatagtgttttatccttccctaaacttctttagtacaacctatcattcttagcagaggtctgggtacatttaccaattgtattctttggaaatatcttttaaaaagacagagaaatgccttcagtcagaggatgttgacttcctggacatttaatttataaggtttcattttgaattaacctatcttttgcactaattcattctatatctcttatgcttttctttcctttttaaaggcttaatgagatgacatatgtaacatatgtaaatcatttcctagcataaggccttgcatttattatatgccaaatgaatattaattgcttttgtttacgtgtttacttttctggttgaattgagaaaagggaattttttaaataacagtttcgctccaaatccttagcatgcaataaaggctaattgtatactagcttgctagttgagaaacataatggagagcaaataatactgtctctttacagtatgtgttaaaatcctgccatgggctaacattatatacaaaattgtccctttcttgggaaaaaaatagaccttttctaaagctttcattgtattattttagaataagaataaatacagttaattttacttctatagttatggtagtcagaataattacagcttcctttcctttgtgattcagaagccttgcgaattttaagtagtagtccattgctgaagaattctgacaaagatgcttgtagtaaccctcggattgttaggttactctaaaacagcactttcaccattgctcaaacttggaatgccacgctgttccatctgccccttatatcccacaggatttctggggatctaaaatgcccagatagggagctttatgcctgggaaaacttagcccttgttgttaaaataataattatagcaactagatacataaaaacatagggtttagaggccagccatggtggctcacacctgtaaccccaggcctttgggaggctgaggcgggcagatcacttgaagccaggagttcaagatcagtctggtcaacatggcgaaaatccatctctactaaaaatacaaaaattagctgggtgtggtggcacatgcctgtagtcccagatactcaggagactgaggcacaagaattgcttgaacctgggaggcagaggttgcaatgagccaagatcacaccactgcactccagcctgggtgacagagcagactctgtctcaaaaaaataaaaagtaaataaaatagagtttagaaaacacttctattgttttatatgtgctcagctagatctgtttagaaagtcttggatcaattaagtttctagttcattaagaatcccagaagtactgtgaaaatacagttatgtttttaactaggaaagctattgacttatttatcaaagccttctacaaatctataacaagggggtaagaaaagtccccaacatattgcggtagatagtgttttcccattaatacataactaacctgataattagagaataattttctcagacatactgaaacagtcagtggcaaaacatggactcaatgccttgtttttgactctaaagtgtaaactcattgcaagcatactcgcttcccctatgcatttgcttcagaataaatgccctgggtataatagctgtctacaagtttatcaaaatcatcagaagtgcatcctattagctgataatgtttctgttgcaaaaataaacaaaaatggcctagaaatctacttcttataaaagaaaattgaagggaaaagtataatgtaagccctttataggagccaacgcaattaagttcattctgtgacatgattctataaggtcaatatggagtcttgttcacagttatttgaaccagcattatgttgaaccatatgatattgctatttttgtaggtcaagatctgtcaattagtggcaatttcatacagtttaactgaaaaggtacctttgatgtattatatcaagtcacctggtatgaattactgtctatcccacacttgacattatcagaatcaaatccagaccggctagctatgaatcgcagtgactctttccatgtgaacaatatgcattcgtgctgtgtgcagtgtcctctagatagggcaatgattgtcttctgtaaaaatatgtagatttccccatagtagatattctttatgggaaaataactcaaattgatggcttcagagtgactggaattcatcaagcattgtttatgcgcagttagaaaagaaattgcttgcattcaatgatgtgattttgaatattatgtcccactttattgtctataaataccgacaataaagggagataaagtaattttaagaataaatggatgaggagtgtggggcaaaggaaaaatgctagtagaaagaggatatcaaaccaataatgaatataacaaggatgatgcacaaaatgtgtatcataagattctgtgaatttcttgaagtaggccacaacttctggctctaagcttgtaatagccaatgtagaaaggaacactgcattaaccgtgaaatttgcagtgcccattaggcaacagaaaccagttgtaaatgagaagcaccatgatttctggttctagagccagaaagaaaattcaccagtgggccttcataaaaaagacactgtaactgtgttgaattacaacttattaacatctttacaataaacaccataatgaattttataaggaagctttttctttaagcaattttcttatacataggccactagtagaaatatcaaagtgtaattcagtaaagggtaataagtggcggttgatatgatatggtacagatttataggtctcactaagctggataacccaaggatagacttcgaaatggatgtactaaatgaatggaggtacagctattccctcaggcaatcctcctctgagctttgatagaggcagagagttccgttatatcccctgacacaagtatctggagtacagctcttctgcttactgcttaggtgcagttcaatgcagagacacaatttccaaccatcattgcggtgaggataggataagcatcctcaaatggaaattgaaaggcttgacaggacataatcttgaataaaatattatcccacttctacaggggatccaggcctaactagatgcagggcaaagaaaaagtttatctaggcactgataaaggaaaatcaaaagtccttaaatctgtttgctggcttgtaacccatagcaaaaatctgaagcagatgtaagaaagacccagtgttaacaataacgccatctctttaaaaaagcaattttgctttctagtatttccttcaagaaaaaaataattaccaagtttctgtctatagatcaaaatgcgttaatttgaagtagtaataataatgatgcagaggatgacgaggatgatagatgattactatatgtgagacactattctaagtgttttacatttatttacttatgagaccctcactataatcctatgaggtaagcactattattatataatatggacgtacaaagagcttaaataattttcttaaggaatatagctagtaaacgtcataatcaggattgtgaatcagtctggctccagaaccagtgatcttaaccactgtgctatacagtatagggttactacttgtaagccagttttatgctagagaaaagctatctcacctctaaacgattattggttttagaaaatgtgcctctcttttaaatagtgattcagtcttatagctaatggtctattaaggttactcatatttaatgacaataaaactgcacttcacatgtatgataatgtttttgttggccgggcgcggtggctcacgcctgtaatcccagcactttgggaggccgaggtgggcggatcacgaggtcaggagatcgagaccatcctggctaacatggtgaaatcccatctctactaaaaaaaaaaaaaaaattagccgggcgtggtggtgggcgcctgtagtcccagctactcgggaggctgaggcggcagaatggcgtgaacccgggaggtggagcttgcagtgagccgagatcgtgccactgcactccagcctgggcgacagagcgaaactctgtctcaaaaaaaaaaaaaaaagtttttgtttcccttttctatgacaggaaggtatccatacatttattcattgaaccaatgtttactgagtgtcttctatgtcttaggcattattctaaatgctgaaaatagagaaatgaacagcacaaacactattcctgctgtcacaaagtttacactttaatggaaggagaaaaattatataccaaaaaataaataagaaaatatcaaagagcaataagcactatgcagagaattaaaacagggttatgtgaaagagaataactgggtaataatgttatttagatcaccaggttttgtttggattccgagatttatatatctagcccaaaattttcccctgagaaacaaatttgcattgatctttctacgtgacgtctctaatcataacactcaggtatgcttgtttttccttcatatgctcttaaaatgacaaaatacatgtttttataacatcagagtacacgtgtctgaatagtaggagctccatgatcttgaattgattgaatagatgtgttcatataaatttcctaaaactacttaggggaaagatattaacagaataggtgacacataatgtgttcagtaaatgtttattgaataagtaaataaactgactcagtaataaacccaagcgtcaataaatacgattacagactaatctgtactcttgcaaaatgcctttctctgatagccagagagatgaaagacctaaaacttgtatatttaggaatatatcacaaagcctaggaagtaaataattaaaataatcagaaagcaaacatattgttaggcttctgcttctatccataagagaataaatggaaccctgccataagaacaactataaaatttaacaaattatataaagcagctgtttttagtcattggccaacaagccagaagaccgtgattacagttgtgaactgagcttcaaaattgcctccatctgctactgggagctctttcttgccacagagggaggtgaagacaagaatagtgtcaggtgtagctgagcaaaggagtcagaaatctaagtgctgggctaggaattggctggaaattttaggacaaggtacagagaaggggaatctacactggagggaaaggacagagtccaagagtctcagtgtggatacaccatgaatccttggccagagtttggctgaatacatgtggggtgataccctggagtctagcagaggtcctgtggtgtgagtttgagaactgaaaggtgatagtataggtagcacagtgctgagtgatgctgagctccagccctgtgagagtgaagaatacttgttgagcacctcaggtctcagaaagactatggtcccagaaggtccacactgtcacagtgcagttcaaacttaaaaagagctagctctaatgcaaataaaatcaaacctgaaaagatcagtaggatctgccaataattaaactgtttgacagaacaaaacttaacaccttataaaggaagatgacataatcgaggttctctacaatatactgttcacaaagttcaaaatataataaaaagttactacacatgaaaaaaggagaagaaaaagacccattattgacggagggaaaaaggcagtcagaagaaacgtatcatgagatggcctagatataagaatcagcagacgaggactttaatcccagcactctgggaggctgaggcaggaggatcacttgagcccaggaatttgagaccagcctgagcaaaataatgagacccgcctccaaaaaaaaaaattaatttgctgggcatggtggctggtgcctgtagtcccaggtattcaggaggctgaggtgggaggatcactgagcctaggaggttgaggcttcagtgagctatgattgcgccactgcactgcagcctgggcagcaagtgagaccctgtccccccaaaaagaaactactaaacatatgttcaaagacataaaggaaaagagtgtcttggggagtgaacatatgcgagtatgaagagaaaaacagacattataaggatgtggaaattcaagaatgtacaaactctgcaataaaaactcactgagtgggcttaataattgaggattgcaaaaggaaggctaagtgatattgaagacaagtcaatagaaattattggatctgagtagaataaagcattgttgatcttgaggacaaatcaatagaaatagatctaaagagagaagattggagggaaaacaaagtaaacacaaggtgggactcatgcctgtaatcccaacactttgggaggccaaggtggggacactgcttgagcccaggagtttgataccagcctgggcaacatagtgagatgccatttctattaaaagtaaaagtgaacagagattcagtgattaatggaatagtgtcatggtgtctaataaatgtattaatgatattccagagaaagaagggaatgatctgacagaaaacatatttgaagaaataatggccaaaaaaaaaatctcaaattcagttaaaaaaacatcaacttaaagatccacaaagctcagcaaaccaccagcagaataaatacaaagaggacaacagcaaaaataccctatactcaaatttctgaaagataaagagaaaattttaaagcagccagaggaaaaaaaaaagatacaatacatacatgtgaataaagataacgaacgagggttgaaatctcagacaatgaagtctgcaagacaatgaaatagtgtttgctgagaaaaactgaacgactacatttggtgaaaatagtcttcaaaagtgagcatgacaaacggacatcttcagagaaatggtaactgagagaagtggttactgagcagttgtgaacatagactatggagatagattacctgagccatgtgatcttggacaggttacttaacttctttagaaaaatggtaataatagaatttttaaaaatttaaaatagtccatatactgcacttagaacaaggccaggcacatactaagctctcaacaaatctgatctaaaatataaggcacggccaatgatttagcaagaagtatgagatgaaattcagcagtagctcaacaggggaaaacatgcccacaattacagcttagaacttggggaatgagtaagtaaatgagaacatcatgttcctcagaataacatcgtaatttcctttcagaaaataaatcaaggatctgtggaacctccaccatctcctcagttccagagagcctcatatagtggaaccaaaacttatggtctggaagagaaatcagcttcccttctcatatttgtgccttcccatatctgtttggtgccagctaatgtaataccagtcctgaccaactgatgtgtcctcccaactaaaatgcagctgagcccattgaaaaccattctcctaactagagaaaggagcaagaaaatcacagccaagaaggtccagccaagaagtgctgggagtcctctgaggacttcatcaagaatggagacagaaataaccccaaaataagaatacaagaattaaatggaatacatatgataccacataccttgttttggatctacctctaaatatcctctcaagagttcttttcacatttcatgccaactggtcccccatcaaggggaaaatagaggcttaaatccctctccacccctacccactgctgtctccctacagtctctcctggctgggtagcaatgctgacattttttcctgcatgttcaatggttctttgtgtccaattaaaaggattttaaaacaggtagttctttatgtaaactttgaatgatgtaaaatattaaaaagcaaggccatttttattattgacacataataattgagtgtatttatgtggtactgtgatgttttgatacatgcatacaatgtataatgatcaaaacagggtatttaggatatttgtcatctcagacatttatcatttctttgtgttgggaacgtttcaaatcttctcttccagctattttgaaatataccatcaattattaactaaagtcacccaactgtgctattgaaaacttgaacttactcctgtgtatttgccccattaaccatcctcttctcatccccctctttccactacccttctctgtctctggtaactatcattctactttctacctccatgagatcaactctttttagctcccaccatatgagtgagaacatgtgttatttgtccttctgtgcctggcttatttcacttaacataatgacctccagtttcttttttcttttcttttcttttctttctttttttcttttttcaagatcttgctctgccacctaggctggagtgtggtggcagggtcacagctcactgtagcctcaacctcctgggtgaagcaatcctcccaactcagtctcctgagtagctgggactacaggcatacactaccatgcctagttaatttttgtactttttgtagagagggggttttgccatgtttcccaggctggtctccaactcctaggctcaagtgatctacccacctcagcctcccaaagtgctgggattacaatgtgagtcactgtgcccagcctagtttcatccatgtagctgcaaatgacataatttcatttctttgtatggatgaatagtataccattgtgtacatgtaccaaatattatttatccattcatttgttgatggacacctaggttaattccaaatcttggctataaatagtgaatagtgctgccataaacatggggatgcaggtatccctttgatacactgattttctttccttcagatagatgctcaatagtaggattgctagattgtatggtagttgtttgtaattttttgagaaaccacaacactgttgtccaaagtcactaatttacattcctaccaacagggaactcttgttcacttttctcttcattcttatcagcatttcttatgttttctcaatttaatagtagccattctaactggatgagatgatctctcattgtgattttgatttgcgttaccctgatgagtagtgatgtcaagcatttttttcatgtatctgttggccatttgtatgtattcttttaagaaatgtctattcagaccctttgcccactttttaatggaattattattattattattgcagttgagttccttgtatattctagacgttagtgccttgttggatgaatagtttgcaaatattttctcccatatcagaggttgtctcttcactctgttgattatttcccttactgtgcagaaacattttattctaatgtcccattagtttttgtttctgttacctgtgcttttgaagtcttaaccataaaatctttgcctagaccaatgtcctgaagcatttgcttgctttcttctagtcattttatagtttcaggtcttatgtttaagttcttaattcattttgtgttgatttttgtgtgtggtgagagataggagtgtagggtttgtttttttttttgtagctattgtaaacgggattgctttcttgatttctttttcaataagtacattttgatgtatagaaaagccatcaatttttgtatattaattttgtatcttgcaactttactgaaattttatttttatcagttctaagagttttattggtggaaacttcaggcttttctatatatacaatcatgccatctgaaaagagggacagtttgacttcctctttcccaatacggataccttttatttttccccttgcctgattggtctggctatttccaatattctatggaataagaatggtgacagtagtcatctttaccttgttccagattttggttttttttttttttttttttttttttttttgagacggagtttcactctgtcactcaggttggagtgcagtggcgtgatctcggctcactgcaagctctgcctcccaggttcacgccattctcctgcctcagcttcccaaatagctgggactacaggcacctgccaccacacctggccaattttttgtatttttagtagagacggggtttcaccatgttagccaggatggtctcgatctcctgacctcgtgatccgcctgcctcggcctccagagtcttgttccagtttttaaggaaaagaaactcattccattttaagtgatatttgaaaatactcagtgacactacagagatatgcagaaggtcagcagagtgaagaactccccatcccacatacgttgctgtgggttctctcattgtttctgtccagaggagaaaacaatctgaaatgtctgagaacagtgaacttaataataatacaacagataaggactaaagttgttgaattgcaaataaagttttaacgaaaagtaattaggtaattagtatgatacttaaaatactatttaaattcacgaaagaataacgataggaaaataacaagattttgagtgactatagtagattagaagtcaacaaaaacataaatgtaaaaagcatagtgctgagattagagttcaaataggtgagataaaatgtaaggactcattaatagtaattaccaaaaaaattaggtgagatagtttaaaatctataaggagaacattttttaagtaaaggaagagcttaaagatttgagggagagaaaaggaaaagaagagaacgagactgggagacgtggagtgagctagggtcaaaatatgcaaaactggtctgacttgtggtgaatcccaagttgaggtaacagggtccatatacagctgtggtttgcaatcttatctcttcactggaattacccaaggagctcttaaatatcctgcagctcaggccttacctgaaaacagttaccctaaatcagatgtcagggtgagaaatccagctatcggtagttttaaaccctctccaggtgattccagttatggcccagggtgagaattattgctctatttggaatgaacatcaagaatgcagaaagcaataaaatttcttcctggagtaagtggaatgatatggttaggcttcgtgtccccacctaaatctcatcttgaactgtaatccccctaatctccatatatgaaggaagaaaccaggtggaggtaattgaatcatgacggcggtttttttctgtgctgttctcgtgacagtgagtgagttctcacgagatttgatggttttataaggggctcttccccctttactctgcacttgtcttttctgctgccttgagggggaagtgtcttgcttcctcttcaccttccaccatgatttttaagtttccagaggcctccacagccatgctgaactgtgagtcaattaaacctcttcctttataaattacccagtctcgggcagtactttatagcagtatgaaaaaggaataatacatgggatattgggccctaaaggattattagcttttacttagtaagttaggactggagggagatacttaaaaacaaacctagagctggtccttagagataaacaggaacaacaactttaggaaactttgttggtcagtcccccccccactctcccacagctggatccactttgcctgagatgcggttttatcagctcacaaaagagttaagatgatcactaatatcaaacatttagaaggatttcctagcaagatttgagattttcaatgacaaatatttttgaatttctggtgtcactcttctaagcagttttatttaaaagaatataggcagtgtaaacttgagaaaagtattccaactcagcttatatgttggcacaagtaaaaacggggacatagactttctgaaatatccaggaatatatcacgagtagagaaaataaaataccattgaaaaaattattctgcatattcttatggtcaaagacaataatagcaagcaattgtttatcagagtgcatgcagctctgttctggaatgtacatggcatctctaataggtatgcatgtagtaccatggtactttggagcaccttgtggttaacttttgctgtactccttcatagctgtgttcctcaaagggtgatctaaacattactgcatcagattcacataaagtacgtgttaaaaatccatatccctagtttatatttctggatttcaacccaaatgtagtgaatcggaatttctgagaatagaacccaggaatctgcttccttaaaacatccctttctgtctctcctacctctctccccaaaccccagtaatggagacatgtactgaaaactgaaaaattactgttctaaggttgagcataggtcatgaaaattatgattatgcatcacagactgggacaccagtgactttgccacattccagaaagctgcataatgatatttttctgtgggcaatgttgacactcagcaacatttgacctttcgtatttgtttttaagaaacacatgcagtagtttaagtaatcccagaagccttactgctatttttttaaggagccttgtcatagatatcatgtgtcttgcgatgagtggggtgaatattagcagccttcatgcttagcctaataaaaggagaacccagaagtactgaaaactccattttttaaatgtcaaacccagcagtttaattcagacctgccaattcagttggcaactgcaggaacaggtggattcgttgtaggtggagtgaagcaaggcaggaatggaggtacaaggaggaggaattggggtgattgctgtcacttgcaattttgtatgtagcaaaggactctgatcaactaaaaagcagtgtgagaaaatagacttatcatggtctaggggttctagaacaagaggaaacgatgtgatgacaaccaagagccagatattgcttgcttagaccaaaatctttggagccatacttgattcttctctctctaacccccacaaccatttccttagaaaattttcctgactctgctttcaatatttatctgaccccttcacttccactatcatcttccagtccaagccactgtttcttgcctgtattattggaatagtctcctaacaggtaaccttgtgttccttgccctgcacaatcaattcttcgcatgacaacagagcatcattttaaatctgaagtctggctgtcactcttgtgtttaagcgacagtctgtggatttttttgtgataaataattatatttggagttgctcagcaaatgtgtggagctgtttgcagaacttttttgattagatactcaaattcttcttcagtacttactttgaaacaaggattatgatttcacaaattctaaatgctacagttttgttattatattttggataacatacatattccagactgcttattttaatttacagtatcagttaatgctgtttttgttgttagggacatcgtgagaatttgagtcaataacggtatgctggaagagttcagtatgagttctatgtacactattctacaacatgtcctatttagaaaaaatggaaagacagactctccatatttgcagtgttgcaacagatggtacatccccatagtagaagagtcatatccccaacaagctgttgatacaatttgtgaaatttaaattctaacaatgatgaaattgttagaaaaatgtatattttgaacaatcccactatttttaagtgttcttatcttacacgaaacaaggtcagtgagagaaattatctgacatatgtttatttctataaataatttaaaaatagcacagttgtattttatttgagtcatgacatgaggagtgattttctaggaaatatggcatcgtgggcatagacatatggacctttctctataattccctaaaatggccagtgaatatacaaatagggaaaaccctatacctgtccttgaaatcaggagacagcccatctagactctagaccctgggaggagtttctgtctgctaagatggtatttatataagactggaggaacagacaccaaggcaaagcagcaacccctgtgagactgagtaatatttgtaagagaattaggaagggaccctggcaaggctcactggcatcctagcttggaagagtgaagactgaaggcaagggcagtcaggacccatcgctcaaatatcctcctaacttgctgacacgcagcattcaggcagcagaccagctgcaaggtgggctcagtcctttatgtagaggagaaggctttcttggagatctgtccctatctgttacaacactgttagtgtccacgtgataactccctcctcaccagcagtgttttcgacacccataattgggaagttaaaactagaatataaagctgaggagaaaagaaaaaggaatgctcttcaggtttcagtctggacctaaaacgtccttttttcaaatatttggaaagaaccttatctaaatttatataatgtatacagtgtatctttcactcgattgtaaaccaaaatagaccaagcctagaccttctctaactccaaaagaataaacagaaaagtcaacaggtttatgtaaaaatgttctaattccaaagacagtgaccgctccaatgaacagcttagctctgaaatagtctagtgtaagaaaaaacactttttaaaaatatgatttgtgacctcaccacaattcaagagattatccaagcagcaagcatgaacacgtgcaaagaggatgcgatctatgatcaagcaggatggccagggatgaaaataatggctatcaattcatgaactgcacagagtagttgattggatactgaagatattgattatgatatagaaaatgaactcaagtacaattcatgtatgcttcctaaattatataatgtcttggtttaaaagaacaaaagactaatcaaaaaccataactcagtggctgggcatcgtggctcatgcctcttgtcccagcactttggaaggctgaggagggcggatcacctgaggtcaagagtttgaaaccagcctggccaacatggtgaaaccctgtctctactaaaaaaatacaaaaatcagccagacatggtggtgtgtacctgtaatcccagctactcaggaggatgaggcaggagaatctcttgaacccaagaggcggaggttgcagtgagctgagatcacgccactgcactccaacctgggaaacagagggacactccgtctcaaaaataaaaaataaaataaacttaataatgagttatcgtagctaaaaaggactggcagggagctttgaagcgcattaaataccaaaagataattctcaagcattattttaaatatggctcaaaattgattgaggaataaatgtatgagctttgaaaacaatgtgttataaattttttttaagtatgatggggtttatgtcaccattatattaaccaggctgagaaagacaagaggaaataaacttctatgattcaagtttagtacaggaacatctccaaaaagctttgagcaatcactggtaacattgaatttgattaattttcaggataaaagctttctttatttgcttgacgccaattactgcgtgaatttttagtgactctagctaaggtctaagtaagctttgagcaaatcatccatagaaccttcttgaaattaaaactgctttggtaaaatatacctgaaattactaccacacacttgtagtaactcagaaggacaaaacagtaaaaacaaaacatcaaaaacgcaccactagtgccaatggcaccaaaacaccctttggcatgtaatgcctaacataatggcagggagttgcaaagagtaagcacttaatatttattttaacttactgaaaaaaatttaaaaaaaataaaaagggaacagaaagccatttgtaactaattttatttgtcggtctttggaatctcttgttatcaagcatccttatatttagtaataaagttttgtcagttcctatacagaaatgaaggtttaaatccaagagaatttccttgtatttgtgaattagcaatcaaataagttcgtttaaggaaataaaatgctaatttaagaaaaaggtagatttacagggatgacaatggaaaaaaaaatacgtatcaggaggttttgagtgcctgaaatgctcagctgttttgctaaatggatgaatgaattattaaatttattgcatttttctcaacctttgagcaccagtatatcttttgaatgaatacagaaaatgtatatcattattcaaattagtctgaagtagactgtgtgagatctctgattcaaaatagtctgagaattcaaagatatatttttatgatttagaaaaattttaaaaatgtacatttgtacatttgagagccttagaacaaaaatgatttagctttgaaagattagatatttaaaatggatgagaatataaattgctttttaagtaaaatactggggattcattttcagatgaatatctctaccagattctgcactggtccacataaaataaccaaatagtctgttttgaaaacttatatcattctagtcaaactattccctgtactagacttccaggagttgggtgggaactgggggaagaacatgtcttctactaactgccatattaaagtgtagcatagtgggtaagtcagctttgaactgttgctaattaactgtgtgaccttgggaaaattacttaatctttttgagcatcagtttcttatttattttattttattttttgacacagagttgctctgttgcccaagctggaatgcagtgctgtgacctccctcactgcaacctctgcctcccaggttcaagcaattcttgtgcctcagcctcccaagtgtgccaccatgcccggctaatttttgtatttttagtagagttggggttttgccatttggccaggctggccttgaactcctagcctcaagtaatccacccgccttggcctcacaagttgttgggattacaggtctgagccaacacacctggcctcagtttcttaattcttaaatgtggattacagttgtgcctacttcatgagatttctgtgaggactaaaataatttctttagtaaatgccatgtaagtgcttactgttatcagtataagtgcagaatatcccattttaataataatttaattagacaggtagttattggtatctagcagaaggaaaatttagtttccatttctcactgcggcacagaagtcagaataattttcattgatagaccactaggtttgatatgtgattatcttgatagcctcaatcatattatgttactacatgacattatattaacaaccctcattaaatgtatttttaattatgacctatattaaataaatatgcatatgtgtgtgcctgtgtatttagctagacatatattattgaaaccctgtcatgtacccttccaagattacatggagtagtaattagaggtacatacacactgaagactatggagccagactgcttggatgtgaatctgaaatctatactttctcagctatgtaattgagggcaacttcatactcggttgccctatatggggataactggaatacctacctcatgggttttataagaattaaataacttagtatctgttaagtacttggaacagtgtgacatttcctggcatgtagcaaacaccatcatccatttgttattaaataaattacatctccattcacaagtggaaaccctcttctaaacttttgtttgtaattccttgtttttctttatatatttgacttgtcaatgcttttcagccacaaaccaccaggaacacacccgtagttgagcaagttgggtttgttactcagtggagctggggagaatgcaaccatgggcatctcagtaaggatatcagaaatgacattataaataatgtgttagattatttttaaggagtttcaataaatgggctttgcatgggttgcatgctataagggagcaagaataattctacgactgggtatctaaataaaccttatctggaaggcgaaaaaactggaaggagactaaagctataattggtaaagaagcagaactcatttatattagctggtagaaggaaagatttgatatttcagggctctcacagtgaccttgtttttgcttagacaaattttatagtcttattttttgtctcactccatcatagtcacagaatatgtgatgtgctgccctatgaagttgttcatgttaaacaggaaccatgtcataggtgtgagtgccaggccagcccctaaaagcatcaggcctagctgaaagtgtcaggccaggtccctgatattcatgactgctttcctctttctcagacttatgcatttatcccaaaaccttatgatactgcattttcaaaaaaataaaataaagctttatatgaatggtatcattaaaaaatatattcttcggcttgctttttcactttctgatgacatgtatgtggattttatattggtgattatgctctagcttatttccacctctgtatagttttgacataacgttattcaatacctcttctcttttaattggacatgagttgtttctagatacttgctattataaacaatactattatacaataaccattcttataaatatctctcagataaatgtctgatagttttccatgggatatacctagaagtatgcacatcttttcaatcatactagaatattccaaattattttacattttgatcaaaacaacttaaattcccaccagcagtgtctgttttagctgctttatgtcttctccagcacttagtgttatcaaactttaaaatgttttgacaaactagtggatgtgccattttagtttttagtttcctattcagttgataatgtgaccgttagtggttaattttagccttttgcaatcaattcttccatctttttttattctctttcttctactttcttcacttctcctttcttgcctttcttaaaatttattgcaacagttttgttattacactacttcccatgtttcacaagtcatacatccttatcctatacatatatggatttatatatatatatatggatttatatatatgtatatgtatggattaccttaaaattttaaggtggagttgcaaatgaatatagtttgtaattaatgtatttaccttcctaagaatattttactcttataaccctccaccaacttacatagtcttctattttaggtcttctatcttgcaattatttataactgtgtgtattagttttctactgcctccataacaaatttccactaacttcacaccttatcatacagttctgtaagtcagaggtctggcatgcatctctccaagctaaaatcaaggagctgacagggttccatttctttctggaggctctaggggaggagctgtgtgcttgctcattcagagtgttggcagaattcagttccttcgagttcaaagactgagatcttcatctccttcctgattgtgagctggagactgttcccagcttctaggaatcacccacatcccttggctcctggcctctttccccaaagccagcaatggcatatcaagtaccttttatgcttggatatctctccactcctttttcttccatctcatctttctaacgcactcgagaagcttctctccttttaagtaataatgtaagtagattgggtccacctggatattctaggttactttccccatctcaagttttaaacctttaatcacatctgtggagtcccttttgctaagtaagataacacattcacaggttccaaggattaaggcatagaacttttgagtgaccattctgcctttcacacttttccaattattattttacaatcaatgcttaattttactcctatttgatattttctctgaccactattctctctgaaattttagaccctagttttgtgatcactttcttttttatgagacataagttctttagaaatttctttaattatggtctagtatagtaatactttcattttctgtctgaaaatggtttcctttgcccctaataattaaagatccctggatatgcaattctaggtttcccagtagcccattaaaacagaaagttctgtgacttgggattagtagttcaccaggagagaggccagatttaggactgtggtactatagtagatcggatttatgttgtagattttggggatcctctgaggatttttcttattatcccagttgtataataaaaggctttatttttaaaataagacacagacttttactttcaaaaagataaaggagatgtactttttcctgtagttgccactaaattaaaaaatattccctggaagttgtatagaaaacaaaccataaaaagactttgaaagttggagagaagaaggcagataagctagatatgtcaaggcccaaaatgacaaggtgattagttcccttggttttctttttgcctcccacatctcaaggttggagctaaagaagccaacaacacggaaacatcagtggacacagatttgtaaaaaccctaacaaattcctgctctttctagccaaaggacaaataaaagaccaacttagcaagacacaaaattttagacaataaccactctacccagccaaaaacacacaaaaataacatggccataccctcacccatatcagcaaagtcgtgatgggaacctcagttttcacccttgtgatactgtaatgagtcgctcaacactcccactaggtggtgttagagaaggccaagtagggaactgacacttccatcactgctagttgctatctggtaaagcactccccacccccacaatgttagtgaagacaattaggcaaccagtacacacagccacataaaagtaactagaagttcctctttgttatcaatggaggttaaataagaaacctggacttctgccttcaccttgcagtaacaatgtggcatacatacacccttttgccattctggagcagggtcataaaaagccagttagaaagaagaaaaggattttaaaagatctagagtcttgtgacatgaggcaaaaatgtctgggtttcaatcaaagtcactccttatgccaagaaccagggagttaccagattcaacgaaaaaaataaataaatagcagccaacactgagatgatgaagatgttagaattatccaacaagatataaggaagccatgatgaaaatctttcaacagttatgagcatgtttgaaacaaatagaaatcttcagcaaattaattgaagatgtaaaaaagaaccaagtagaaactgcagatctgaaaaatgcaataacagatataaaaactctgtatacgggtctaacagcataatggaggggagagaggaaagaatcaaagaactaaaatacagaataatcaaaattacctaatccgaacaacacagaaaaaaatatgagggaagaaaactaaaagtatttcagagacctgtgggactgtaacaaaagatctaacattcatgtcattggaattccagaagaagaggagaaagagggcagagcttaaaagaaaaaaaatgtattcagagaaataatggctgaacacttctcatatgttgtaagaagcataaacctacagattcaagaagctggatgaattccaaataagttaaacctgaagaaatacatgccaagacatattataataaaaatctgaaaacgaaagataaaagtatttgaaagcatccagagaaaattgataaccttactacaagaaaaagaaatttgagtgacagtgaaccagaaaccatataggtcagaataaagtactaccatatttttcaagtgctagaggaaaagaactgtcaacttgcaattcaatactcagagaaaatatctttcaagaatgaaggaaaaataatgacattcttaatgaaggaaaactaagagaagttgttaccagtagacttaccctaaaagaatagctaaagaaagttcactaaataaaaacgaaagattaaaggaagaaaccttggaatatcaggaaaggagaaagagcgggtaaacaaagtatagctaaatacaataggcttttcttcacttgagttttctaaattatatttgacagttgaaacaaaaattataacactgctacctgatatgattctaaaaatacgtagacgatatatttaaaacaatttattacaaatgagggagggtaagatttctatactttagttgaactagcaaaatgaaaatatcagtaggctgtgataagatatatatatatagtatatcttgtatatatatgtacatatatacacatatacacatacacacccatatatatgacatatatatgtaatgtaatatctacagcaaacactaaaagagctatagaaggacatgcactcaaaaacactgtagataaatcaaaatggtattctaaaatgtgttaactcacaggaagacagggaaaatgaaacagaaatgaataaataaaaataaatagaagacttagtccataacatataaataactacattaaatgtaaatagtctaagtatactaattaaaacacagattggtagagcagatttaagaagcaggacccaactattcacattctacaagaaactcacttcaaatataatgttatatgcaggtttaaagtaaaataatgagaaactgtgtgtcatgaaaatgttattcaatggaagcaggagtggctatgataacatcgaataaattaggcatcaaagcaaagaaaattaccagagacagagaaagatattatataattatataatgacaaaagagtcaatccaccaagaaggcaaaggaattctatgtgtttgtgccaaacaacagactgcaaaatatatgaacaaaaactgatagaactgaaaggagaaatagacaaaactgtaattgacaaatagataattgtagttggaaatgacaataccttactcccaacacttcatagaataattaggacgaaaatcagcaaaaatacggaagaactcagtaccatcaaccaataaaatctaaaagggattattataattactccatccaacaacagcagaattcaccttctttcaagtgaaacatataccaaaatagaccatgtcatcatccataaaacatagttcaacaaatgtaaaataatttatagagtgttctctgagcacaatggaatcaaattagaattcaatcaaaaaagataggagtaaaatctccaaacacttggaaaacaacacacttctaaacaatcaatgtgtgaaagaggaattctcaaggaaaatcaaaatactggatgaaaagaaaatatatcaaaatctgtgaggcatagctaaagcagtgctgagatagacatttgtaacaccaaatgcttacattggaaaagaggataagacacaaatcaataatcaaagctcccatctagagaaccaagaaaaatgggagtgaaatgagttgaaagcaagaaggaaagaagtaaataataaacataagaacagaaatcaatgaaattgaaaataaaaaatagagaaaaaccaataaaacaaacagctggttcattcaatagatcattaaacctctagcaagggtgataaaagaaaaaagaaaaaacacaaatcaccaacaccaggaatgaaatagggaaatgtcactacacactttacagacatcaaaaggatagccatggaatacctcagacaacctgatacacataaatttgacaacttagactacatgggaagaataaaaaaatcaaaataaattgcaacctaccacaactcatctaatatgaaatagagcatttctacacagaaaaaaagaggcaacaaaggcactgacagttcaccaaaaagaaaaatacagaccaaaatgcctcatacatagacaaaaatccctaacagatattagcaagtagaattcagcaatatataaaaataattaaaatataagaccaaatgcagtttattcaaggatgcaagcctactccaatattaaaaagttagtcaatgtaattcaccaatttaacagactaaaaacataatcaatacagcaaaagctatttaacaaaatttagcatccattcataataaactctcagaaaaaaataggaatagagaagaacatcctcatcttaataacacctaggaaaacctatagctaacattatacttaatggtaaaagactgaatgcttgttccctaacactggaacaaatggtctactggcaatccttggtgttccttggcttgtagctgcatcattccaaactctgtcttcgttaagcatggtacttctctgtatgccttcacatggccttctcataaggacaccacccattggatttagggctcaccttaatccggtaagacctcatcaactaattacgtttgcaaaggccttatttctgaataaggatatattctgagattctggtagacattaagtttgcaggaacactatacaaccaaagtacattgattgtaataatatcaatattctggctgtaatattgtactatgtttatacaatcttgcctatgggagaaactggataaagtatatgtagaagctgtcaaattacaatttcatatcaatctacaattacctcaaaacatttaatttaaaaattatagatataatttataagatatataaactatctttagaggttatatagtatgtgtatcttcagaatacttcattggccatcttgatagaaaaagaagtgttgagattatttttatttttttccatttgtagagcttaaacattcaaaacacaagaatatttcggaaccataaacattcaaaacaagaatatttcagaaccacagaaatgcatcagcctcattttttaaatttgttttggaaacttcagaaagtttagacattcttttgtgaccttgtgaagcatggaatatacattcatttgaatcctctttaaattaagaacaataaaatttctccattattctgagaaatcaaaaagaagtcttcttaaagtttaatatgtatttctctggagtttgtattggctgaagaaccatttcttaaatagtaaattatacaagagtaagaactgggccattctagaaaatagaaatctcagtataaactgaaatccagtaatttttcctaggtctgtcctttacttcattcactgaattacactgattccaaataactcttgggcaattgcagaaatgtaatcgtcttacagtttttgaggaactcaggtaagatctgtgatttacaattaatatgtactctatttcaagaaaacctataatgaaaatcaccaaaggaatagaattatacatagcaggtattcttccctgtttccttgattaatgaaaaaaagcttatgtatacatagggacaactgttaagtagaaatcattctttgacaattatgtcagtgttgatttggtgcgcttagcagctgagcaaacctcaagaaggctttgtttcagcaatactgaagcagctatgttgtctggggtatataccctgggatttgtctcgtgccaggaaaatttaggacacagacacaaatgcagagttttggagtggagattcaataggcagaagagaagagaaagagaaacatctccctctctagagagagagaagggtgtctgagcagaaaagacccgagggagggggatgtgctggattttatagtcaggtttgaggaggcggtgtctgatttacataggactcacagattggtttgattaggtatgatgtttacatagcttatgggaaggctggctgctcagccctaatcttattatgcaaatgaactctcctgttgatcggtaccatcttgtctgttccttactgtacacgtatgtggctcataaagacaagggaaggtggggttgccattttaaacatgattggcacaactaccagcttctatgactgcagctcaattttacaggctgttctttgttaaaaaggaaaatgatgtggggctgcttttcattaaaatggaaaccttaccaaggacttctgtaccctcactatctgcctaagtaattttttcttaactcctgtatcaatacttccttgagcctttatttatcacatttccctttttgtagctcaaaattttgtggctgattattctatttaatttattgaaaatacaccaaaagctaaaataaaacttattttttaaaaaacggccacgaagtaaaagcacaatgttttaacctgtttcctttttttacttgtttaaattaggggttgggagtgtgtgtgtattttttttctaacttttaagttcagggatatatgtacaggtttgttacatgggtaaatggggagtcatgggggttagtgtatagatttcatcacccaggtaatgagcatagtactcaataggtcgtttttcaatcctcaatcctcaccctcttcccaccttacaccctcaggtaggccctgatgtctgtttttccctactttgtgttcatgtttatcagcttccacttgtaagtgagaacatgcagtatttggttttctgttcctgcagtaatttgaataaggataatggcctccaggtccatccatgttgctgcaaaggacatgatttctttctttttttgtaccacattttctttatccagttcactgttgatgggcatctaggttgattccatgtttttgctgttttgaatagttctgtgatgaacatatgcatgcatatgtctttatggtaaactgatgtattttcctttgggtatatacccagtagtaggatggctgggtcaaatggtagttgttttaagttctttgagaaatctccagaatgctttccacagtggctgaactaatttacattcccactggcagtgtataagtgttctcttttcttagaaaccttgccagcttctgttattttttgactttttaatagtagccattctgactggtgtgagatggttatctcatggttttgatttgattgtctctgatgaatagtgatgttgagcaatttttcatatgtttgttggccatgtgtatgtcttcttttgaaaaatgtctattcatgtattatagtttgcccattctttaatggggttgtttattttttgttaatttgtttaagttccttatagattcaggatattagacctttgtcagatgcatactttgcaatattttctctcactttgtaagttatctgtttactcagtggatagtttcttttgctgtgcagaagtagctctttagtttaattaggtctcatttgtcaatttttctttttgtggcaaatgattttggggtcttcgtcatgaaatctttgctggggcctatgtccagaatggtatttcctaggttttcttctagagttttatagtattagattttacatttaagtctttactccatcttgagttgattttcatatatggtgaaaggaaggggtagagtttcaattttcagcatatgactagccagttatcctaggataacttattgaatcaggagtcctttccgtattggtttttgttgacctttttgaagatcagatggctataagtgtgtgactttgtttctggaatcactaatctgttccattgatttatgtgtctgtttttgaatcagtaccgtgctgttttggttactacagccttgtagtacagtttgaagtggggagtgtgatgcctctggctttgttctttttgcttagggttgctttggctattcaggctacttttcagttccatattaatttcagaagagttattctaattctgtgaaaaatgtcattggtggtttgataggaatagaactggatctgtaaattgttttgggcagaatggccacttcaataatattacttcttcctatctgaattagttcattttcacattgatataaagaactacttgggactgggtaatttttaaagaaatgaggtttaatagactcacagttccacatcgctgggaaggcctcaagaaacttacaatcatggcagaaggcaaaggagaagcaagcaccttcttcacaagatggcaggaaagagagagcaaagggaaaagtgtcacttcgaaaccaccagatattgtgagaactcactatcatgagaatagcatgggggaagtgcccccatgatccactcgcctcctgccaggtccctcccttgacatgtgggattacaatttgagatgagatttgggtggggacacagaaaaaaaccatgtcactattcaagagcatagaatgtttttccatttatttgtgtcacttctggtttctttgagcagtgttttgtaactctcattctagagatctttcactccctggttagctgtgttcctaggtattttattctcttggtggctattgtgaatgggattgcattcctgatttggctttcatcttggatgttattggtgtatggatattctgctgaatttcatacattgattttgtatcctgatagtttgctgaagtgtcttatcaggtctgggagcctttgggcagagattacggggttttctaggtataaaagcatatcatctgtgaagagagatagttttaccttatctcttcctatttggatgccttttatttctttctcttgcctgatttcactggctagaacttccagtactattttgaataggagtggtgagagtgggcattcatttgtttgttttaagttctggggtacatgtgtaggatgtgcaggttcattacataggcaaatgtgtgccatggtgatttgctgcacctgtcaacccatcacctaggtatcaagcccaacatatattagatatttttcctgatgctccccccaaccacactcccccaacaggccctagtgtatgttgttcccctccctgtgtcctcattgttcagcttctacttataagtgaaaacatgaagtaattggttttcttttcctgtgttagtttgctgagaataatggcttccagctccatccatgtcccttcaaagacatgatctcattccttttaatggctacatagtattccataatgtatacgtatgagattttctttatccagtctatcattgatgggcatttgggttgattccatgtctttgctattgtgaatagtgctgcaatgaacatgagcatgcatatatctttataataggatgatttatattcatctgggtatatacccagtaaagggattgttgggtcaaatggtatttctagttctaaatctctgaggaatcaccacactgtcttccacaatggctgaactaatttacttttcacaaacagtgaaatgtaatttgtgtaatttacattacacaaacagtgtaaaagcattcctatttctccacaaccttgccagcatgtattgtttcttgactttttagtaatagccattctgactgacatgagatgatatctcattgtggttttaatttgcgtttctctaatgatcagtgatgttaaacttttgttatgtttgttggctgcatgagtgtcttcttttgagaagtgtcttttcatgccctttcccactttttaatggggttttttttcttttaaatttaagttccttgtagattctggatattagacctttgtcagatggatagattgcaaaacttttctcctattgtgtaggttgtctgttcactcaagtgggtattcttgtcttgttccagttctcaaggtgaatacttacagcttttgtccatttggtataatattggttgtgtgtttgtcatagatggcttttttttttaggtattttcctctgacacatagtttgttgatggtttttaacatgaagtgatgctgagtcaaaagacttttctgcgtctattgagataatcatgtgatttttgtttttagttgtttatatgatgaatcatatttatttgtgtatattgaaccaaccttttgtcccaggaataaagccaacttgattgtggtggttcagctttctgatgtgttactggatttggttagcttgtaatttttgaggatttttgcatctatgttcatcagggatattggcctaaagttttcttttttgttgttgtgtctctgccaggttttggtatcggaatgatgctagcctcatagaatgagttaaggagggtttctttcttaattttttggaatagttttagtaggatcagtactagctcttctttatatatatatggtagaattcaactgtgagtctgtctactccaagcccttttgtggttggtaagggttttttattactgtttcaactttagaacttgttatgtgtctgttcagggtttcagttttttcctggttcaatttttggaggttgtatatttttaggaatttatccatttcttataagttttctaggttgtgtgcatagaggtatcataatagtctctgagggtattttgtatttctgtggggtcactggttatgtcacctttgtcatttcttactgtgtttaataggatcttctctcttttttctttattagtctagctagcaatctatcaatcttatttattctgtcaagccagcttttagtttggtcattgttttgcttgtgggtttttattacactgttttggaaagcacagctttgtttttggttatttcttgtctactgctggctttggtgtcactttcctcttgtttttctagttcctctaagtgtgatttcatgttgttaatttgagaattttctaattttttgatgtgagcatttagtattgtaaactttcttaacactgctttagctgtgtcccagaaagtctggtatgttgtatgtttgttttcattaatttcaaagaatttctttatttgtgcctaaatctcattgattacccaaaagtcattcagaagaaggttgctttaatttccatgtaattgtatgcttttgagagatcatcttagtattaacttctgtatttattgtgctgtggtctgagagggtggttgatatgatttggttttttatttttatttttttgaatttgttaagaattgctttatgttcaagcatatggtcaattttagagtatgtgctgtgcacagatgagaagaatgtatattctgttgttgttagatggaatgttctgtggaggtctgctagtttcatttgatcaagcgtgaagtttaggtcccagatatctgttagttttctccatccttttactttgagcctatgagcgtcattgcatgtgatatggtctcttaagatagcgtacagttgggttttgtttctttatccaacttatcactctgtgccttttaagtggagtgtttagcctatttatattcaaggttaatattgatatgtgaagattttattctgtcattatattggctagttgttgtctagatttgtttttgtagttgctttatagtgtcaataatctgtgtacttaagtgtgtttttgtggtggtcagtaacagtctttcatttccatgtttagcactcccttaaggacctcttgtaaggcaggtctggtggtaatgaatttccttactccctttcagagatgccagtgagtcataggtttagtctcttcacataatcccatatttcacataattccttatttcacttttttaatttgtttacattatttttgtctgtctgatttgatttgaagaaccactcttcaagctctgaaatttcttcattagcttggtctattctgctgttaatactttcaattgtgttatgaaattcttatagtgagtttttcagatctattagatcagtttgttttttttcttaaaaaagctatttcatctttttactggattccttagatttcttggatcgggtttcaactttctcctgaatctcagtgatcttcattgccatccagactctgaattccatctctgtcattttagccttttcagcctggtttaaaaccagtgctggggaactagtgcagtcatttgaatgtaataaggcactgtggctttttaagttctcacagttcttgtgctggtttttctctcatctgtatgggctgatgttccttaaatctttgaaactgctgtctgttgaatgtggcttattgcttttatattctttgatgtccttgagggtttgacagtgttataaattgggttcagtcaactggcttcatttccgggtgatttcaggtggcccaggctcagctcagtacactggggacctgggaccaggcctatggctttgttctctggcccctcaaggttaagcacctgctgtactgcaagggctgaggtgttcctagtcagctagcagcaacactctgatggagggtgctggcaaaagcactacattggggtggtgacaatggggtccacacttgggcatgcatgccatcaactacagggcagcagtgtggcagggtccacgtgtgtgtgtgtgtgtgtgtgtgtgtgagcgcgcgcccacaccagcaacaacagagcagcaacagggtggtgggccctggcacaatggttggggaaggctgcaggcaggagcatgctggggagggtccatctgcagaagctctctaatggtggtacctaccaatgaaggagctacagtagcagctgctggaaagcaccctcattgggcatctgagattgtactgcaagtgtacaaggccaggcagttaccctgggacgggctggaagatagggggtgctgagatcagactgggcttgtgccatggggaagaaagctatgctctgttcatgtcctacagtcaacaaaggccaaagccatcttgaagagtgtggtgagccttgggagaaggacatctttggccatgctcttctgcagctatttctgtgccaaacgctctggattctgcacatattagagacctgcccctgataactctccaataagctctctctgcaaactcaaatgtctgttgaggagtgggttcccctgcagctaggattctggggtccatggcaagagtgggccattccatgcctgtttaattcacccctttcccaggagcccctcagggccaggaatggatcttgatgctcagtagcccagtgcagagttcccagcttcctcttcttttagcccaggttctatgttctccctctgtccaccttcaatgccatccttctgaagatctgcttggagggtgcaggtcttcttaatggtctggtcacttggtgggagaagctcttcctgtcagccatcttgcttaacctgttttcttaataaaacaatgtttgcttcctaaagttttcaactttatatataaaataaattcagactctaataagattcctcacaatttcatacccagtaaattttattttatataaattattatttcaaaaacaatatagtagcaccaagatttaaaatgacttttcatcaattgaaggaaaaaatggagattttaaggtcttctacccaaaacctctcattttaaattagatactccgaaagtttccataagtaaaaatcattacttatgttaatttgcagctaatttgctacatagtatagactcttctgcctatacatgtctttaaaagaatccatttttatatgaaatgtgtatcattggtgtcaagttttttatattcagagagtgaagcttttaatttctatattttatgtcattagtgtgctgaacacttctgctcctggaaagcaatgaaattaatcatttttggcttcggctgctgttgtgatgcacataaacagcaatcctgttgaactcgagtgagaatgctcactgtgctcatactaagccaattagtgcccagttatttattttcactgtagtggcgagtgtgggagtggtgggggtggggaggcgggggagatgtggagagagagataagcactactagtagagaaaagcagacataaaattggcagaatatttttcagaacaaaaactgtggtagtaagaggaatcaatgtcataggctttagatagcatttatgactgtgtgctcgtgtgtgtgaaaacttataggatgtaaaagtgcttacaatttgtcttcaagtttaaattacaaacagacatagtactttcatttaaaagttaggaaaatgtagtttaaatttttttaatttctctgtgagcttctgcatgcaatcctatgcaattggaatttgatagtcctttcacacaggagaatgagaaatagctaagcatccattatttaagtcattttttctgcaagtgtgggctcacccaatcatgagagtgataaaggaactggaactagctattattcaggaaatgtgtgaccaagaaaatgactttttttttttccgactgtgtctcgctctgttgccaggctggagtgcagtggcatgatttcagctccctgcaacctctgcctcccaggttcaagtgattctcttgcctcagcctcccaagtagctgggactacaggtgtgcaccaccacgcccagctaatttttgtatttttagtagagacggggtttcaccatgctggcctggatggtctctagctcttgacctcgtgatctgcccacctcgtcctcccaaaatgctgggattacaggcatgaaccaccgtgcctggccatgtattagatttttttttaaaacaaaagcaaatatggcatcaggagatagacagacagatattatatagatagatagacagatattatacagctaaacttgattctcttcctctgtccatatagttttacatatcttcatcacttagtcatttttagttagttctatgtccagaactatggatatatattgaccttaactgtcaagtatatacaaaagagccaaactgcaggcataaaaaaaacaaaaaaacaaggacaagcaacatttatccacagtttattggtcaaattatgaacaaatgtagataattataaattagcatccttagtgattactagatttgtgtcacatatgcagataatgtgttattatttagacattttggaaataattcagtgagcactgtagctggggggtacagagagtagcccccatttgagatccttcttcatctcacctgctacctctcaatcccggtgaaccaaaagagatgggagagttctccaccaggaactactcagtggacatttttttcatatatgttgaagctatagtccccctcctatttttgttcagtcctctgaagttttcttttactttcttagaatattgctatagaattttagatctaaccttaaggaatattttgcagactaggaaagttatattcagcattattaattgcatgaccaattaatggtaaaactggtaatcaaacaatttgcaagacatctccagtttcctttgactacactttattgcctcttttatttccattcgttctctttttattctcaggatgtggctgagaagcattggaataatgtcttggtagcacttctttaaggattttccttttccatacacacagaaaaatcatattgttggccatatatgttccttttgttcattttttaatatgtgtctgtatttttctctagcctcaaagccaatggacttaaaattatgcactggacctatccctaatactacacagctgtgccacattccttgtccaactgaatgtgaagtttcaccttggtcagcttggggaccttgtacttatgaaaactgtaatgatcagcaagggaaaaaaggtaggtaacgtgaccatgacatgccttttatacccaccaattgtatcaaatcatgaattatttttaaaatgctcttctgtgttccttgtttgtggtattttccagaatggctaaagactattaatttcaaaagatgaattaaccttctccagtgatagtaccagaagattaaaacagaagaacataggcataaatgcttgttaatttagacaacatgatggagaggatctgagacagtttagtgcaatggttaggatgagctgtggggtcaggcctggattggaaaatctactgtgtcccttactgtttagataagttaactaacatatctaaacctttgtccccttatctgtaaaagggatgtaacaatatctgccatccagattgtctctaagcagtcaatcagataaacataaagcacttagttcagtgcctgacccatacctagtgcccaataataaggctgcttattactttgaagaaaaaaatgtaaaaactgtattactttcatatgcaaatgatagaggaatagaataaatgcaatggttttcttatggtagacgtggtgagctaattttcacatgatctcatgattgaaaacatttttcaattttgtttcaaagaccagtcttctagtgattctagtatgtttacatagcaataaacagacttgttaattttgttacacactctcatgaagggcagcatttaggtgctattaaagcacaaagcaggactttgaatatttcacactggagcccacatggcttatgttcctaattcaaatttccagagggtctaaaatcaactgaacctcaaagagattgtttctctggaaccatccaacttcttagaggttcattttccaaatttaatcatgtgacattgctgaagatttaagaataatagcacttttgtctggtcatcggtatttctaaatagcttgaaatttcactccttctttgaatattctatagctacagactttccaagttgaccaaaatttatctctctctctgttcccaccctactcctctacgccctacaagggagatgggtactatatgacatttctagccttacctttgcagtagtaagctaaaaccaaaggttctcattttttttcattccattcgttaatccactcactcatttaatggatggttcatgacctcacattagctacagtttggggatacaccagtgactcaaaacagaaatgacttctacctccactcttatccaacttttactctgaggttttattcaactttctgaaatactaaacctttgatagtaacaatagatttttccttcccccataattcaggcttcaaactgaggaagcggcgcattaccaatgagcccactggaggctctggggtaaccggaaactgccctcacttactggaagccattccctgtgaagagcctgcctgttatgactggaaagcagtgagactgggaaactgcgagccagataacggaaaggagtgtggtccaggcacgcaagttcaagaggttgtgtgcatcaacagtgatggtaagacagacgtatctattatgtttttatggatgtccaaccctgcatatatgtttttactttctgttaaaatcctgtgtcttctcgcattataactgattctgtttacaaacgtagaaatagctgcttctctctccctccctctctttccctgtctctttctcttttgttctaatgaaatggtggcagtgggaaggatccatgaatagtaacaaaataatgttaaatgtgaaaacagaacagatcatataacataagaattgaattatcattagggcaataattgccaaatttaacaataacaagtaaaggtaacttttttaagtgacttttttaaaaaagtctatagctccagtgttatagaaaatgaaatgtaaacaaaaaagggttgtaagcattgtttgatttgactctaaaagtattttcctttaacctccctgatatcgtgtcttagtgttatcatttaatttccaggctcccaatccacgaggcctaccacagcctagagttcctgaaccgaccttttgctctctagggctccactatttaggaatgtcctagagccactggatagtggctttccgcaagattcttttccccaacctcaggaattaccttggacttttacaactaatatttgtttgataaaatatactgtcttgatgttagctctgatataagatttttaccttccttccaaagagtactgctactgttttggggagaactccttacctctaagtcatccctgagtcacacttgaaaaccacaagactcccccagacatactttaaaacctctggacaagatcatctctaaggttgctctatctcttgaatcctatgactctgcacatcagagaagcatgagtgctaaaccccagggtccaacagttgacagtttatgctgtttacagcatgtgcagaaacaccctggtgcccccttgggggtactggaacatctggtaaccgtcataattctttccatcctattttcttccagtaagcagaattgtttcctcctgtgactcagtcactgttcagtcgtaaagaaagacactctctggtgtgggagactgacagacactgctattactgagaaattagccttttgtctttgtccagggtctaatatagtcatgcgagacagtattaggtaaaatctgaaccagtgcttgagtttgaaatgggaagaaggagatcattgctccagatcttttatgatgaattttatatattctgcttttttgctacgataagcataatctgctgtgatatgtcctctgtttagctcttacttattctataataaagagaggaaaaaaaggaggaagtaacactcagagattggcaagaaagcaaaagaagcatgttctgtttctcttttactcacactttaaatcctagtttggattacacaatactgttaccttctgaattgctgtaaaaacagtcagggtcgtattgaattccctcagtaatagtacttgatcgtttttctcagttcaaataattttgcttgtccttccatagtcctatagaggaattagggtctcaggtattgtgaaaagtatttttgagtgaaacaaaacgctaaaaagttaactttgcatggcacttctgcctcagtgttatgcaatgaaaaaatcagatttagtccacttagtacaatgatcttcctggtatttgtgctaatggaatatattttatatagactaaaggagccagctatttaaaaaatatcagtggcttattttcattttgttaagtgaaacttattttgcaacacaagtaattacctcctagcttgtcttgtgaaaaaacactaaaaaacaagcagaggtatgacttagatgtgtgtagttgtactggcaatgtatgttataacctaaaaagcaaattgataactcacaatacaaatgagctggttttactttgtgtacatcacaaacggaatgaattttaaaaaggtaagtatgcaactgctattaaatttgttattgtcctttacaggacatcttttccaccattaaattttatttcctgacattaattagttgtagtacaacttaatacattagctgtttcagctacatggatgtataaaatcaagaaaattatttttttattatgaatcctagaactcactcaaatttgtatataaactgagacataattgggctgatagaatgaaagaaaaagctggagacttgtaactactgctcccatattatcatgtggtcacctggtaagtgtttagcagctgcaccaaatgttgttttgtaattaaattgggcccagggaattaaagttgattagttgtagactctacctctaggcctgggctgcagctatacattttgttttataattaagttaaagctcgactaggggcatgaagcattagagcctgtgaactgaagaaataataaaaagacttttttgctcccacattcctcacagatttcacaactttgttaatgacctcaaaacacttaaaatctatttgttttctgaaatattctttgtccagactcccagtgatcattaagatttgctgctgctgttcatttttccatttcccttctaaggaggaggcttggggagggttgtaagagaccccaggaggagttttgcatagcttctctgtcagagaagaaaacagagggatgtaagagagtcgcaagacaaaagagagcacaaaagacgattagactctccaaaaagagataaacatttcactgtaatagaacaaatattgctcattacttcatgatcatcggatacacaattccaggtctctgaacacaaacgcaggaacctactccaaagatctgtggtctggggaatgacccaaaacccgccctattttaatttttctgatatttgaatatgtttcatttaaaggtgtaaatctggcaaagcaagtgtattttgtttcctaaattggcttgttagaggctgaacaaaccaggctattggaccggagcaaggggaaaaaagtattattccttacttgagagtgtaaatcaaatattgtttccatatttccttctcctctgccaaaaaaaatgatgctgtctatatttccttatcatgtgtgctatttcagatatcgaatattgacacttttccatgtgactttcgaaaaaaaagtcagttatgttatttttttgtttgtttttgcattattttttaaagcagtacacctcagtggtttcaaatgcctgaacttctatgctatcttccttttcttttccccacattagcaaagttaaccaatgacatgggcataggcaactcactttcctccttgacccagattgttaagaaacccaaacatacttttatggaagtaaatcattgcaactcagcattacccagctattaatgttacagtataagagtaatgaaggtcaccggctagggccatccttgtgtattgtgccattcttgaatgggagtaactctgctatccaaagactctcagcaccatgtcaaaccggctggcttctagtaatgctgaagaaggcctatgtctaagcacatgtggagatgagcactgaggtaagccctaaaagcaagtttttctgcctcttttgggaacatttctacatatcatcaaaagtatcaaaagaactggctttgaaaacacctgggggaagttgactgtgttcggctatttgtgcattgcttataaagaaatacctgaggctgagtaatttatgcaagaggaaaagaggtttaattggctcgcagtcctgcaggctgtacaggaagcatggcgctgtacaggaagcatggcactgttaggtgttcagcctctggtaaggcctcaggaagcttttactcatggtggaaggctaagtgggagcaggcatctcacatgacagagtggagcaacagagggagagaagagagagatgccacacatttttgaacaaccagatctcatgagaactcactcactatcataaggccagcaccaaggagatagtgctaaagcgttcataagaaatctacccctgtgatccaatcacgtcccaccagacgccacctccaacagtggggattacatttcaatataagatttagtggggacacatatccaaactatatcattgactttagtatccagggcactggcttgccatgtgactgcttaatctttctcaactttttaccaccaatttcttccttctgtaataagatatgtttccgcctataagatgaggaaggggaaaacttgagtactatttctttcccaagtagttcttgtcatacttctttgtttccatgtagttagcactaggaggaatatgggggcatatcatttcagtatcttcaggaaaatgtaagaattttgaaaatttataccactggagaataggactcattgtggaaagagatagggaaagataatgccctattttaagtcttatagtacaatttgtatgcaatatataaactgtatgaatactgaattttttttcagacatatattattaaaaagtaacagtgtgaagggggacagaggtaagtgggacaatcggtagaagattgggagcaaagcaagcatgccaggaatagaaaaagagaagttatagaactcatagttgagactaatattttgactgattcagaatattcatagattgttccagaagcataggccaggtcaaggatgaagatgcatcgagcttattaaggatgtgctcccagaagaaaccagtaagaaaagggggaatgaataagcaaaatacagaaaagagaaagggtcttgagctcctaaaaccattcccaggtttagtgattcactaggaggattcaccatacagttgtacctataaccatgacttattaaaacaatagtatgcaaaacaaaatcagcaaaaggaaagtgtacttgaggcaaattccagagaaaagaagatgagtcccagaaacttccaattctccatattggccagaaaaacctagtgtcaaagggcaatcagcctaaagtcagggatgaggctgaagctgcagaatctgaaagatgggtgcagagatccagtgaaagggatcacatgggatccaaactggccagcaacactacccattacaaaacgaaatccaattatgtggtaaggaatataaatgttgtataaactaaaaggaaccaaagacccgattaaacagtgtcttctgggcccacgagaatatgcagttttccagtccgctgccacttaggaggttcctggattcccaatgaaattgaaataattctatttgaattttaatgcagaaaggagcttcagaaggctggaaaacctgaagactcccaagtagcagacattaagattgtttaatattggaaaatgttagaatatcttttcaataacttaaaatggaagagcacatttataaatatttttgtgcctttctatcaggggagtaccttttgtgccatattttatcatttattaatgataaacaaggacattgtaatgtacaagggagagtggtagacaaaaagttaaaatatatttatagaatggaaactcacctaaataagatttgcttctgaaaccttggtgagaaccttgagttcagatcaattcaaatatctatggaactagatgagagcacaacttcaaatgcatgatcattctttggaactggaatctacttcttaacacaaattacaaggccattatgtagaaaaaacttcttttaaatgcaagaatccatcctataactgaatcgtttttccataatttaagcaataagtcaacaaagtttccttcctgtagaatgttatgtcttctaatgtgtttgaaatataattaggttggatattatgttaaatctaaggtctctcacttacaattaggatcgtctaaaactattggtaggagtttgtttcctgtaattgggttgagactctttattcaatttgttgtaaagataaaagtcattataaccttttagaaaatttcaagcaatatgttttccttcagtgttggtgtgtagtaatcaccattttattttggactataaaaacttggcatcagatactctgatttgtctgctatctgttagtatatgtgtctgtgtatgtattacaatacacttggatatcttagtaaaaaatacttttttagaaaaaaccgtcagagttgaaccaatgttctttgttcttttgaatggcaatgttgtagcaaagagtaggattttctatataattttatgtattttattttttaaagtagggtagattcagcagagacatcagataaaaattgagtaaataattatttaccacttagtgatacaaattccccactgaatgttagctacaacttcaaatggcaaatataaaatagccatttactttgtcataggtggtgggtaccttaacacaacacagagcaaccaattttctctttatttccttttagagatgtggtctcactgtgttgcccaagttggtcttgaattcctgggtgccagcaatcctcctgccttagcatcccaagtagctggggcaacagtcacatgacactgtgcctggccaaagccagtatggacattggacagaaagcataactttcagttaaattaggcaggagtttagttattaaacccaacagatgcattcctcacattagtgagcctcttgcttgcttctttgattccctttatatccaccttctctgtaaaatattgtcttcccatgacttcattgattctgtattccctattctctttccacctctcagaccatatatcatttaactattgctaggtaacaaaccacctcaaaacttagtggctgcaatcatgagaatgcagaagtgcttgctaaggtttcacctgagctctcttgtggaagtttgactatggctgaaaggtccaagtgtcctccctcacatatctggcattggtgctgtcagctggggtacattggtaccccattggtacatggactctcatcctccaataagctagatcagcttctttttatatggtggcttttggcataacttcaagaggaccaagcaaaagctgaaagtcctcttgaactcacacaatatcacttcgtccacattctgctagtcaaagcaagtcacaagtgacaatccagatttaatgagtaggaaaatagactttgccttttgatggaatatattgcaaagaattatggcaaataatttactatggtctactctctggttacaattattttcaatcctctcacatgcaaaatatacaccctccccatccaagaccacaaaaattctcatgcaattatattatcaggcttaaagtttactatctcatgatttgcatctgtttcaaatatgaatgtagctactcttgaatcagaggtctgtgaatgaaaagaacaaggtatcttccactaattcccttcaaatatacaacatacaatattgtgaaagagagtggaaaagcactctcccattcaaaaatgagaaaaacaggaagcattcagccatttctgccctataacagttttttaaatcactttaagtcccaagatacaagtgcagaacctgtaggtttgttacataagtatacatgtgccatggtggtttgctgcacttgtcaacctgtcacctaggttttaagtcctgcatggattagctgtttgtgctgatgctctccctgctccccacacccgacaggccctggtgtgtattgtttcctatgtccctgtgttctcattgttcacctcccacttatgagtgagaacttgtggtatttggttttatcttcctgtgtttatttgccaaggatgatagcttccagcttcatccatgtccctgcaaacaacatgatctcactcctttttatggctgcagtatcccatggtgtatgtgtcccacattttctttatccaatctatctttgatggacatttgggttggttccatgtctttgctattgtaaatagtgctgcaataaatatatgtatccagctgctcaccataaaacaggaacagagtaagttccttgattaggctctacttttgttctctgggaatcgtttcctagtccactgttttcttgattctttcattctgagctcttgaattttcccctaaaatatctttccttttccataagaaatggcttatatttgtagccgaggaactttctcagttggcctctggaccacagaaattaggccagaggacatttttttcactctgaactgtctgaatttctccaagtctaaattggcaaagttttatcaatgcaacacccttaaaacgttttgagttttctatatatctcattggatatcactttatgccccaaaagccatatccatcactgtttttcacacaaccttctttttattttgggctacatgtgagtctgctgtgggagatgcttctaagattcttaaaagccctgtctagctgagagggtcttctgtgaatcacgtaagtctttctctggtgttatcaaagaattattagctatatcccagattaatttttaccttaggtcacttcttactttttcccagagaagtaaggatgagaaatagttttattttttcattttataacagctcttgtggcatcttctaaattccaattgcacattgaattatttcttctctatttctcttccaatagcatatcattctcagaagaaaaagaaaacattaaatggacatttttaacatttttcctgggaatttcttgaaatacttacattttctatcttgcaagtttccacaagaaacagttttgccaattttttcatcactgcatgatgtaatatgtacattatggaactaatttttcactaacaatcttcttacctacttttgccgatctagattcaatgggtaggaaaatagactctgcctcttgatgggagaattatggcaaatgatttaatttattatttaatatctgtctctatccttcactaacagtcttcttgcctgcttttcagcctttaccaatcccaagtctcaaagccaattctacttgttttagatttcttaaagcagcatctcattgctacatattaaattctataccagctacgtatactacataacaaattaccccaaacttaattttttgtgtttgtttcattttttcacaattctttgggttgggtgggtagtttctgtgttggctttgcctggtctcactgatgcagctgtatttagctgaagagctggcatgggtggaatggcctaagttggccccactgatgtcaatgaaggtgcctcattttatctccaggtgtcctctcatgttccagtagactagactggcatcttttctaggtggtctcaagataatgttctaggagagaaaaacagctgaatggtcacttattgcctaggttctgaactcttgtaagaccacttctgccacattctatgggtcaaagcaagtctcaaatctaacaaggctcaaggaatagtggaatagactataccttttgatgagaggtacttgccagaatttgtggacatactgaatctggcacatgctacttcctctgtttcctatatgctatattctttctctgatcctttcttaaaagttaatatttcatttcaacgctctgctatagagctatacccggaagtgccagccaaaccctactgacattttaacctcactgtgtaccaaagtcaaactcatcatcttttctccaaagtcagtttctcttccaatttttccaacctagttcacaacactacaatttattcaatcctcaatcctgctgatggagtgacatctgtgaagagacacaaaggagatgagaaagtaagccctatgcgaatttgagaagagaacatttagggcagaaggaacattaaatgcaagacccagaggtagaaaatgcttggactatttgaggaacaacaacatggccagtgtggttggagtagaatgagttagggagaggttattaggtgatgaatttaaagaggctgcagaggcttgagatcattcaggggctttggcttttattctgactaagatgggaatctattgaagggtttgaaacaaatgaccagaaccgacatgtttttaaagaatcactgatgttgctttgttgagaacgaactttaggggagcagagaagcagcagtgaggagactatagcttcagctataattccaatgagagatgacagtgtggcttagataagggttgcaacagtggaggggacagtgctaatttaaaagaattacactagttgaggaaaactagagcagcaagtggagatgttggaatccttgaatcaggttttccttatactggtattattttctttatactagtgttatggtattatccaccataaatcctctcttgatcacatcattcagctgcttgaaatcttgtttgtttgtttttgtgacagagtcttggtctgtcacccaggctggagtgcagtggcacgatctcagctcactgcaacctccacctccgagtttcaagcaattctcctgcctcagcctcccaagtagttgggattacagacacccgcgaccatgcatggctaatttttgtatttttagtagagaccaggcttcactgtattgaccaggctggtctcaaactcctgacctcaagtgatctgcccacctcggcctcccaaagagttgggatttacaggcatgagccaccatgcctgggcagaagttttttactggcttccttttgccttctgcgtgaagtccatttgggaattgcagaatgtcctccaccatctgtcttgtccgttttaccagttggcttttctacccctcccttcattacaccattgtacattttatggaatttggaatataatcatttacagtttactattccccactattccttctatatggttgcttactatggggtaggtatcatgtcgtaattatttttgtgtgactgtttcctagcactgtgttccacttaacagattgtcaataaatctctgaaccataactaattcctttcttttatccctaaacatcacatattttcaagaaatgactcttaatttctcctcaagtaaacttttattattgccctcactgcaaattcaaactttgcctaccagatgtcgaataaagcatgacaccaaattgcacaccctattaacatctcagtatgccttcaaattccattacactcaagtcccagtacagtggagcaaaatagctcctgtattttcataggaagaaaaaaataaatgtacagaaaaacttgaaatttgaaggattcctctcacagcattttatcattaaaccatgttttattgagctttaactttctggagaccggtcattgcagcactgactctaggttcacatgctaactttgccactttatttggcaagttccttaaatccacagtgactacgtttccttttctgtgaaatgagacctgtttataatgctgttttgtagtgcaaatgagttaatatatgctaaatgctaggaattgttcctagtgtgttctatttaagtgtttgttgttacttttattcctctaaggtgggttcaatagagagaaagttagctgagcatagagactgccttgtttttaatttggttacagataagaattttattgcttactgtattagtgtatcctcacattgttataaagatactatctgagactggctaatttataaaggaaagaggtttaattggctcacatagttctacatggctgaagaggcctcactcagaaaacttacaatcatggtggaaggcaaagggcaagcaaggcatgccttatatggcagcgagagagagagagagcaaagggggaactgccaaacacttttaaaaccatcagctcttgtcaaaactccctcactatcacaagagcagcatgggggaaaccatccccatgatgtaaatacctcccacctggtccctgcctggtggggtttacaattcagattacaattcaagatgagatttgggtcgggacacacgcaaaccatatcacttaccaataacttgattacatgatttgcagcctagctcatttattttcataacacactcatcagataagtgacctcattttcaaagcacatatacatggccttaaataaatgtctattgtattcactaacagaaaataaatatataataaaattctataataaaaaaattatttcacctgttttacagagaaacatatctctgagttgacattgagctaatatcttttgaatagaacaagattatgtgagtttgaccaaacttataaaaagtattgtagcaatgttactaattttagagtagattagaaatgcacgttttttatttgtataacataagaactatactgaatgtgtcactagaatcgtacttttctgtttttagaagacaacaagctactgactgtgggcagaaattggacttgacttatgtatgatcagggaatattgctgtagaaaggcaattaaatataattaagaaagctgtagtaatctttaaactttaagaccgctggtacttagccttgtgttaagtcgaagctgaggaaaatatatcttcaaaaaaaaagtcaccaggaacccacattaggaagtaaaaaaagagatgctgtttacctttgattctcaatatgagatttcttatctcaggagcacctatggttgaaacagggaacatgctatagcttgctacaagattaatacagtgcattttcttgactttcttgacttccagttttgctagtaggctaaaaaggggtaaggaatttaagtaaattagctcattaaaatgttagaattgttgatcttatattgaaattgctgaattgatataaaattatagaagattaatatacattgtgctgcttgcctcctcaacattgtttcattctcttctatcataaaccgccctgatttttctttgaggaaaagaaatcccctaaattattgaggcttgctgggatggatcttacctcccagtcgaggcaagcagtatatcccatctacttggctgtaataatcgctttaaggatgaacatgtgacccagtacaagctaacagagagaatatatccaagagcttgtacagaaataattaaaagagacattggagctctttgcagtcactatataaatttgataatatgaaaggcagagagcagagaagatattcattggtattacttgagcctttagagctatcctcacatgaagccacgtgttgttttctacattttattttattttagagaatgggtctcactctgtcacccaggctggagtgcaatggcatgaccatagctcactgcagccctcaaactcctgggctcaaatgatcctcctgcctcagccttccaagtagctgggacaacaggtgtgcaccactaggcccagctagttgttttaatttaagtttttatttttttgtagggacaaagtcttactctatggcccgagatggtctctaactcctgggatcaaccaatcctcccacttggcctcctacagtgctggaattagaggcatgagccaccatgccgagcctgaagctatgtttaattcttacctaaagccattatttaaaccagtaaagtctcttcattgtttttatcccaaaagaggtctaagtgatatagaaagagaggagagggaaagttcctgctttgaataagtggctactaggcttagactcacagatgtatccaaaatttacccctaaccaactatttattctacatttttctttagaatatgtcaatgaaaacatttgcaaaacccctagattatactaaaggaaggatctaacgtggcttttcaaaacaagttaattgtctatggaagatttcttgatagagtgcaaagtaaaatctagttggaagaggattcttctagaactggtttcatctttgtagagcatgtgatgttagataagaaaacatcaactgtccttacaaaagcagagttagcccaacagagagacagtggagtgggagtggctaaagtgcctcaacatatatatatatatattttggccaattttgtttcaagattcctttttttttatttttcctgattctcatctccctttggacagaacactgaattgctagaaatcatagctgctgagatcatgatagaaatgacatgttgtcacaaaatatttggcttatattttcattaagattccaaaatgttaactttgattcagaactatatacaataattttaaataagaaatctatatggagagccttctggatatttagtcttgacttctctaggatacacaacccaggaaatggctatggtatgcattccattagagagctagaacactggagaaaaattctgaccttagaaacaacatttaaacattatcaacaaactggtttaatcattggttagacttctcagtctgctgcctaggctcattcattctttcatttcacatttattgtgcttgctgtataaggtgagtgcaatagagagaaagttagctgagcacagaaatttcattttttttaatttggttacagataagaattttattgcttactatattagtccatcctcacactgctgtaaagatactatctgagactggctcatagttccacatacctgaagaggcctcactcagaaaatttacaatcatggtggaaggcaaaggggaagcaaggcatgtcttacatggcagcaggagaaagagaggggaaagggggaactgccaaacacttttaaaaccatcagctctcatcagaactgctgtatactaggcattacatgctatgttactggcattatatgcacatttattgtgcttggtatgtcacaggcacatggttatgcctgctatgttgcaggcattacacctgcattaataatagcagcccctgcccattaagtatgcactatttagttggagatgggaaaatatgtaatcaaatgattctaatatagtgcaacaaggactagagacatgctcaatgtgccaaggggcacagtggatagagtatactctctgcctcataggatcactgaagtttttaaaaaggagatgactcatgttaactcaaggagtaaataaaaattaagaaggtcagtatattttaggttaaaagcatgattatgcaaagcacagaagtatagaagaacttgggatatttgggaagctgcaaatagttgggcatgttactgaacagttcgtgtttgaaaagctggaggagatgaatctttgtggataaaaccagatcatgagagaattggtaagccaggttcaagagactgtttcacacaattcaaattgaaaatattctggtagggaaatggtataatcagatcctttaacgtagaactccaaccacagctgtaaggaagggaagttgagacacactcttgctctctttctttagactaaaccatgaactctggctataaaacaaatttggtctaggaatattccagataactttcttgcagtgaaatctgttttcacccagtgctgctgatgttctcttgctttccagtcacacgttacatttagaatgtggacatgtatatccatatgttttagagtctttgttttatgtgaaagaccttttatgggtttatatactaatgaaaataactgttccaaatgagtataatctagcaaataaataagaatagaagtcatattgtacactttttctttatgttgtagcatctctgaaatgtagaatcatgtaggtaagaatatcttttataattattgggaaaatttatacccaagcattatacatatacacttctgacaactacagaaaggtaaaaacaattgatatatcataatagtatttggaaaagctgtaacttttaaatatattttatgtgccagaaatagttgtatagttgtattactatagttgaatagtatagttgtattacttccattacttgtaagtagtaagttgtttaagcttcatgttttggaaattgatctatggctttattgacagtgatgaattactaattgttcttaccttcttaatttaaaaaactgatcttcatttattttcaatttgacatgaagaacattatggtatttatatattctatggtatttttaatatgttcatttataatatttcttggcagggtgaatttaaataacttcagtgctctttggatgaactgtactcaggcatgatctattgattgcagttaggggaaaatgacaaacagaagttgcatctgagtcataaagcaaggcttcacctttgttctcagtgtaatatcttcttattctaatttgataaaagcatttaaaaatggatttgctgatggcttaaaatgtagctttggtcaatagaaaggttaatattaaatgtgaaaaacatgataatgtgtatgaagaacgtgcctttcatccacagaaagtgaaagtgtttatctcctgctaaaattaagaaaggcaaggcaggttccctgctgtttcttttgaaaatgatcccataattatatagccaaattcaggaaaaagaacaaaaagcctttctttttttgaactcttcctttacaaaatagtgtttcatgttgatttggagtatacattaaccatatatcctgaattaagtgtgtgttgatttctttccacttttacccttcctcagagaagagaatggcagaaattcttttgatgcagaatggttcccattattctggtttgactgtccatgtgtataagaggaggaaaatcaagttctgggactattcaaagcaccctggaaagctcagaccctgtggagctctgtttccggctggctagccacatataaagactgtaaacattttcacagctaaatgacctctctacctaccttaaatgttcatcggtcttttaaagtcgaaccatccaaaaaatattattcatccgaagggaattagtttcaacttaaaggttcgttgaaatacacccaagtgttattctgaatgaatgggggtttatgctttttctaaaaactgtacatgtcttaaacctgctccagctgaagcagtcaaaaagataccaagctctgttgtactagcaatagacaacatgacagagcccagaagccccattgccattctgggaagttgtgcgccaagattgtcatacatctagaatgtatgccaatactaagggcaccctggacctgtccaatacactggcattcaagccttcatttagggctggattctgagtaccaccacagagccagggtacaattcatgtaagaagaaatacaggtggttactaaacatataagaacattgcaataaagaaatacaaattgatgggacaatatatctttttccacatctgcatactaaaataaataaaaagaacctaaaagcacccagtgttttgaaatagaaacttttacatagaaaagtagaaactatgaaatgttgtttaatcacatatgttataaacctcaaatataataatctataccatgtctagtaatttattctaaggaaccatatcccaaatgtggattcttatttaaaaaaattgtgtacaatatgtactaaaggcagaagaatgaaataacttaaaaataagacctgaaagaatgacaagcggagaacaataaaaatgtctttgtatagttaaaatctattattctagtaattactacgtacaacagaccagtatattctggtttttttaatcttcctgtcaattattcctgtgaattcttctgttctttcaccaggtccagacaacttttctattgtttgatcatttactttactatttagtaaagccattcttccttctctattattaactttcaaaaattcattgattaatagtttttcctagctgcagactcctgttttttgtaattttttgtcagggattatggaaattttaaatacatttaggaaaattaacaactttaatcacacataatctctccatccagagttcggtgtacccccacctccattatttgtcaagtttttcttaatttttcttagtggtgatgtgaaaattttgtcagatggaacaaagaaattctcaaagaaatggggttgtatgatttttgccattacttgtatttctagtgcctgtgtctctcatttagtaatcatttctcaaaaagcaaaagtcttcatattactataaagactttttatttttagagatcaagaatcaggaagccagatttttatttatgactctgctgttgaatcgtttttatataatgctttgaacgttttgaattctttattcaccaaagtacaaaagcaatatagaactgaaaattatgtgttatgtttcattaggtcttcagaaagtatttttatattgaaatatgtgtgactaatacaacgccattttctgtaactttgtagtgtggacatacttgagatagttcatctgagtttgtttaccataataatcattttggttcctttggattcaaattctacagacacttataaaatgtctaaagagacctggtacagattattttgaaagggactacaaaagtataacgaaagaaaaatatcatatgtacctgttgatttttattaaatgtgtgctatgaattgatatttttattttccatgtactttcgtattatagtggaaacaaaagaaacattgccacaataaatattttcccataacaaaagtgaaagcaatgggctgataggaattttaaaagagctattatatcactatttccacggccttgatataatctacttcttattttcaataattagcattaaactgattcttattttaccttttataattagtgatacaaaattctctaataagaataaaattactctttagctgtcaaccacagattttatgtcagattgtctaatacggtagcaaccgaaaataaaaagcagtcaaatgaaaagataaaacccatagaaaaataagcaaagtacttaaaaacagtatgtttgtgttgaatctcatttataaacatgaaagtatgtgaaagataacttgtggaaatcaatgcaatgaaatatttacccaaagaacattttaagttatattgatttccactatttcctaattaggtgaaagttacctacttcaattgcatgtttgcccatggccttggggaaacatgtacttgttacagggaaatgggggaagcaggctctgactcttaggcttctaagtaggaattctgtccaaggaataagaagagaaaggaatatgttattacgaatgccctcactccggcaaacagctctgctctttaccactcactttcagtttccctcacacagtcatgaatgatgctatcaaaatttttatcaggtcctaattctacttttcctaattttggtcacagcttgcctggatttaggacataaagagcttagaaactcttaattttaatattagaaatgtagctcaatcctatatcaggaacagtttataaaacccttttagataataatgatcagttataatttattttcatagaaaaacatattctaagatgctctatacaattgtttttacactgaattgttttactgaatggtgcctgtattgaaggcactatcagaaagggtacattgaagttgaggtaacttcaaaaggtagtgaatacctgctatttggcagtcctcttttctgcctgcccctagtccgccatttgaaggaaacgtcatacaatgaatgcatcctcgtggtggggtcgggggaggggggagggatagcattgggagatatacctaatgctagatgacacgttagtgggtgcagcgcaccagcatggcacatgtatacatatgtaactgacacgttagtgggtgcagcgcaccagcatggcacatgtatacatatgtaactaacctgcacaatgtgcacatgtaccctaaaacttagagtataataaaaaaataaataaataaataaataaaataaaaaaataaaaaagaatgtggccctgtctcagtgccctaagcttgtgacttcagtgtctctagagagttctatattagaaatcacagtggccaattagcaatttttctttaaaattagtggtcacaaagttctttgtaaatatacagctaaatgaatgtagttgggcatgtttaactcttaaaagttctaagagaatgaaaggtaacctagatgacattttgtaatcagaaggaagtacttctaatggagcaactaggttaaggactgttctgtatttgtcttagtatgtatgtattcatatatatatgtctgtgtgaatatgttcagaaatatgaaatgtctgtgtagtacatttatgatcactatgttccttaaatcaggctgattggtgatgtttttaaaattcttcaataaaagcacatacattttaaatgattacattttgaagagcaatatttgtgcattttttgaatagcacagtcagcgttctgatttcctataagacctttcagtatatttgtagactggtggtctgcatattgatccctcttgttgccatggctaaaattgatttcaccacctctgagacctttgcctgtcatcaaacttactttttctcttatgccaaaatgacatttgattggattatccaacagaagaaggcttctgtggttgagcacaatcaatatgcttgtcttcactgattttatagaccttacagtgactaccttcataaatgaaagctggagtgatttaaattctagtcaaattataccaagacttgaagatgttttacaattgtaaactcttttgtcaacttaatattcagcaagcctgtttctaaaaatattatgtactcataagtaaatatgacatcaatcaacattttcaagcacttgatatttgcatgatactgtggcatatgcaaagatatatacatgattcttagtctaaagggttttatatcctggtggcatgtgtacagtatatgcataagagataattgtcaagaaaaaggtatataattaattttaaataagtcatactatcaaaacttatagaagtaatagcttctatttatttaagccaatattatgtgtcaggcttgttatgctatgttcagctatgatgtcgatcatacctaatttttgtaacagccctccaaaggatttataattaactccattttgcagacaaagaactagcatcatgagattaagaaacttagattgtgcagcttgcaaacagtttaaaactcacctctatttgactcaaatgcctgcagtttctccaagcaccatattacatctcagtagttgttacagattttcaaaagttagagattgtttccagctgtgatgatcaggaagctttgacagagagggtgcagattaattcggtttctcaggatacaaagggttctaataagttgagagaaggaagacaaggttctaatttggaaaggaaagacacaagttggtgtgtaaagacaaagagaagaggagcacatgcattctgaaaaattgaatatactggtatgtctagagcagaagggccatctgaaagtagtttgaaaataaatttgaagagccaatagcttaagagtatagaaggatttgcatgctttctgatggtttagaatctgctcttgaatagactagatttacttgaaagctttttggggaaaagtacaatattatcaacaactatatcaagaacactattaaaatcggtattagtctgtcagaagtgcaggataatcgaatgtttgaacgatatttttccaaagagacatcctaagtcaataaatacattaagcattctcatccttattttaactgagaaatgccagttaaaaccaaaatgatacacctctacacaccaaaatggctaaaagtgtaaaaagctaaacaattccaagagttagcgaggatgtggagcaagagaactttccagacctgctggagtgaaagtgacagtgtgccagtacctagcgaagtgaacatagttctgaccaatggcttaggaatcctgccgctgaacatatacgaagagaaatgtgtgtgtaagtgcattaaatacatgtaaaggaagctaaaaatttattcacatgaatttcaaaactagacaaagctaaacaactgagttaaaagtcaaaatagtggttgcctgtaggaagaagagaaggggaaatagaagggttgtgatggcgcggggcagttcagggctgctggcagtgctctcttttgtgatctgcaaagcgattacccaggtgtttgctttgtgataataactgaatggtacatttttttagaacattactgtctataacttttacttcaataaagatattatatataaaccaaaaaattaaaaacaggaaaaaagtcatttatctagaaaatggaaataagtgattcaaattcagatatgccgaactccaaagcccataagttatttatcctcattcaggagaacagatgcaaataatgaattcttggttcatattcaaatttggtaaacaaatatgtcaggtagtctatattaataaatagtgaaaatgaaagtatcaataaaggtccatgaatgaaatatgtttctatatgatcctctgttcttaactctgatttcatttatagtccatgccataacatttgataatttattatttcacatgtgttcattttgtccagtggacttgattgtacatttctggaaaccactagccatatttaattggtttttaattttccagagcaccaagttaaagcacatagcacatgcatagcaaatactttttgggtgatacaatttcagggaaaagaaatctatgtgtgcgtgcctgtgtgtgcgtgtgtgtgtgtgtgtgtgtgtttctattttatttccagctacagggatgatctgttgtactttttcaggaaaagaattcttgtcttacctcgtttactacatgtatccactgcacctagaacaatgccagcatgtaatgaatgaagcctggcacttaccaaagcattcattcatatatgccccagttttgcttttctacaaacttagagtacactctcctacccttctctctactgaaattctacccattcctttaaagccaaattgaacagtcttctccacagtctctcacgcttcctagtcccaatcaaaagctttccccttgcatatcagaagcaatttctttgtattcctattgtagcatctctggtgctttcctcttgttatacttaattgtgtacatgcctgtgtctccaatttaaactgtaagatagtacataatgtggggaaagcaaggggttaacaaacaagcactaacattttttaaatacctactatgccctagactctaagcagggggttgtctcagctctcagaagttaaataaggtgggcagggtcaaccatccagcaagcagtcaagctctctttgtatccaggtccttctgtctctgcaggcagttcccttttcatctctccatgctatctcctgagcagacaatgtgtctgtcttacctatctgtggcactcacaactccttgcccagtgttctccacatgggtggtccggaaagatttgtaaatttgaatactctgttggttcttcagttataaatgttaaatttttctcaaaggcacctgattctagatgggaagaatgcaaattagcatatagagataatatgtctgtcagttttcataagggatcagaaaaataaacctactataaaattatcttctatgtatctcattgcatgcagctttaaaatatgctttctataaagacttctattaagttgtgttaaaaatggtgtagttgtctaccaactgctcagatcaagagaagaaactaaaaaagacttgaggtaaaatggcaatcaaaagctgatgtcaaaatattatgatatgctgggcttttcttcttttatctgattctcttgtgcttattttttacttcatagccttactttgttatacttagtgtatctatttttaatgatattccctgtttcaggagggcaaaccttttttttttaactctttaaaaatgtagttttgtgattttttaaaaataatgatatgggggccgggcatggtggctcacgcctgtaatcccagcactttgggaggccgaggtgggcggatcacgaggtcaggagttcaagaccagcctggccaacatagtgaaaccccgtctctactaaaaatacaaaaatttagctgggcatggtggtgggcacctgtaatcccaactactctggaggctgaggcaggagaatggcatgaacccgggaggtggaggatgcagtgagccaagattgtgccactgaactctagcccaggcaaaggtgagagacttgatctctaaaataaaataaaataatgatatggaagtatttatatgttctcttgcttaaacaattggacctatgaatgtgacagatggcaatgcgtattacatatacaattattttgataggaaaaatactattattttctcttttatttcattgcatcatgtaaaggctctgtctacatgaccatgactgcaattctggtaggcgatggcaatatagtgatgtatatgtccttttcttaccaaaaatactaatggcattacatgacaattggtgccatatccctgaattcaagctcattatttaatacacctggtgcctcctatgaaattattaaatatatccttattttcaaataacattttatatttaatcctttaaaatgcaatttaaattcagcttttctgtaaaggatagttttatggagatttatattgttagcaaatagcaaattttttcttaaagagaaagctttacagataagaatttaaagccaaaatgttattgacagaatttcacactgaagatggatgttggcattgactgctgtacaaacaaggtcatctctgcacacaggcaaggtcaatgggcttttggaagcttccttttataggaagatggggatgaggcactataatatagccatgaagtacacttcagtaatttttcttctggcagagctagctgatcagtagtaggtcatctagaatcgtgaatgagttctcaccaaatcattcctcgggtacacggacattagcttaatcaataaccatacttatcttgtattctgccttgtttcaaaaatgggtcaatgcattagtttaaaatttctgattttgtaagtgcattttaagtatttatgtatgtattttatgagggcaatttagcttttgggtttgaacctatttgcagtaagttcagtaaattaactacataagtattatactttattacaggttttatttattacagccagaatacaacttaaaataaagatgcacacaaataatagctcctagaaatctcaaatttagaaaggaaaacggaaaaatcacttttaaaaatgatcacaaccaaaagttctcatatttatatagtttaaacatgtttcattcactatttattcattcacagtatactttaaatcatgattgatagtgctacttgaaatattttgacaggcttttaactgagtttgggcagtcacagttatgaagtcacaactcacttagccaaagcagtactccttgtttcttctcagtaacttgtgagcttatatccctggatagtaagatacaaccaagatattatgtatgtaaatcattgccatagatgtactaaaaagactactaaaatatgaaatgtgaagtctaggtcttgttctgccacttactataaaacatgggctgtcttttctccccatcacaagcttggtttatttatctctaaaaatatatatataaaagatctctgtagctttaattttctatgacaatagctgtgtgtttggtaataaatctagctagatgcaatgagttattttcataatcagtagatgatgagttaaatttttatattatataaatagatcataattaattgttgatattgtgcttatttatggcactatggattattaaattatctgccttgtgcatttacagagtcttctttcagccaaaaggtaggtttgctgtctgaagtcaagttgaacattgtcaaaagccagagttaaataacaagtagaaaagtgggataaattcaccatcatcatctcttacagttgttccatagcaaacttgttgaagctgtgaatattcagttaaagtatcacagacctagcaagtaacattaatattctgagaggctaataaaggttgatacagagtctaatgaataaattttattgtttgaacaggaactaaaatcatagtgaaatgtttccatttttagatgaaagcatgtattttaattgtttttgataggatgggctcagatgtgatttcccattagttacatgtaaaatttatttctaaagttaatatttgcataaaatcatttatcacttatgccactcaaagcaaaagaagacggattcaaatgagtataaatttgaaacaacaagtgatcttctgaacagaaagatccatcttcttaggttagaaatggagtaacagaaggcactgtcactgaaggtggagcacccctacaaatattagtggttcttagttttggagctttcgtgcagtcatagtaaaatgtttctatgttcttccaaagaatagagtaataatcttgaaaggagaaagcaagtacagtcatttatttttaattaagcaactaataaagtaagcacacgtagtattgtttaatattactgaataattatactgctaacctgttgaaaaattttgtgaaatatttgatgcatgttaaagattgcatgcaatattatatatcataaatcttaaagacaaaaaacacttatttaaaatgttatccaattaaataaatagaaaatatatagaaatttactcataaaattgaaactcctagacccctcatgatctcctccttctcttttctcctcaagccctctccagagtgaatctctaaatgaattttgtgtttatcatgatggctttgacacatatatacgtgtgtctaaacatatcatgtttacttgttttggaactttatatacaaaatactcatttattcaacaaatattaactgactggctactctgtgccaggcactgttttagatgtagagggtataacaggatttaaataatgtatctgtcttcatggaccttacattgtagaagagaaataggcaataaatgagtaaacaagtaaaatataatgtgtcaaaacaatgataagtgttatgaagaaaaataacacaggctgaaagagatgggagtgtattattttattttgagtggtcaaggagagcctctcggaggtggaatatttaagcagggacagaagaaaaggagtgaataactcttaaaggcaactgtggggattgaatgccaaatggaggcaagaaccagtgcaaagacattgaggtggtgcacacgtagcatgtttgagaaatggcaggaggcaggatgtctggggccaagagggtatgtgtacatttgtgtgtgtgtgtgtgcacctatgcgtgtgtgcttgtgtgtagggaaagtgtaaggggggagggggatgaaggggagtaaaaatgtatcaggttgtcatatcctaatagccttataaactataatcaacacatcaaattgttttttaaattaaggtgaaatttatgtaacataaaagtaaccattttaaagtgcacaatacagtggcatttagtatatccataatgttgtgcaaccactacattgatctagttccaaaatattttcatcacctcaagagaaaacattctatttcactgtctatttccctgtcctctcatcccatggcaaccactgctctgtttcctattttttatggatttaccagttctgggtatttctataaatagaatgatataatatgtgacctgttgtgtctggcttctttaagttaccataacgttttcaaggtccatccatatgatggcatgtacaagtcagtacttcattcctttttatggttgaatcatattttgtgttcctcactttgtttattcattcatttgttgatggacatttgggatgtttccatttgactaatttgttttttggttttttttattcttgaaaagtttgctattttttattttttattattttattctatttttccataagtgattgggatacaggtggtgtttggttacatgagtaagttttttagtggagatttgtgagatcctgctgcaaccatcacccgagcagtatatgctgcaccacatttgttgtcttttatccctggcacccctcccactcttccccccaagtccccaaagtccattgtatcattcttatggctttgcatcctcatagctcagctcccacctattagtgagaatacacaacatttggttttccatgcctgagttacttcactcagaataatagtctccaatctcatccaggtcatggcaaatgctgttaattcattctttttatggctgagtagtattttacatatatatatatatatatcatagtttcttttttattatactttaagttctagggtatatgtgcacaatgtgcagattcgttacgtatgtatacatgtgccatgttggtatgttgcaccccttaactcgtcatttacattaggtatatctcctaatgctatccctcccccctccccccgccccatgacaggcctgggtgtgtgatgttccccaccctgtgaccaagtgttctcattgttcagttcccacctatgagtgagaacatgtggtgtttggttttctgtccttgtgaaactttgctcagaggtttccagcttcatccatgtccctaaaaaggacgtgaactcatctttttttatggctgcatagtattctgtggtgtatatgtgccacagtttcttaatccagtctattattgatgaacatttgggttggttccaagtctgctcttgtgaatagtgccaaaataaaaatatgtgtgcatgtgtctttatagcagcatgatttataatcctttgggtatatactcagtaatggaatggctgggtcaaatggtatttctagttctagatccttgaggaatcgccacactgacttccacaatggttgaactactttacattcccaccaacagtgtaaaattgttcctatttccccacatcctctccagcacctgttgcttcctgactttttaatgatcaccattctaacttgtgtgaggtggtatctcattgtggttttgattttcatttctctgatggccagtgatgatgagcatttttttctgtgtcttttggctacataaatgtcttcttttgagaagtgtctgttcatatccctcgcctactttttgatggggttgtttgattttttcttctaaatttgttcaagttctttgtagattctggatattagccctttgtcagatgagtagatggtaaaaattttctcccattctgtaggttgcctgttcactctgataataattgcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtttttaatccatcttgaattaatttttgtataaggtttaaggaagggatccagtttcagctttctacatatggctagccagttttcccagcaccatttattaaatagggaatcctttccccattgcttgtttttctcaggtttgtcaaagatcagatagttgtagatgtgtggtattatttctgagggctctgttctgttccattggtctatatctctgttttggtaccagtaccatgctgttttggttactgtagccttgtggtatagtttgaagtcaggtagcgtgatgcctccagctttgttcttttggcttatgattgacttagcaatgcgggctgttttttggttccatatgaactttaaagtagtttttcccaattctgtgaagaaagtcattggtagtttgatggggatggcattgaatctataaattactttgggcaatatggccattttcacaatatggattcttcctatccatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagtccactgatgatttggctctctgcttgtctgttattggcgtataggaatgcttgtgatttttgcacattgattttgtatcctgagactttgctgaagttgcttatcaacttaaggagattttgggctgagacgatggggttttctaaatatacaatcatgtcatctgcaaacagggacaattgacttcctcttttcctaattgaataccctttatttgttgctcctgcctgattgccctggccagaacttccaacactgtgttgaacaggagaggtgagagagggcatccctgtcttgtgccagttttcaaagggaatgcttccagtttttgcccattcatttatgacagacccatattggctgtgggtctgtcataaatagctcttattattttgagatacgttccatcaatacctagtttgttgagagtttttagcatgaagggctgttgaattttgtcgaaggccttttttgcatctattgagataatcatgtggtttttgtctttagttccttttatatgatggattacatttattgattcgtgtatgttgaaccagccttgcatcccagggatgaagccaacttgattgtggtggataagctttttgatgtgctgctggattcggtttgccagtattttattgaggattttttcatcgatgttcctcagtgatattggtctaaaattctcttttgttgctgtgtgtctgccaggctttggtatcaggatgatgctggtctcataaaatgagttagggaggattccctgtttttctgttgattggaatagtttcagaaggaatagtaccagctcctctttgtacatctggtagaattcggctgtgaatccgtctggtccaggactttttttggttggtaggctattaattattgcctcaacttcagagcctgttgttggtctattcagggattcagcttcttcctggtttagtcttgggagggtgtttgtgtccaggaatttaaaacagtttctttatccagtcgttgactgatcggcatttgggttggttccactattttgcaattgtgaattgtgctgctgtaaacatgcatgtgcaagtatctttttcaaataatgacttcttttcctctgggtagatacccagtagtgggattgtatgtatttatgggtatggtgtgatattttggtacacgtatacattatgtaatgatcaaatcagagtaattagcatagccattacctccaacacttttcatttatttgtggtgagaacagtaatgctgattatcttccaatgttcagattcttaatatgtcatttaacttatttttgattcttcagatgttatttttttttttttttgagacggactctggctctgtcgcccaggctggagtgcagtggcctgatctcggctcactgcaagctccgcctcccgggttcatgccattctcctgcctcagcctcccgagtagctgggactacaggcacccgccactgcgcccggctaattttttttgtatttttaatagagacggggtttcaccgtggtctcgatctcctgacctcgtgatccacccgcctcggcctcccaaagtgctgggattacagacatgagccaccgcgcccggccttatcttttaattttaaaatttgtaactgcactgttaacatggatcatctgtaaattgtaaatattaatttacatacatagaaaaagcagcattgaaaagttatttgggttcaatacatttctaacctttgaaatcagattgtatggtagctaaatctggaacaattttgttggatgagaatgtgtaaaggaaatgtctaatttttgactttatattatataagtcagttattgtgtcttgaaatgattgcagttcatcactgctctagtacttgccaattgctatgcatgccgtaaaccaaaacatgtccatatcaaagccccaaagaaaactgttttgttcccagtggaatatagaaagctaaaaacattaaactttaaagttaaatttaaaagttaatatttaaagatttaaaaattatatgtaaagtgtatatttttaaagttttattttgtggtaagaatacttaacatgatgagatataccctcatatttttaagcatataatacattattcttggctgttggtatagtgttatatagaagatctctagagtttattaatctggcttcactgaacaatttgttggtaagtcttcatttccctctcctacagcccctggcaactaccattctactctttgattctatgaatttaactattttatatatctcatataagtggaatcgtgcagtattcatattgctgtgactggcttatttcacttagcataatgtcttcaagattaatccatgttattgcatattgcagaatttcctgcttttttaaggctgaatgttattccactatgagtatataccacattttctttatccattcataaatagacacttaggttgttaccacatgttgacaattgtgaataatgcttcaatgaacatggtagtgctaatatctctttgacatcctgatttctgctttttgggataattacccagaaatggggttacagcatcatgtagtagttgtatttttaattttctggtgaaccgccatatcatttctcagagcagctacaccattttgtattctcatcaataatgtacaaggattctaatttcttcatattctcaccaagagttgtctttttttttcaccttttgtttttgctttgcctttgcctttgatcatagctgttctgacaggtatgaagtggtatctcattgtggttttatatgcatttacctgatgattagtgacactgaacattttttcaaatacttgttggctcgctgtatttcttctttgaagaaatgtctatctagtccttaatctactttgtaatgcagttattctttttggttctttgtctccacccaaatctcctcttgaattgtaatccaaattgtaatctccaggggtccagggagggacctggtgggaggtgattggatcatgagggtggtttaccccattcagttctcatgacagtgagtgaatcctcacaagatctgatggttttataaatggcagtttttcctgctctctctctctctcctgccaccatgtaacacatgccttgcttacactttaccttctgccatgattttaagtttcctgaggcctcccttgccatgcagaactgtgagtcaattaaacctctttcctttgtaaattagccagtctcaggtagtacctttacagcagtgtgagcacagattaatacataagagttccttatattttacatgttaagcttttatcagatgtatggttttaaaatatttttcccatccataagttgtgaataatacattaaagccttacaataaaaaccaaatatttcttccactgtatatataaacagaaaacatgaatactttcagaatatttactcattataaaaatatgccaaattagtattattagcagtattatctatttgtatgtaacaactccagcagttaaaaattaaaaaaaaaaaaacacacattatttcatggaagagtcagtgaacttgtagagcaataaaaatcatacctggattaaataatcctaaataaggataatatttttgttacttatttcatacacaagtcagtataaacacttgaagaataaagcagaatcatgaatttatggattcagcatagtattcgggcatacaaatttcccaaattgccattttagatattgttataacaatatataaagtcactaaagcactttcttttgagttatctttgtattggtgagaattgcagtgatatctacataatataaggctttatattagaaatttaacatgaactcaccccagaaaaaaatttaagttgaaaaattaaaatgtagagtgagtatccctaatacaatgcagtctttgacttgttcttcatattactttcgagctcttctaaattgctctttagaaatcctggcttgcttcaaggtccatagtacctcactgtgactgcttaatgtctttaggtatcatgctcacttatttactcagaaaacatttaataagaatgttctgtgtgtcaggaacttttaaaaatcactaggcctacagcaatgagagatgaacagacagtacccctgacctggtagaacttacattgtagggagaagagacagaaaataaacacacaaaaagatacagttcatgatcaacatatcaaaattgtgaaaagtattggggaaaaaaacaaaggggtacggtgatggagagtgacaggtgggtcatgcaaagactctctaggaagatagaagttaaatggatacttgatatcagggagcaggctgaacatcagaattcccagaataagcaaatatcagagaggaaagtgttagaactggaggggagaacagagacagtagaatgcttaaagtgttccaggaacattgaaaggccagtaaagctgaaatggaataagggagaatgagaagagtagagggagccaagaagcagatcatacagggccttttagaagttgggaaataattccatgttaatggaaagccactggaaggtttccacagagaatgttgtgatctgaactatgttttaaaaggcttattctgactgctgagtggagaacatactgtgagagagcaaacatagaaggcagaatctggaaagtgaccacatcagtcatggaaccatcaggatgtaaatgaatgtagtactaataatggccacagaaagcaagttaagttcttataattagtggtgaaatgcattctctttggtgaagaaaatatgtaattaacagaaaaactttaaaaatcaaaacatcaggcccagcgcggctcactcctgaaatcccagcattttaggaggttgaggcaggtggattacaaggtcaggagatcgaaaccatcatggctaacacagcgaaaccccatctctgctaaaaatacaaaaaattagccaggcgtggtgtcacatgcctgtggtcccagctactggggagggcccccttttgaagttaaattatctgcatgtactgaggatgctgcttcattcctgcttcagggactgtgccacctctggacaatctctttacctctttttgtctatcttgttctcataaaattgtatttaatttgcttcagaagtgctttcaaaaacaggtgctctttgcaaagcactcttagattccccatcccgcaagtccagattcttctcatgtcaagtcactacgagaagaagaaactagataatgagccccatagttatataaatctcaagccacagtgcttgtcctagtaatatggtaactgcacagatggcagtcgtttggcatgcttcatatcccagttattctgaatcctaacctcacttctcagcatgtaaaatttgccataaccctattgactgaacacccaatgttgtatgcattcttatttttcattctaatggaaaggattattcttcctgaacccatccaagccttttattatgtgaattctttagtgtattttaattgtttgccttaagttatattcaaaatgcctccttttaatttagatgtttctatctttggcagggtttctattcccaattcaagtatgagaattactttgccttctttcttttgtcttctgttcaaatcttttaaattaaaaaaaaaaaaaactttacactggtagtgttagttttcggaaacctaaggtgtagctgagggttcttttaagtactgaaatcatcagtattttaagttgaaaaggaaaaggaaattagactctcatatcaaatatttgaaatggatatttgaagttagtagcccttgtaaaacattttgagagaagaatttggacgattaatgaaattagctacaaaacttaaactattattttcttttatcaaagaattttagtcttctagtatttagaatatccagattttcctttcaaaacataatttagttttttcatcctctaaagcttcatgaattcaagactttttctaagcaatgatatttttatttaaatctgcttaacttcctaccgaaccaaatgagaatatgatggctgaagttaagtttgacaatcaggagttctgaaacatgcctgcatctctaactagttgccttatgcctacaacaaagatattacataccttagcagttattatttttattaaagtgttttggattgtttaccttaaatatatttccaaatctccttttaattttgccagtttaataatacatacaactaaaatttacaaataaatgcaataaaaaaaaaggagttagttgtcctttctttttaaaccatccagaagaaaatggttcatgcaaatgtatcaggcaaatggatggtggaattgatttactgagttgaatctcaaattttgctaaatgattatcacaatcatgaaaaatttggcccaagatgaatgtttaactctcaaacatattcaattttgttacaatatatgtagattattatcttacctgccacatcctggactacttcatatagatagctccagggaaaaccccactttgtaggccagattatatctagggtgtgtttgtgtcattttttaaaaaaggaataatagcggacagttattctttttaaaattttttttattttaggtttgggcctacatgtgatgatttgttatatagacaaacatgtcacagacttttgttgtacacattattaggttggtgcaaaagtataatattacattacccaggtattaagctcagtaccccatagttaacttttctgctcctctccttcctcccacccttcccatcaagtggacgccagtgtctcttatttccttctttgttttcataagttctcataatttagctcccacttataggtgaaagcatgtggtatttgattttctgttcctgcattagctttctgaggatgatatcctccagctccatccgtgttcccacaagagacatgatctcgttcttttttatggctgcataatattccatggtatatatgtatcacattttctttatccagtctgtcattgatgggaatttatgttgattccatggctttgctattgtgaaaagtgctgcagtgaacatttgcatgcatgtatctctgtggcagaatgctttatatccctcagtgtgtatactcagtaatgggattgctggaccaaatggtacttctgcttttagctctttgaggaaccaccatactgttttccacaatggttgaactaatttacgcttctaccaacaatgtataagcatttccttttctctgcaaccttgccagcatctgttattttttaactttttaataatagtcattctgactggtgtaagatggtacctcgctgtggctttgatttgcatttctctaatgatcagtgatattgagcttttttgcatatgcttgttggacacatgtatgtcttcttttgagaagtgtctgttcatgtcctttgcccactttttaatggagtcgtttgtttttcttgtgtaaatttgtttaagttcgttatagatgctggattttagatctttgtcagatgcatagtttgcaaatactttctcctattctgtaggttttttgtttactctgctgatagtttatttttctttgcagaagctcttaagtttaattagatcccatttgtcaatgtttgcttttgttgtgaaaattgacatcattgtcatgaaatctttgcccattcctgtgtctaagatggtattgcctaggttgtcttccagggtttttatagttttgggttttacatttaagtctttatccatgttgagttgatttttgtatatggcataagaaaggggtccagcttcaatcttctgcatatggctagccagttattgcagcaccatttattgaacaggaagtcttttccccattgcttgtttttgtcagccttgtcaaagatcagatggtcgtagatgtgcaaccttatttctgggctctctattctgttccattggtctatgtgcctgttttggaatcagtaccatgctgttttggtcactgaagccttgtagtatagtttgaagaggggaatgtgatgccctcagctttcttctttttgcttatgatctccttggctatttggactctcttttggtttcatataaattttaaaataattttttctagaagaatgaagaatgtcaagaatgttattgatggattgataggaataacattgaatctgtaaattgctttgggcagtatagccattttaatgatactgattctttctatccatcagcatggcatgtttttccatttgtttgtgtcttccctgatttcattgagcagtgttttgtaattattttagagatcttccaccattctagttggctgtattcctaggtattttgtgtgtgtgtggcaattgtgaatgggattccctttctgatttggttctcagtttggttgttgatggtgtataggaatgctggtgatttttgtacattggttttgtacctagattattgagagtttttaagatgaagggatgttgaattttatcaaaagacttttctgaatctattgagataatcgtgggtttttttctttagttctgtttatatgatgaatcacatttattgatttgcatatgttgaaccagtcttgtatcctggggatgaagcctacttgataatggtgatttagtttttgacgtgctgctggatttggtttgcaagtattttgctaaggttagttgcatcgatgttcatcaaggatattggcctgaagtttttgttgttgttgtgtctctgccatgtttgggtgtcaagatgatgctggcctcatagaatgagttagggagaagtccctcctcctaatccttttggaagagtttctgtaggaatgataccagctctttatacatctggtagaattcacctatgaatcttttaggtcctcctgggcttttttgttgttgtttttagtaggttctttattactgatttaatttcagagctcattattggtcttttcaaggaatcaatttttttcctggttcagttttgggagggtgtgtatgtccaggagtttatccatctcttctaggttttagagtttgtgtgcatagggttgtttgcagtcatttctgatggtcatacttatatttctgtgggatcagtggtaacattcccttcatcatttctaattgggtttatttggcttttctctcttctattagtctagatagtggctaaactattttattacttttttcaaaaaaacaaactgctggattcattgaccttttgaatgtttttttgtgtcttaatttcctccagttcagctctgattttttgttatttctcatcttctcctagctttagggtttatttgctattgcttctctaattctttcagttgtaaagttacattgctaatttaagttcttcctaactttttgatgtgggcattttagtgctatgaattttcctcttaacactgccttagctatttcccagagattctggcatgttgtatctttgttctcattattttcaaataacttcttgatttatgccttaatttcagtatttacccaaaagccattcaggagcatgttgtttaatttctatgtaattgtctgggtttcagcaattttcattgtgttgatttctatttttattgtgctgtggtccaagagtatgtttggtgtgattttggttcctttacatttgttgaggactgttttatgtccaattatgtggtcaattttagagtatgtgccatgtggcaatgagaagaatgtatattctgttgcttttgggtggagatttctgtatagtctatcaggtccatttggtccaatgctgagtttaggtcctgaatatctttattgatattctgcctcaatgatctgtctaatactgtcagtggagtgttgaagtctcccactattattgtgtggggagtctatgtctctttgtaggtctctaggaacttgctttatgaatctgggtgttcctgtgttgagtgcatatatatttaggatagctaagtcttctcattgaattgaaacctttaccattatataatgcccttccttgtcttttttttttatctttgttggtttgaaatctgttttgtctgaaattaggattgcaactcctttttttctttttttttttctttctttttttgagacagagtttcactctgtcacccaggctggagtgcagtggtgcgatctcagctcagtgcaactttgcctcccagattcaagcaattctctgcctcagcctcccaagtagctgggattacaggcacccaccaccacgcctggctaatttgttgtatttttagtagagatgggttttcaccatcttggccaggctgatcttgaacctacctcgtgatccacccgccttggccccctaaagtgctgggattacagatgtgagccactgcacccggccccttctttttttcttttttccatttgcttggtagatttttttccatccctttattttgagcctacaagtgtcattatatctgaaatgggcctcttgaagacagcatacctttgggtcttgcttttttatccagcttgccactctgtgccttgtaagtggggttatttagcccatttacattcaaggttagtattaatatgtatggatttgaccctatcattgtgctgttagctggttattgtgttggcttgtttgtgtggttgctttatagtaaccctggtctgtgtgtttaagtgtgtttttgtattagctggtagtggtctttcctgtctatatttagtgctcctttcaagatctcttgtgtggtaatgaagtccctcaacatttgcttatctgaaaagcatcttatttctctttcacttaggaagcttagtttggctagatttgaaagtgttagttgaagatttttttttcttttctttaagaatgttgaatataggcccccaatctcttctggcttatagagtttcagctgagaggtccattcttagcctgactgagattcctttgtaggtgaccttctcttactctttagctgcctttaacattctttcatttcaaccttggaaaatctgatgattatgtatctaggggatggatgatcttcttgtgaagaatcttgcaggagttctcttaatttcctgaatttgactgttggcctctctagcaaggttggggaaattttcattgacaatatcctgaaatatattttccaagttgtttgttttctccccctccctttcaggaatgccactgattcatagatttggcctcttcacataatcccatacttcgcagatgttttgattatccctttttaatagttgttctttatttttgtctgactgtcttatttcacagaaccagtcttcaagttctgagattcttttctcagcttgttttattctgctgttaatacttgtgattgcattgtgacattcttgtgttattcagctctgtctgacccattagattcttttttgtactggctatgctgtccttcagctcctgtattgctttactgtgattctcattttccttggattggggtttgccatcctcctgaatctcagtatctttgttcctatccgtattatgaattctatttctgtcatttcagccagttgagtctggttaagaacaacttggcactcctaggctgcccactgaagctctagggaaatcttggtgtttatatttcttcttcagcttaggggcaacagaggaagacatcttattagtggttgtggtcaagtcatttgcttgactcctgagagtcagagagatgcatgtcaactcagtgcagtcagcaggtcatgcccagtgtagtcagcccaagatggaaggtttgtgctgagggcccaagccaggagttccctgtctggtgacaagccatgaagggtgtgtggatcccacaggagttggactgaccgcctctccttgggtcaactgcagcttgttggaggtgtggataaggcccttagggtctttgctccttcattagtctgaggatggcaagggctgttccactacagaggcagtggcagagaggctttcatttgcccctggaggctctgtcaaaggagttgctgagttggtactggcttgataactccagtgcaaggtggctgaagatccaggcttggaggacctgcccagtgaggagatatgagaacgggaacccatgtaacagtctggccacttttccatagggctgctgctgtatgcttggggcctgcttcagtccctagtcacctcggattttctggaacctggaggtatcaccagtgaagactgtgaaacagcaaagatggcatcctctctctccctctaggagctttgtcccagggaagtagggacatttttgccacccaaaggcatctgcatgaagtggctggagaccctagttgggaggtcctgtccagtgaggaggaataggatgaggacctgctttaaaaagcagtctgggcatgttttgataaagcagctgtgctgtgctgggggtccagtccacttcagcccccggtcacttcagatagccaaaggctggaacagctaagtcaccaacagcaaagatggtggcccacccttccctctgggagtgcagtcccagggggaattcagatctctgtcaactggagagctcaagcaggagaggctggaggtcccagttgggaggttccacccagtgaggaggaagaggattgagctcctgtttaaagcagcagtctggccacattttggtagcacagctatactgtgctggtggatccctttcacatctccaaagcctaaaggctagaatggccaaggcacccaaacagcaaagatggcagcccgcccctctctctgagagctccttcttagggattccaagccagtgggtcttatcatatgaggtgccatgaaagtggggtctgtgggctgttatggatcagccccatggcttcagcctcttatctaggggtatgtacaggagtctaagctcccactttgatggagctgcagctacttttgccagaaggcccaagtatctaaggctccagggtcttcacacatgcctgagcggctgctctgccaagactccacatagctatattggactgaagactgaaggtggagtgggttctcaaagagatctcctaacccaagggttgcaaagatctgtgggggaagcatggtttcccgggatcgcttattcactcatcacttccctgggcaggggatggtcccctggctccatgttgctcccaggtgagccattgtcttgtcttgtttttcttccctctctgtgagtcaggttgtttccttgattaatcccaatgcaagtacctggaagtttcagtgcaaggtgttatatttacttgcccttctgttcctctccctgagagccacagctcttagcatactagctgcttctagtcggctatcttggctactagtcaacagttattcttaagataaacattttccaagtggaaagttctattatgtattaaagattattgagagtacattatactccaaaaaatgtatttaccaaaaaaatgaccagtgttttccatatctttgaaacaacattggattggtaattggctttgtttgaactactttctcaggagttaccttattcctaatgtcccctaaagaaatgcaatgaggtacatttttatcaataccattagttttatatttgacagatgcaccaaaatatctggcctatctcaacaaacatatgtctattatcttattgattgatatgttttggctgtgtcctcaaccaaatctcattttaaattgtagttcccataatccccacacattgtgaaagggacctgctgagaggtaattgaatcatgggggcagtttccctcatcctattctcattatagtgagtaagttctcatatgatctgatggttttataaggtcttccccctttactcagctctcattcttctgcttcctgccaccatgtgaagaaggatgtgtttgcttccccttccaccatgattgtaagtttccttaggcctccccagccattctgaactgtaagtgaattaaacctctttcctttataaattaccccatctcgggtatctccttatagtaatgtgacaatggactaatacattgatttacgttggatagcttaatttctggactcatgacatctatattgtctgctctaataaagtctcacaactttttagcctcagtgtctttatttacctagattcaatgattgttgactttggttctacccttggttggctaaatgttttcatttgtttattttgtttcaagaacatttcattgtatgttttgcatgtttgagtgaaatttgccacttttatatttcatctgtatagtttccttacttgtagaagtgagataatatctcctgcttctaaaaattagtgtaagcagcttacgtagccacaggctcctggcccttggaagaagtgtaatttatttgtgttccttagtgcattagatagttgagcacaatgctgtggaggaatatctatcatctctgtaacgataatttggcctcatacatgaaaaaaattacggatgtctcagccctaaaccccaggtcatatggtcactgaatctccaactccatcatcaacttgtgtaaccttgggcaagtgttttccatactatgggcctcatttcctaatccttaaactggatcacctctcgcatattttcttgccacatacaatagtgtattattgaaaaatcacaagagaagacaaataaattaagctagtctctcacactaagaggggacagcatagtataaagttggggacattaatcaacttccatggttttatttctctgtaatatgggtataataatcatgtctacttcatagagttgttggaaaattatatccgctaaatcctgtaaaacacttaatgcctggcacataacattgcacaataaaagtcagcaattattagttccatgttataattttatgttcatgactttcagattagaattcaggaacattatagtcacatataagcatagcatttctgcatacttctgattctgtagaatatatcactttaaaaattcatgataccagaagactagctgacaagattctcccatttgggtctctattagtattctttccattgacttcccagtaacttaacttgtctaaaaatcttaactctccaaatcccctgttatttcgattctgtgtatttcatctcatccattttcccccggctttgtaagtccatccaaactcaagcaaagtagcttattattcttaccctcagggtaaagacttcaaaagtctcagcacattatctatgaaactcattctgcctgcatcttctctccttgtttgatcacataggcagcctctattccatctttaatatgtgcacataagccaaaccctttttaagatttttctagttcaatagtggttttgattttgtaatggcttctagagagcagtatcttggcatacgatgctagaagatacagttttgcaatagaaaatcttcaaattgattttatgttatcttctttgaaactgttcaccaactactacagaattgggaggtaaaggtgtcagtttgtaagtgaatgtggtaatgatttccttagtatcctagctgatctttggcaaaagcattcacgtataagtgctgtttatttctcttctttctttatttgcttatccatcatatttttaacatttttctcataagcacctacggccaagggtcttctaaagtttacctacttactgcatttgttctgagccacatattataaaaatatgatataaaacagcacatacatacaggatgttacgtatttttaaataaaggttaatttataaatcagatgaaatttaatctcaatgagcaatgatttgtaagctagactttttaaacttttctagtgaatataatgtttctggcaatttagcaagctacaagtttgaaaaaagaaatgcatcaaaggtcaagttgcccataaaagcattactgaaatgtcaaaaacaattacactgcacagaagaataaacccccaaagatattaaacatccatttatgaaaagtcttcttcatactgcagtttcatctcccaaactcatacatttgattatttccaaattttaatatgctacatagaattaatatattttaagcatagattatctctgaaagaaaaagaaaactatattttagaaaatgctgtattataaaggtttaggtaaaacataagcttatttattttaccagcttttatgaagtgcccataagaatgctcgtgcctggaagttatcatatgatgtagagaacatagactttggagtctgggaatatggactagaaatcctgcctttgtcactaaatagctggtaacttcgggcaaggagaaaagaattctttttgattctgtatttcaaatgccataaaatgtgattttacttcccacttgaattgccatattatcatgcttgaacacagtagctattcataagtattattttctttcctttcatccctggatgtaataatcagtgtataactaatagatttttaaacagtaaagcaacattgtaaaagaatgttagattattttacctggaactttagtcataggctgatttagattggggagaggtttgagtctctagttcaatcctgtcatttggggatttttgtggtccttgttttgttttgaaattataataaaaacagtgggaattaagagtggaggacttataaagaaatggttgattaaacccagaggttttatttatagtatttaacaaagtatttagtgacaaaggcacaggcactgaccaatcagaagagaggccatgaccagttggttttgtttttaaaactcaatatgtctttatccatgcagaccagcccacatcaactgactatttgtgccacattggcatcagaaaattgtatataatatctgtagcctaatgtaattatgtttcaattttagagactattttcttccttctataggagcaaaattcccactaacgtttatctgtacctgcttttagattttaggtaaaattatactaaggtgtattggtataaatctgtgtgtatgtgtgtgtgtgtttcttcagagcagtaattgtattttattgaatcataattaaatggtcctcctaacactcgtcaaaataccttataaactagatgatattacccccaaaggtttctattaggcaaccactaccataaaacttcattaccttctctgttcatagatgaccatgaaacaaaaaagagtccagtctggtttacttatggctctttaaaatacttaaataattgcttcaactcagagcatgagatgaacaacaaaaaagaactctttgaaacaaattaaaatggtacaatgggccaatattgtttaccttcaattaaataactatatgtaaattcaagttacaaatatgactaggagaatttggtttgaaccatcaactctttcttcttacatattggattttaaacaggaatgagcagacatagtagttcccacatactaatgcatcagaagcattagggacctttaaaaatgaataaccctaatatcttcccctgtccatccaattgagtagttctctgatggaactgaagataggatttttagaaacttcccatcaggtttgaaacgtgtgagctagactcattcttctatctttttcaagatctttgttctcgttgttctttaatttcaacgtatgttgactggttccagagttccatcttggcccatcccaaactcaccaactttttatcaggtcagatatgaacattttatagaactctctgccttgttttctgcaaatattcattaaccatgatttgatttggtttgattaatagacactttctttgtcaatcaacaagctaatgatgctttctgtatcagctatatacgttttattacaaattcttacaaatgttaataacgctgagacagccctgagcaacttttcataaatgctaactgttgatgaaatgggctgggagttcctaatacatgtgtggttcccaaggtggaagagaaccacttctgaccaacttatagagcacttcctccattgctgaaatttcattctccctaggattcttttcctgtgatctcctagcagacaactatgaagattaaagggtcagactgtgatttactcagctgcaggccttaggctagtctttacggttcaaagtttttgtgtttttacatggggttcatagaggatagagtgggaagttttggaaaagtttaatggtgatgattaattctttggattagattctgcttcaaagccttcccacatagaccagtctcctacatttatattgctcttcctcatttccaagcacttagcttcagttctctccaaatattgttcagatttcactgccttagaaatgttttcctttatgaactgtgccatctctagtcacttcatcaatccacaatctccatcagtgggtcaaaattttacactgtgtttactggtgcttgttttcgtgtgataaatatagaatgtgtaagtcatttggtcttactcatcctggcaagattccaaagtcaaatatagttatatttaagctatttcataatttccccattacccagtagacttgtttgcacactgtgatcttgtaataactgtctgtggaatatgtggtataactatactttctttttatttttatgaatctgaaagaaatcccaagcagtaggagtacagaaagagaggcagtaatcattgttttaagcaagaaaatttacaaattgaagttggtttttagcctagtccttaagagttgataaaggcacagagtcatcctcttccagtccatggggtcttttgcaccttttctggttgcaaatagaggatagaaaatggacttgctagacaaggtgtgtcaagtgggggcagatggcggaatgtctctaaaacacaacagacgtgaatgcatgcttgatcaggagaaccacagagaatcattagagggtgtaatgtagtcacagcagtgtggctggcaagctatttggctgataatttgcaggacagattggaagtgtgaagacccctcagagaaaaaagtgtgagataaccaagacttaagaatagaaagaaagaaagaaaaagccactcaaagggctcacccaaaaagagcgttgcaaggctccacgagggactaacttgagattagaactcataagcttccttagtgtgatggagggcaaagctggagagatcaacacaggagctgtatttcatcccagagtaaacggaattctgttgaagcacttgatgtggaaccatctatttatgtaagctcttaaattaattaagccaataaattctgatgaatgtgactatttgggtgattgtattgattaactcttcaaatgactatgatatataatttatcttatttagtagcataattcctctcattaagtactgtaatatagctcagtgtaactgtatcatagcacttccagaaaacatttgtttttcttcctgctagaagatgcctgagaagatttgatgaccaaatgtagctgtgtatagctgtttaaattacagttttgaaaagttcatgttaattacgtagtccagagagaaaggggactaaaggaactttatagaatgccatgtgtcttagtactcctactgatcactgtgagctaaatattgtgtagtacaactttcagtccaaatttttaattgaagcccaaagatacttagaacccaactctaaataatttataaaatatggactataaaatttaacaatcaaaaattacgtaagttagcttttcctaggatttctggatttcctcgcaaccttagcactttaacaaaaggaaaaatgcaaaattactgaatgatgaagatcatactctgagtctagtacaatgtatatacctgtaactttccacaagtccacacataagcaaaattcggaaaaaatgattaagtacatcaaatcaagtgaattggaacacagtggggtttagaatggagcagatccatttctgtagtagtatgggagggatggtcaactcctccacagatgagtgatgaaaatagcctcatgctgctgtcatattgaacaaactttatgtgccaataaaaatttttctcagttaatatgaatgggaataccataagtactattattagcttccattaagattaagtaagttttagaatagttaaattatctgctcaagggcacattagtggtaagtgggaagccagaatttgaactagttactaaaaaactaaatgtggagcacatgaaaattaacattttaggtcatttcaagcttaaaaacaactgagaggaatgaaatcacaagaaagaactattcaagaatgaagatataaaatgaataactggggaaaaaaggaataaaacatttttcacacctttattcaaaatacatgtgcatttgattatacccatactgtacactcagagaacatgcacatgtaccatgatagttggcattaaacaggagcagaagtcatgagtctcatgtcaaagcttacagagtacacacataccctttttgtctgtctaacctcaagtgaaatccttaaccagagttattaggaagggaagtcatagatgttttaataaaatttgtttgcctaatgccctgcttactaagtgggcaacttatatcatgggtgggttaaattcaatgaaataagaaaatgcaaagttatgattggatttagccctaaattttcatcatgtatttaaaggtcatgttatttactgcactttgttaaaatgggttctatctccggaatgaagtcaaatgtgatattattgattacaacaaagcctgggctggaaagtgggtgctatcagaagaaggaagacagccttttaccccagcatcacctattcattttgctagggtcatgaaggaaaaatatgaacataaatatatgaacagaaacttgagattttaaaaagtgacagggaagagagcatagtggaaacataggcaaacttattgtgaataaaaagggttttgaaaatgaaatccctgaaaataattgtatcatactgtgaagactcccaggtttcttaaagatatttaaaaatcaataggtaaatatatatgtgggggaaaaaagagaaacctaaagataatatatcattataaattgaatatcaagggtttgttaaagttgtaccagacaaagctaaactagcaaagaaaagtgtatttgagattattaaaacaggagaagattgaactcaactcttgcagtaatatttttaaatactggagtgacctagtggaaaaagtgctagaggacgttagggggtggggtgaacagtgggatatgccaagcacattgggttattcctgagtttgcaaatgcttttctctatgattagtccatctgtgtttgccaattaatgcctatagaagttaggtacctgccctcctacagagactgggagctcagagcactatttccctcaatgttaaaatttcaaagacccagttcctatttccttgagaaagataattcctggtttgcaaaactggcaagaggctgggagaagatttacatacattacaaaggggcagagaaagaattacaattgcaagtttcctaaaataagtcctttaagaaaaaagaggtcaggggcctatagccaggaagaaatctgcctaatgcttaatcaagctgaagtgaatttcaaggccttcttggttaggttctagtaagccaacaattagaaatgtataaacaccagtgcttttttcttttgcagaaaagcaatataggttctggcattttaggttcactttttcccctcatccaacaaatatttactgtgaaactctaaaataacagtgactacaccaaggactaaaagatactgaataagacaaactctctggccagaaggttctcataggctaatggaagtaaaggtgagtgaacagggaatgagaaaaagttttaaaagtgacatgtctgcaatgctatgggagcagacagggcagagcacaactccatctggggcatttgagaaagtcaaataatgttcacagaggaagaaaaccgagtcctaaaggaagacagcgagagatggggacaccaggcatgaagaacagtgtttgcaaaatggcagaggagtgaaaaagcagcatgtcagttcatggaaaaatgaaagctttctgtggatagaatgtagagaaaacgtgaggcaatgacagaagatttctattttctttgttctagtgaggaagttggttttcagctaatatatattggagagactatagtattcagacttagattttagaaacagacccttgggatacaagggaaatgagatacaacagaatcccaggggaaagtgtgcaaagatttggaagagaaaatggattcgagatttgtaaaatcaggctcactacctggatatggtagcaaaaataatgcagggattaaaattgacttggaaactttctatttaaaatgaagcaatatgtagcttcattttgagaaggggagtgaagaatgaggcataagtctcagttcatgggtcttcttcagtaagctgagggtgattctggacctacataccttatggttgttagagagttcagataagatggttatatgaaaatgttttctagaaaggtccatgcaaatatgagactccattttttccctctttaattcttttgtaaacttttattggttatcaataaataaatatataaagactatcactctcaaaagtcaatgtgaatttttaagataatttctgaagaacacaaaacatatcaaaaactcagtaataattatcggagttactccggattttgtatagatctggcaagagaaatctaatctcaaaattacaatcctgggatctctctaaataatgtgctttttaatcttggctctgtgtctggtccctctctgcttcaatttctcctttctgcttacaattccattatgttgtgagttgcaattttacaggggaggtgctttgcacatagcactgttgtgactgttaaaatcaaccataaaagttgcacatttctatgatttaaaaaaaaatcaggataactcaagaggcgtttagagaataggcagaacattgacatagttttgctgtgtccccacccaaatctcaccttgaattgtaataatccccacgtgtcaagggtggggccaggtggagataattaaataatggtgtcggtctcccccatgatgttctcatggtagtgaataattctcatgagatctggtagtttttttcaatgggagttcccctgcacaagctctcttgcctgccaccatgtaaggcatgcctttccttcttctctgtcttctaccatgattgtgaggcctttccagccatgtggaactgtaagtccattaaacctctttttctttataaattacccagtcttgggtatatcttgattagcagcatgaaaatggactaatacaaatatgtgtatattttgcattaaaatacaattgattgtatgtttaatgtattaatttttgcattcttgctcaattgctaaaccaaagaaacattgaaactataaaaaccttgataaaccatggtttatcttttatgttttatttaggctctaacacgataaatgcaataaactttcagtatatacttttaccaaggaaaaagactatccactgatctcagttctcattttgtgtttctatggtagtcttcatgaatttttatagtaattatcttgagcagatgttttagtctcttatcctgataataagagatacagtcgaataaaaaggaatagtttaggagagctcatgagagtgtggtggcattcatgaaaatagaccaaacaagggaacgtttaggggtgactttaaaatgtcaaaatacatgtttaagtttattagaatagtggattatgaaaacattttcttaaaattacatttttgaagaaagataaatggaggaatacaaatataaacatttaaatctcattttgagtttacaaaaataaaccaaagcattttcattttatatctcaacctctttcgtagggtattccaaataagtttaaatagtatatgcttcagttaaggcctcaaagtaaggtgtaaattgtaaaatgtagacaatggttcatttagtctgttttataaatgttctgtattttggcaggtttgtttataatgcctagacctttgtgggtgagaaaaacaaagttatataaatgcaaagcaatcctttgaaaccatttatgtttgtaaatgtatgccaaaaaagatagtatatttaatatgaatacacgaagagaagcataaggaggattctaaatgtttgtgacatcacagtcaaaatctagctaagaaattgtcctcagagagactaaagaagaaaaacaagttgcgttggttcatacctacaccagtgatagaactacacaaatcacagtagtgataatcagatgtgtctgtccagatttaatgggatgcacacttggataatcaaagtctcaaatagttctatagtggggacatctggtggatgaatatgtcctaactgtggggctgctgatatgaaaaagtggaattcccatagtgctaggcagcaaaacttccatttctccaaatagaggagtataaattaacctgatatttagatatgtgcgtgtttaatgtactcctatatatactctgaagtaatgttatgcaaaacagttcttatccaatcaaaataaagtgtatcaatccaaaacaaaatttaatgtgaggaagagggatgaaattattttctgctactcttgtaagaccttaagagtagagtaagttcttataagtaagattcaattaaccttataagtaagataaaattaatagcctcaaaaagtggctggaattgacaagttatgaagttgcctgtaatagccattgacccaactttttatttgattttatttgcctatggtttcccagatgacttatgcctggaatgctgaagatttagcttaaaaagaagacagctcctaagggttccaattagctgagttgattaaagcattcattgaaagcaaaatcaaaaatttaattattccatattctcatagatcagttgctgtttgttcaatggctatgagccaaaacatgtcccactggactcatcaacaatgcatgtctttgtatttgaagcactgtgtggctggcaacatgcatcactgtgttgacaaacaacttgagagtgcctgtttcttgacttctttggaggcaaagccttatctattatttactgccttggcatcctcagttctccaccaagaagaaccccaatctagttcaaaagcagattggggtattggtgaaaactcatttcaattctctgttcctttagtcaaacttttgctatttgagaaagataacttaacctttttgagtctcaatttcttttaaagtaaaaaatagatagtaatactgatgtcaaaaggttattgtgagaattagctgaggtgatgtatacaacattcatacattcttagcatagtgcctgacagaagatgggcattcagcaactattcattgaataaatgttttcagccatggatactctgtgtgaagagaagtataaggagaatctccacagagaagcaaatgctattaggtatgaagtccagatgaatttgttttacatacctgcctgtcaagagacaatctggttctaatcaaaccagaagacaataaatggagaaaaattctagagcattgtttcttagatttgatatgcatagaaattacctggggatcttttaagaatgaaggttgagtctgggtgcggtggctcatgcctgtaatcccagcactttgggaggctgaggcaggcagatcatgaggtcaggagttcgagaccagcctggccagtatggtgaaaccccttctctgctaaaaatacaaaaatgagccgggcatggtggtgcatgcctgtagtcccagctacatgggaggctgaggcaggagaatcgcttgaccctgggaggtggaggttgcagtaagccaagatctcaccactgcgttgcagcctgggcaacagagtgagactccgtctccacaaaaaaaaaaaaaaaaaaaaaaaaaaaaaaattaaggttgtgattcagtgggttgagtctgagaggctgcatttccagcaaactccaggggatgcatgtgctgctatccactaaatacactttcgggaggccctagagcactcgaatgcatgacaagaaatactgtgcttagatctctatttgtctagaccaacattctatttcctagcacaacttaaaatttatgtatttatttaacaaaaaatgatttagtgcttcctacgtgtcgggcactattctaggttctaagtatgaagtagcaaccaagacagatacggataacaccctcatttagtctagtgatagtcagacaataaacatattaaccaattaattaaaatagtttctagtggtgattaaaagtataatgaaaataaactgaagtgactgggagagtgtgtatggtcaatgaaatctcctctaggaaggagaaaattgaactgaaacctgaatgttgaaaaacaggattctgtgtaagacctgaaattttcatacaaagtgaagagaaagtgcaaaactgctgagacaacaatgggcttcgtttgcaggaggaaagggaaaaaagtcattatggccagaacataaagcttcaacctaaatgtgagacagtgatcagaacagtaaaaagggacaagatcatacctggaagggttggggatggtacagaaatcattctaaaaccatcagggaaatctcagatgttggatcttagatgggtcttaatagctccacagaggattaagggtggtagaaggagtgatcctacaggaaagtacacctggccaagcagaacaagatgattgaaaaagagctaaaataagatatgggacacaaactgggcggatggggggcagggggagtgcggaaaaaagcataacttagaagaaaggtcaaaattgcacatttctttggtttacatgacaacaaacaaaaatgcattacttacgctaggcaagctaatctaatggcacccttgtagcaaagtctgcattgccacagaataaatatttttctgaatagaaaagattaggtaactattagaggataaataaaaatatgacgtttgttagctatagactttagccccaaacttttcttgctttccacagaatattggaaacaaaagtgagagaaggtagatggtacaataaaagacagcagtgaagaaaataagatataagagagcaccccttgcactaagaaaaagcctagtagaaaaaagagtcatcattattatgtcaagtgtaaaatattaaatgccttatacaataatgattttcatactctacctatgtacctatatatctactatctgtttagtacatttttttaattgggatacatgccaaaacccaacaccaataaaaacaaaatttgagagctcccacagattagagtagctaaataagaatgaataataaaatatttactcaattgcaattttaatgagccttctttacttactagtgagtaagtctaatgatttaaggccttgcaatgtaatggctattaacacgtaggtgcattccaattgacttctgatttttgtctcatgattaaaggctctgcaagctagtagctattaacatattagagcatttgcaatttactctgattttctgtcttgtttttaaagcatatgaataaaggagtgtacattaaaatgatgctcctaactccccaagtgagaaacagcttggactattttgttcagtagcctctgtaaggaatggcaaggtgagtcaccctttctcacctgaatgcctaatgcgaggcacacactttttatatattcacccagaattatgattatattctgtgccaaaatagcaggttaatttttgtttgattgtgtatgatttcattctgttctgttcccttgacctcgttaaccacctatattaatcaactaaaccatagagttcagactttttctcctaccctgttttggttattctgttggttgtttttggcatttattaacagcaacaatgttttgtttctcattggccttttatatatctcatttcacgcattcagcaaatattaaataagtgtccatttttgggccaatctctagagtgtcaagggcaaaatgagggagtgaagtgagatgaggctaggaagagaaacacagcgaggtcatttgaggtcgaggtcttgtaaacttgaaaaatctgccctttatcttaagagcaacagggaactaatgaaaaatattaagcactggagtgacatcacattacttctgccatttgtttgttttctattgtttccctccctctccaactgggatcaccttaagcagtgactttataatgttatcccatcatttacatttcctgtctatttccaactaacaaacaattttttacgaaagaagaaggttgccaattgtatgaaaataactactctgagagacacaagagagtttgtaaatagacacctattagttggttcatgaaaacatatgatagatgctatggatagagtcattatttgtaaatcatagctcatctccaaaaaagaaagaggggacatgctttgttgatgctccttattacaacttaagagtacaagtataaaaattagtacttaatgggcaggtgtctgtggcataagaatcgtctcagcaatgtgcttgatataccctgataatgaaagaagcctcatttagggtcatgagtgtatatgtgtgtatatatgcttgttcctggtgttctattaacatctggctatagtaggcaatccctcttttggctacgtttttttaagtaagagcaaaagaaagataatgtaacttatctgggtgcccatctggtttaaattgctcattttacattaatttaacaataatagctgttggtggtcatgttttccccaggagaagaagttgacagacagctgtgcagagatgccatcttccccatccctgtggcctgtgatgccccatgcccgaaagactgtgtgctcagcacatggtctacgtggtcctcctgctcacacacctgctcagggaaaacgacagaagggaaacagatacgagcacgatccattctggcctatgcgggtgaagaaggtgagtcgccagcttcagacgccatctaggttcgtttcaaaagttagtgtgcatcttttttgtgtagcctggaaaagatgatattctatgaaagtcaacaaccagaaattcagccatccaagatttaatatctgttgatgtgttgagcaatttgattctgtcccccaaaattaatcttgaaaatggatctctaacaaaggagaaagactttttaaaagtgaactcattttgctttttcccacccttccagtcattagagttctttgtaaaccaaagtgttaggcctttaagaaggtctgaaaatggctcccaaaatttcagatgtttcattgtttttttctgaatttcagaagtcagttttatcttttgaaaatcatattctaccttctcataaataagtatatatatccaatcataaagtttatttaaaatcacaagaatagctactgttcgaccaaaaattgcaattttcagtttctttgagtttcttgaacataggctccgaggtccagaaatctcatatgtaaattttgttcatttttaaaatatgttgctcctaaatctcttcaccctatagggtgaataaagcatgtttgtcacatattcagacctcacttgcaagctttattgccaagaaatacaaggctcttggtaattgtctctcaagatgatatccaaatgctaatttggcttctgtgtgactgggtaatataatgtcatacttaatcttgtctttctgaaaaataacacaagagtgagaaaagcataaaagtaaatcaagtttgttcatattaaggcatgttctttctcaagaatataagtgtatgttatttaaacattatcaagctaaatgactctttgttcacatttagcactgataaataattatttctatttgtaataagcataacattttatgttttccccaaattatcgatttggggggagttttgtgttgcctatactttttctatttttctgttcatgaagtattttagtgatagaaacatagtgttcctagtcaaatttgctatctgtgtgtgtaacaactgtgcacacctataattaccttggcctttgcacatgagtgttacatgcgtaaaacattttacacacagaaaagccaacctgtgtgaaattttagaattttctttatagtgttcaaaaactttttcctaccaccttaatatatatttaactctttgctccaaaaaaaaagtgtatctattgaaaaatacaaccttttacaaagaaaattatatttcttgtgttgtcaaacaatgactctaacctcgtgaagattgtatgaaggctttaaactctatcagctcagattttgccttgggcttcattaaaattagatctgtggtcaccctgcttcctgtaaattcattatactctgcagacacttgctgtgtgactactaatgaatgacttttcaccccaccccgagtcacatggcaaggattttgccatgcttgcagaactcaccagatcattattcctgtagacatgatgcttcacacggaaaggtcatgaaatgttttaaaggcagaaatttgtgattgctctttgatatgtatcatccactgagtttgaaagggtagggcttcaataatttttaattaagtttagtggttgcattataagcaagtcatgctggaaagttatagatgtttatatagtaaatcataagggcattaattcaaaacaatatagttctgttttaattgacgtgtaataattgtatatatagggtgcagtgtgatgtatcaatatatggataaattgtgtaataatcaaatcaagataattagcatatctatcacctcagacatttatcatttcttttagcaagggcatagagaatcctctcttccagctattttgaaatatataatacattattgtaaaacatggaagccataaaagaaactctgtcaatgctatttgtctctgctgctatttacctctgttaataacatttataaaagctggtataattatgtgaaatttatacttcaaagcctatttagtacctattagtggacactgaaacatgttttatgagaaatttgtacttcaaagcctacttagtacctattatttgttggacactgaaacacattttctcttactcaaaataaatctttcctaattctgaactatttttaatgatttaggaacagcatctgcaggaagttttaaaatgtgtttctctgccacttagataatcctttgtaattctacacaaaagtcagtctttccattattcttcaagaattagtgctttgtgtcataaatgttcttaaatttctgtggatcagacactgattgtgataactttaaaggaaagtgccacatttgagaaatgatatatgaagtgtttaaacaagaaattatatgattttctagggaaataacatacaggacaagtccatgcgaaaagtagatctggatttatgaaataaatgctccaacctatactttcacttatcttaatcagaatgccaccattaaacaatactgaaggctggataactccttgtaattaataaggatagactaggttgtgcttcagtaatggacagcccagacattcaggagcttaaagaacaaagctttatttacttcttcctcatggaaatttagctacagttttgggtaactctacagggcaatttgtccttcatgaaatgtcacaatattgcatcaccatatgaagacctggttccacaatcttcatgtgccagaggaagaaaatacttggagaatctatctgtcgattttaagcatcagcaagtaaattctcccatctaagagtgatttatgtcatttctcacgtttcattgttaatgtaagttgtataactatgcctaacttcaaggcgaatgagggaaatataatcctattgtgtgctaaaatgagaggagtattgactagtactcttacccctgatttactcagtgttcttattgtgtatcagtgtgtatatatgtatgtatgtatctatctatcgatggccccaatccagtagataaaacagggctcctaacattgtgaaaatgttaggattaattatttttgttcctcttaaatgaatgacagaatgatagaatggcactttctcttcctcatactgcacttcttttctttcttttccttttgcttttccttttgcttttccttttcctttctttcacttccttttattgctaggctctttttctcctttcctgaacaattctatccaaaaagccatttggtaaagccaagcagctgggcatctgtgccagcagataggaggtctgttggtgatctagagtgggttgtcagagcccaactgggtgaggagcaaccaaagtgggaaaagaggtggcctggcatgcattttcagagccagtgagcagggtgaaggacagggggcacatgggttgtatgagaggatagaagagtgactctacactggatgtcagagcatagctgggtcaagagagaattccagcatcaaggtggccagcccagtatggggtgtcacagccagacacagttgaggagtgtttctgtcatgtgggtggcctcatgtaggatgtcagatcatgagcagagtaatgaagatatcttgtgggtatagcaatggagataacaatgggtaatggagtgtgaagtgagagggaattgacaaaataagtacatgtatttaacatagtgagagttggtttttttattgctggagaagagagttgcaaatatgttaggaaagaaaactagtacactctgtggtacagcattggaattggatgttattaatttatttgaattcatggtgttcaatttgtaaagataaatatagaataaacatcaatgtaagtgtgcaaatataaatatgtacatattatatacatatagacatatattagcctcattcactgaaaagacctgagagcagcaagacctcaacagaagtaagtagctgcagcagtcagatcttggtttctaatactattgtctaacaaaaggaacaagggaaactttgagaaatggctgattccacagctgcaatagaagaagtacaagatgggccaggaggatcttgtggtagaaagtaaagagaattgtcaaaaggccacagaagccaacttgaatgttctcccactgaccacatttgcaaacaattttaatgacaaaataataataccaacagaccattaaataggaaaccatggatccacatattatataaataaataaaggaataaattcaatctcattaaaagcattgtagttatatagtctcaaatatttccctaatagagaagtctgacagacacccccttaatctggtgaccaaagttagcattatcaataatgaagcaaaccaaaatcttgtgtcctcagtatgatataatgagaatacgatatcatttctgtaataactctatcaaagatgcatatatagaatctagtcatgaggaaacatcagataaactctaattggaagacattgtacaaaataatctttaatcttccaaagtgtctaagccatgaaaatgaagaaacaattgaaaaactgttcaagatttaaggagactaacaaagtgtgacatctaaatgtaatgcttgattctgaactaaatcatcttgctgtaaaggacattttgggacagttggcaaacttgaatgcagtctgaggattcaatggtcataacttatctgtttatattctgatttttggattttgaatatttaattgcttatgtataggagaatgctcttgatcataggaagtacacactaacatagttagggtgatggacatcgtttcatctttttccaagtggtccaggaaaagaaaagtatttatatcatacttttaatttcactgtaattttgaaattagttcagaattaaacatgaaaatgaatttgtatataatcgctttctacactatctttttttttttttttttctctgagacggagtctctctctgttgaccaggctggagtgcagtggcccgatcttggctcactgcaacctccacctcccaggctcaagcgattctcctgcctcagcctcctgaatagctgggattacaggagcaccaccatgcctgactaattttttgtattttagtagagacaaggtttcaccgtgctgcccagggtggtcccaaactcctgagctcaggcaatctgcccaccttggccccctaaagtgctggaagtacaggcacgagccactgtacctggtgctttctacacaatcttgagtaacattatataatctattatcaatacacaaaaattgtcataaaattgctaattattgaaatgtcatttggaaaccaaatcacaagtactggcaactggtgatagttaatgtactggagaaggtaaaattagttctttacacttaaaaaaatggtgtgtgtgtgtgtgtgtgtgtgtgtgtgtgtgtgtgtgtgtgtatcttccagaggcttgacttctggttaaataaaagtgattcactttttaatattcttgccttaacgtataaatattgtataaactgtaggaattgtctcaaaaaatattttaaagttatgttaggaaattctaaagggaggcaacattttaatacttaagcctggcatatttttaatataaatagttgaatttgaacaaaaagttaaaaattaatgttagacttttagctttaccaattttttgaacctgtattgtagatcctaacaagtttcatttaaaaaggaaaaggttattttttaaatggttcccactgggtatacaatttgttaactctcatgatatagttaattattcttacagagcaaaaaaaaaaaaaaaaaaaggaaagtatttatttttgttaagttcaatatgacctgatagaacttcatcaaccaaatattaatgtctttgcacctgtcttatacaagcagagaatagatgcagatggaaataaattatgtcatttttttctcaaataattatcttcagaagtcatattttacaatgcaaaacattgagaagaatatttttatttaacttgttcaatttttacagctaaatgattttaattatagtaaccaggtagtacccatattccctagaaaaatttgaagaatgcaggattcattacatgtatgcatatatatgttatatatatgttatatatgttatatatatgttatatacatatatgttatatatacatatatgttatatatatacttataaccctgatttctaagtaaataccatcacttccccattctcccactattgaccttgaaaagagagttctgcttcaatctgtcactacttgaccaccacacaggacttacgcaggcttcacggtggacagtcttctgcctgtttctgcaaagaaaaaccgggaggtggggctgtgctgccgcagaatctcctgaagtaccccacagctaatgctgttccaattcggtacccccaaagcatatccttgccaatgcacttttcacccagcagtggtctgctgtcaaaggaattcaggctacaatagcaggaaacgttagaagcaccttaaaagtataatttatagtattatgataatagtactcttcacactaatagcttctttataacataagcccagtctactttcttattcttgttgccaattactttctgatgtgaactctacactccaattgactatgtcaatattgttaattgccaaggtcacacctgcctgcatgcctttgcttctgtttatttatttttctacttagatactattctcttttccttctgtcccttcccagaattctgcttattgaaatcctactccttcaaaatttttctcagtgcctctttcaatctgaggcattcttcagactccaaaaagtagtgaaattgtactccttgaatcccagttatactaaataccgcacaatataattatttcattctatctagaattatactcatttgtatccttatctcccctactacttttccctactacattatgagatccttgagtgtagcagaaactatttttaacccctgtaggtatcccttgaagcatctcacataaatattgcgtgtatttatgaacttgatgtggggaagaaaagtcactttttatttctaagccatgttaattccaaagaacagagtatggtaaggttcctgttggcaccgtatctaatttgctatcattgtccatgtttttaggtggaattcgctgtccaaatagcagtgctttgcaagaagtacgaagctgtaatgagcatccttgcacagtgtaccactggcaaactggtccctggggccagtgcattgaggacacctcagtatcgtccttcaacacaactacgacttggaatggggaggcctcctgctctgtcggcatgcagacaagaaaagtcatctgtgtgcgagtcaatgtgggccaagtgggacccaaaaagtaagagctttagaatgacaacagtaaatcgtgtagccacctgtgcagaggattggctcaggcttcactggcttcatgaaatggaacattttgatgcttgtcatacctgtcctcaagagcaagatttgtttgttttgaaagtcagccactgataaagctataacagctttgagttttatactggggaaccataaattctgtagaaatctttctatctggtgcctactctctgttttatagtagcactttctgcttttattaagctagtgaggcaatgaaagaagtgcttgccgtaagcctggctgatcaataatgacagtgtactaggtcctggcagtgtaggtcatccatgacctcctatatacccgtaggctacggaggctgcccaatctagtttaattgggtagaagccttgtatgatctgcctttcatttcccctagaaaacactatatcaaaaataccgaagcatacttactgcgtctttcaatggttagagtaaaaaccatttacttccaagagagagccttgggataggatgagtgttattataagtagaaaaactatcattttctcagggtgcttttgagtactataataacagggcaaacactttgctggaggggagaacaaagaaccagagagtcgacatattatatgtgccttgtgagaagtataaacaaaaataatggcataactgagctaatcacttcatagagaaaattaataaatctactctaaaaaattgaggggaaaaagctttatttttcaaaacttaacatactttttaaaaattcaaatcaccttagccatgtaagatatgaaatgataaatgagtcgatttttgcatgggtttaaaagtggcctcatatttactaaatactcagccaagtggttaaatattgtgtgtaatcttcagcgtgctacctaacttactctggccaacagtttttgcagtctgttgaaaggatttaatgaaacatataatagtaatctaagcactcaataaatgttagaaattggtctttttcttaagaatttcagctactccttagtgttccaagaaaatgaaaataatgtctctgatgcatgaaaaactccagggaaacaaatatgaatcccattatgagatgtttgtgtctggccagggttccagacattagggatattttgccccacaatttatttttttatattgcttgaaattaggaaacacagaagacatgccagtgagatttgaataaattgaaagactatttcacatgtttaataggtaacctcaaaccaatattttaatagaaattttgctaaagctgtgatgaatctaactcaggaaattaatgtacagtgtattaaaattcaaaagtggtaacagcaagagcagatgtcccaagtcctggaggattctgactcttgctggatcaagaacaaaggtagaaatattcactacgcaggcacaggaccaacctgttgtggcgcaggatgagggttattgtgctgagcttctaccagtgagctcattctgttcctgtcccacggttaatcacctttcaaatgttgctgttttgacattttcctcacttacataagctacaaaatatttttcctgagtaatggatgtacatatgtacacgcctatatgtgaaagagcctgctggattaacagcattaaatcagtgggaagggtatcctgaagccccatgtgatactaccacaataattcattaaaaatttgcttcacccttgcagccttcattcaatgacttatgtgcatctatagacttgttaaatcaaatggatgtactttacctctcaaattctagaaaatcaagcaaatactgtgaattcaaaagaaaatattattgcctttctccctacatgctaggttaaattcagtgaattctttctaatactaggtatatgaaccaaaaaatgcaaattgaaaatttgttttaaacttctcttaataaaacagattactgtgcaatggtaaaatcaatgttattgatcttatctgtcctcccggtaacaaacttcagttcctatcacatctgtttaatttgaccttgaataagatttggggggaaatcaatttcttgatttaaaccacaaacactaaatacaaacagtacaaaggataaaagaagcctgctgactgaaccaattgccttgccaaaggaagtccaaattcattttattggatgtaatttaggctgtataatttatctttgtgtgttcatttaacaactttgttgtttgtaattttgttctccacagtcagccaagtatcttgctgtgactatttctcaactaaaacagaatatttggaggttgtcaatgataacattgtaaatttcattgatttattcagggctaatatctgaggagcatgcaactgagtaatgctctctcattgttaaagttataaaattgccttattgaacaaaagtgctgacaataataattactgaccaataatttcatagttccaaaagaattaactgaattatatgtggagttttgccatataatgtttcctggttaagaatgcaggttaaattgtaattctactgatttataatctaacatgtaataataaatttgcttctatgattcaaatctaaatttatttgttgtccgtgactttgaatagtcatagaaattagggaaattccagcgcaagataaatcaaaaagattatttttgaaatgttgaatccttaaatattttaaaatccacttccaaataaacactggggttttaaagtaagagaggagagcattgatctatataattgaataaagcatagtatctatgtatgaagaagaaaatttacataaatacttataatacaagatatgtcaaaaatgaagtatcagcaaaatactataaagaaattatgggaaatagattaatgatgttgacttttttcactcgtagttcacttctgaaaacctgattaacttacttgacaaaagacaaacttgagctacaaaatatttgaattctcttatatagagtattttaaaatcctatttcccactgatctgccaatttattttagcaagaactatactagttgtttagattattttttcattgcctgttagcttacatggcagggatttatatgacttcaaaagagaattgcttaggaatcagaataagttatttgttacttttaattatatgaatgatattattatattttacttttctaagctacatctttttctagtgttaaggctcattatcagcatttgacctctagcaatagtagcatcagattgtaaaaatgcagagaagaattgggaaatttaaaaattattacttctcagccttttggctaagctcaagtgtaaaaaattatatactaagtatattttgaataagacagtatatttaaaacctatacatcagcttcctattatctcttaagaagtgaaagcttatatgaagttagacatttcagtgttcttcatccttatctttctgttgtgttcccaataaataatatatttttgctgttattttgaaaatagtagttaattttactataatttatgtcaaaaatacagtattttagttttctttactgatttactatctttatttatcttcactgtttttgtttcaaaaaagatattgtagtttataaaaacataaaaaagattaaatcccatcatttaaaactagggactaatggaaaagaaaacacaaatagatgcactaaataaaagcaggaataaagcaaaaactgcttatcagattgatttatacagttttattatcttaattattattaaatatgtagtttttaatacagtattgtgttttgagcatgtactgtgtaaagaacatactccactataaatttattttatacaatacatattttgtaaaaataaattgtagaataacctggaaacttataataggcaaaaggcctagtcatacaaatatgtatcatagaattagatccttaaattaataatttaaattttcacaaaatttttcttaaaacatattagaatataaatacttattaatggagagattataagaggataaggtataagtgttatatttgtttctaaatagcattattggtattagtaaatctgcacatctttccttgagaggctttattgaggtccggtttgaaacaatcaatttagttgtatagttcttgcctgtagcagaaagaaagactcctggaagttaaataatacagatgagtgacttgttttgcaattttaccagtgaaaattctagagaaattaaattatctgattttctgctttactattgaagcctaataattcccctttgcctttctagatgtcctgaaagccttcgacctgaaactgtaaggccttgtctgcttccttgtaagaaggactgtattgtgaccccatatagtgactggacatcatgcccctcttcgtgtaaagaaggtatggtctgcagagttaggaaggctgttcacctagaaaacctcctcggtagacttctgaggtcttctggcctagcaatgtttgtgagttttgcacagggctatgtaaacctgatttgacatgcatgccataaaatgttagtttccctctaggaaataacatagctttagaataccagacaagtgaggtttatgccaaaacctggcttgaaattttatgatatagattaaagtgaaggattctaaatcttattgtattaatagtgtttactttcacattagttctgaaggaatatatcgtggtatatgtatttcaaaatgatatacagtgcttttatcagtacacatggctttcatcctacttaatggcaaaaaataacatgggaccagatttgctacagattcaattatgcagccccaagaataggaataaaagaaagagaaaaatggccaaattgtttctctgccagcatgtaatgtgtcatgaggaatttatgaatatttattcccagtttggcttagttttgcttttattacttacagacaaagactcgttagtatcaagccaaatactttgataattctttcttcaccctctaggtcagggtcttttctcattgctgatgagaaaggtatcaacatcctccaggtgacttatgcaataactgagcaaattttcctgcagtgttacaaatgacgctgtctcctatttcttatcttactcaacaaatacagataattttttctaaatttcctgtatgcttttatttttttcatgtttcttaacacttactagagagattcaattaagagtcaacttctagcttaacaaactattttaagttgtcaaaatttaatcaaatcctttaggtattatacatttaataatggatacttttactgtgttactatatttttatatagttgaaacatgattttccttttgatggttttctatttaatacccttgaaatatccaataaaattaaaccacacttagaagtgatagaaaattattattattctttattttattttatttttaagatagagtctctcactctgtcatccaggctggagtacagtggctcaatttcggcccattgcaacctcagcctcctgggttcaagcaattcttgtgcctcagcctcccaagtcactgagactataggcacatgccaccacacctggctaatttttgtatttttagtagagatgggtttgtgccattttggccaggctggtctagaactcctggcctcaagtgatccacccatctcagcctcccaaagtgctgagattacaggcacgagccactgcaaaatatttttatttaggagtcttttaagacatttaaatagcttttggcaaattaaaaggagttataagcattaacttttataaacatgttaatggcatgaacttgctatgcagtgtcattgcctgacattttaatccagattttcctctcttattcctttttttttttttaagctgaataacaccggtcacagttggcagtagaattgtactttcttatagattaatattttacctatgatggcacttataggtggtaattgttggttattaattaattcaattaaaaagcattaattacatagaattaatacacttacaaattttgttcttgatgcctttatacttgatcttttctgtttatatggaatatgttcatttactaataattccaagcatgtgcagttacatttataagcaaattgttaatagtctaaaacaaattttaagtgaaaattttgaaagtggaaagactttgcctttcccttattttggatattttcttgtattgtgtaaattactcttttaaaaaagttgatttgatctaaagtatttcaaggaagtaaagtttaaaaaagaacagaaaatattttattaaattgattccagagtagtcactaataaaagtgaagaatcagaatttttctcatttctttagacctttatttgaaaataattttggatattggaatgtatccaggaattaggaaccattttaatagcctataaattttttcttaagttcttgaaaacacatttgtgattttgttacgtattatatacatctggaaaggaaagaaaaaatagaggttttttaggagtaaaaaaccatacttgaaaagaaaataacatgatttttaaatttgtgatttttacagtatgaagaaactgatttgctctttgctgtttgatcatttataaaataaaaaatctaaaacactgtgataactcacataaagcacttttaaaaacttcttagcagatagatgagaatgaatagattgtgaatgctacataggtcttaattgagtcagtacttatttgtgtatatatgtataaatacttatttaattacttatttattgatttttgtatataactagcacactaatggtcatatagagaaatcacagtcccagacatcaaggaagcttttaattgcatttaacatatagaactcttctgcacagcccagataatgtaagacttacatggttcaataacaaaatttaatggtaaaacacaaagagctctaaggaagggaatggaataatcatgtcagagcaaatatattaagaaaaatcatactgaaaaggaggtacaagagatcttcttgaaagatgaaccacatgaaagaattgcaagtgaggattggagacatcaggaaagccttaaatgactgtgagaaagatgtgattttggaacgaccagcccactggagcccaagatgtgaaggaaactttcccagaagagactgaagatgagagatcatgtgttccagtgggcgcagcggtagaagggctagaggatgtaaaggaatgaaaaactgaatcgtgttatgcgggtagatagtgctgtgggtccgggtgatgatgaatgacctggagctggggagggctcatttcttgtggtgagtggcaggcatgtgaggcataatgggtttagttgggttggtctcttgggggaaggtaggaaacctctgtaagtaaaaatgcatggtaccactaggatactattctctcctggtgttcctgagatggtggtggcaagagagtgcaaaaatgccaactcgggaatcggctctcttagaagcaagaggctctctaagcggcagagcagtgtttccctgaacacaggtcatgtcatccggagcaaggaatgagtgctgactgttttatttggcagctcatgttgtttctcctagaacaaaaggttttcagaaaccctaaacctaggcactccgatttttaaaaaatcacctcagttgggtatttgaggaaataaaaattttttaaagactggagagtgatagaagggtcattgttggataacagtgccaagatgctttgtgctctagaagcagttttttctgttttgcctgtagactgctgtaactgagaataaggagacaatggtgttacagaaagctagccttttgttgtgaagaaaataaagtaaatggcatgaggttagtttttttcattatttcataagaaatggaaataacccaagtatcattttgaaattacaccaatttacacacaccatttaaaaatgctaagcaaagttgaatgttcaaagagaggtaatagcaacagaaaattaattcaaagttggggtggttctttttacttaattctgcgagtaaagtctaaattttacaaagatgttgggcttattaaagtgcaggactatccttctttttaaaatcactttaaggaagtcaaatacacaatactattgcacaaaataaaacagaatagtaggattccaggaagaactaaaagagttgtttgaaatgttattcagccttcttctaaaataccccttgaaaaatcaatgctgataaagatcagtattaagtggagtgtagtttaatcctgagaccagtgcacttgctaacgtgtttttcaaatttttgtaaattttgacagagggcattttaaaaaatagaaataccttatgcacataaattatttgtacctctaattttaaaaaatcaatacttttgatcaaataatatatttggttgctcaaattctgtttgctccttttttttctcactgcatttattgtgttgagaaatagaaggaatattgcagaggcttcttcctcatgtcctaaatcactagagcactagaattaccaccaaagatctgaatactacctttacattttgcttcttggatgagacatttccctttcaatttcctattactgtactgcttcaacctgcaatccatcccatatccagtttaatgaatcagttttgcctgccttttaaatccttttcatcaagtaatttctcggtgaaatttattttgaatgtcttaagatatctgaaaaaatgctataactgtgtgagagattacatatcttctgaatctgtgtaccccatcatcacatgattatttgctagatgtacgatctgttttttccattcctatcctggataggcatttttaagcacaaacgtcacaggcaggtgcccttatttttcgcgtacttgttatttccaatgaaaacaaagtgatagcttatttttattaatccttaatgcacagcattggtacctgtgcgcttaccactataaaggaataagtggaaagaaatagaaggtgctaactaataatccagttgagaagatgtgaaataaatgtgtttgtgcgttcagcaaatatttattaagcacttactatatgtgactcttgtcttaggtataaaacacacagatgaatagaaacactacaaatatatcaaccgcatataataaaatgagcataaatacaagcaggggatgatgaaaggtataaaattcccagtttgccagctcaagttattaatgatgaaactttcattttttgtttttaatgtgtgctgtatagcttcctttttttctgctctctgatctgaggactgtataacctggcaaagctctacagcgctgtaactttgagtacacaagcaatttcttaactgcaatatgagaagaaacagacctgccaatgggtaaaaacatagatgtcattgacacttcctgtgtaaccccattaaacgtcttctctgggtgtcatatctttgaagagttccacttgaatcaggtcacaatctctatcctgtaggctgtaccaggttaaggaatttgaacttttcataagaataaatggattgccactctggaatccattaaggacgtgaagagagtcatcatagtcttatatatctagtactaatttgtggagtttgtgatgagaaggcattaggagaatgtttcagaaatgtattctaagtgacattttttctttcaaatcaacaaacaaaatagaattgaaacattaatgtttggtagctgcttcctcaagtagaacagccctggctatgcaccaggtgccatctaggtagttaataagtaggagctttagtctatgaggtgccactaatgctgaactcattgtctccaccagcccccaaatcccctggtcttaatcctgtgtctgtcctctatctgcagattggagagtaattgcctctaagaattttgaccaactgggaaacaaaaacccatttgagccctttacgtcttacctccccattaaaaaacaaaacagaaacctccctgcttcccccaatgttaaacaaatgtgagtctaattagtttgtatactttaaaaaaaaaagattatggacagttcatacacataaaacaaaagaaaaaaatagaaattgtaaaagaagggcaaatccaggtagtgaataggaagggggtagaaggaagagggagagaaaaattatgctagaaaatcaaagctgtggcaagctccttcaactgagaagaaaattagctctgagattctggtgaccaaagcaaaaaatagaagtacaatggattctttacagattgtcaagggagacagaattttccctagctctgaattattaaaggaatttatcacctgggccttaaaatacaggtcattttgacaatataatagatggagactgcattagcaatttattaaaagtcctgttgacatttcttagatcttccctagataaattatatttaacatgtaaaagttgcagctggcattcaaactactgctacaattaaaagtccatgacaatattttcaaatactttaattctctgctgcccaatacttctagcccccaattccctactccattacctgtagtatcccgcttattcattaaaatagttatgccatcattaatagtacagacgacaccccacaacgggaataataattctaaaaagttacatgtaagcccagaatcttacattgggataggtcatacaaggtcgtgtattacagtagatttcaaaccaggcccttcatcccaaatacctggcaagatttttaaatatcctattcccaaacccagcttccagattctgatttagtagtcctgggtataggcccagaaatttgttgttgttgttgttaaagagattctcctatgaagtcagccatttactgatccattctcccatccaatacagaaatcctctctaaacatggcagtgagtcagttgcccagaccgtgttgaagaatatctttgactgaatgagaaaggatattccattatggcaatgttctaatcatcaaatcatactttctccaccaccacagtatcttttaaaaaggtttcatttgatttctgattaaacattaattgttaggagctgctaatcctttaaaatatttctgttcctgtagtctatgtatgaaatatttgaagatcttgcaaaataatgaaaatgcatcaggaggattctattaacataattctttagagaattattttgtaagtaaaaccctgtgccatgcagctattcatcgttaaagtgtacgtaatcttaattgaaatatattttattaaagttggcaagttttatacgctacatgatctgtatactaaaagatttttgaatccttacatcagtcatactgtcaagttgatgtctttattgaaagtgtatcttaattttttccatttttaacatactttagagttacttatttatagtaattattgctattttgactgcttctctaaaaagtctgtgtctgcctctaagaaaccactttcattttactacttagatccctaatgtttagaatgtgacctgaattgaaggtcttagactgtctaacatgaataataaatgaccggaataatttacaagttatgcatttcaaattaaatgaataacaaagaaataaaatttcacattatagcactgaatatattctcctaaagaagattcattacatgtgtatgagtcccatgtgataaacagggctaggcaaaatagcatgacaatgaatttaaggtagaggaaaataaattaattagatctgtcatattcctcaagggaaagaattatacaaaagagcaattactttgtgactgcaccttaggaaggctaactgcctacagaactgttttctccattcttcacattttctctatttttaaatatgaattgattgggtttttgatataaatggtctttgggagaatttagtgaatgtttagaccaggtgaagcctctcagggatgtcaaagcacatgtagctggaggcaatgtaatttcttcacacagactggtatttagagattatctcatcagtgtaaagtacagaggttaaaaaactgcttcattgcaggggactccagtatcaggaagcagtctaggcatcgggtcatcattcagctgccagccaacgggggccgagactgcacagatcccctctatgaagagaaggcctgtgaggcacctcaagcgtgccaaagctacaggtagggttagagaaatgcatcgtgagggaggagctgaacaaatacgtcaactccacatcctttcctaggataaggaaaggaagtcaacactgttccttccacaggctcaatggagttgggatgtttatggctgtagctgccattcttgtctcttcagcagagctgctgtgctactgaaatgatgtacaagaaggcaaatatttgtgtaaacttccaaggtgacgtgttagctccagtagtttggggaaatgtcttatgttgatataacatacaagaaatgctgaaaagtgattaataattatgaaacatgtatactttaggaagaaattctttttcacttagaagactagcctaagcattactcccctgctccaaagagcacctgtttgtaatcataaatgctcacattctggctcaggaaatgacatctgtatctcaatgatgctggtaagatggctgttctgttcatttgtgatcacctcaaataaaattgtagttatcgaagctatatatcatcttgataatttgttagagaaattttacctccttatgattaagacagaaattatctaatagaaatctgacgtatacatttgcagtcctgacagcaaatgaagtattatggcatcaattaatgaaaaatgtaatcacaaaataaatatttaagatgacattgtcaaatttggcatcttaatatatcaatctttaattctgagatgacaaatactataattgtatacttacaccatgcacattgacaactactggttcaaacttatttatttttggaatttgtttttgtaaagcatattatacttacagttgctgagatactcctacaatgctaaccaaaagagcactatacaaaagactcatgacttgaatacagtttcataacttgaataaaataaatatacattatttaaatggcatgcatcacttctggggccatctggtgcatttgttggcagtcctaatcattaaaaagtctaaatgttctctgtagagtcctatagaacttgacaatgatgtactcttgtcttcactgccagagaaagtacttttatatttaatgttacttcttctaaagcctagatggagatctaaattaaatttagatagaactgagcattgctaaataactgtgtttgcagtggtcaaagtcatgtttccatgctgctgtgtctctgtgatttgctggcatttttgcttcttccccactgggcttctgttcctgtcttgtaggtggaagactcacaaatggcgcagatgccaattagtcccttggagcgtgcaacaagacagccctggagcacaggaaggctgtgggcctgggcgacaggcaagaggtgggaggccccattccacagttcatttctccagcatcgctagtttaactactgttttgatgcatttgccacttggacaccatgcttagcaaacagagcaaagcagatataaatctgctatgagccattccacaaaacatcaggacatagaaacatgtctttttaaattgttcccattgttctttggcattagctcataattcttgaatttttctctcatttatgtctgaaagaaagtcaggccaagctttcacttatgacataaatggtacactgaagcttttttgtttgtttgtttgtttgtttgtttttagattacggtatccacagcattttgcttgccaccgtaataagcaataagattcttacctccttgcctatatgcattatatatgtgcatacatacaatgtaatagaattagttaactttttcagaagttctcagaatgacatctctttcattttcatggctatccacaattctgttcatatttagtactgatttttaaatggcagacttatttacttaattacaatctgcaccactaaataacgtggaatcttgcagaaatgggtaatgagaatgttcaactttgccataattatttactagatattatagggaatatagaaactcaagatttggaatatgttgtttcttccagacatagcaaattcagtctttaaagagcacatgattatttttactcatattgacttatagcatacagctcctgctgcgtatttaaaatgtagcataatacataattgaatatgcgagcaactttaatttataaaaaacgtattttgctctcccatgtgtagttacgtatttcatgttgacacaaaaatttgaagatgtagagcagaattccagtttttgctgatttgatctgggacttcattttctgtacagtgaaaaaaaactgcctttttaagaaaaaaatgcttctgttttgtaaaaaaaaaaaaaaaaaaaaaaaaaaaaaaaaaaaatcccctgtttttataatcttccttttagaagtcttcttctggaacataaaacttagtttccaaataatcttaaattgctagttgcagtagtttttaggattttattttatttgcataattctcattatgtatctcccaccatcaactttgggtaaaacataactgtgactccctttacagttatagagacttaagtatatagaactgaaagtcgttctcctccatttcaaatcattctttaagaaattgagtgatatgagatcttcttgtcatgccctgctaactccttcttgaatcaggcattgatttgcatatattttgggttctatatagaggttataatgaaaatgagcatgagtttgggaatcaggaaacataagttttagtctccattcttttactaatacagtgtgtcttactcatcccttcaccttctggacctcaatttatttagattaaaaaaaaagaggggtttggaccaaatgatattttaggattattcaaattttcataatagatgcacaaacaatacccagagatcaaaatgtgaaataaaattaggtaaagcagatgaaaaccatatctttataaaacaccactggaggaaatacaagatcagtagaagcagcacaagtgtgaaaacagcctcagttccaaacaatgacgtataagctgcacaaccttggatgattcatttcctccctttaaggctaagaacacaaaagccttagagtagttggcacatgctgtcttcattaaacgttaatttcttccctcttcctgtttgttcataacccaagtgaatgtatgcatatgggccttttgggttttgacacacaatctgtacaaaaactattctgtctgtgattaccagcaacctttgcatttccaaatcggaaaactgttcgttcttcatcctgggtggccaccttgtagtagtgaatacttgttacccactccctctgtgataaaagggtctttagcatcttcagtgtgcgactttctcctatctttctgattgttccatttttgatttcctattactggtgtctctttctctgcctgtacttacatagtgcttcctaatcttggcatatttgtcaaacaacttgctgtacctcagcaatcttatccattttcaggatatctgggaagtgaaagttgcattataacaagtgatatattcataaatatatttagaacaatccctttaacttccatatgaagacagtctttttctttgtttcctgagtagatgaaagactgctttttcgtacagcttatatttctatagaaacatgaagtggagaatcttaagaatgtagaagtatcttttactaattgcaagaagacaaaattttcttcctttgatggtcgtggctgttttcagaactccatattatttactcgccaagttcttgctattttcatctttatccttacttatatggtcagagacttaaataaaaaaatgaacttgtgctatttttatgacaaaaataattatatagtaaacattaaatcaatcaacaaagactatagagaagctgctctctgtcccccctagcacatcagaatttctcatttcaattactcattccactgtttttgcatttggaagactgtagaaaaagctataaatgttaggaaagaatgaagatctttaaaccagagagcttatattttttaggaaaattagatcactgttaatgtcacctaacaagaattaaagactgaaacttatcaattgcaaagccaatcatttgaagctgaagagctgaggaaagacttaaagtacgggttgggacttgacttgtaccataatattagaagaagtagagaggataaaagaatacaagataagatcaattctataagctaagtgtttgaggtaagaaaaacaaaaacattaaatgtgttcacagaaaagtgggtggattgagctctgaagatgtgatctggagcctggggtgattttgtggaaggctataaatgtcaagatcagtattttagaccttgttcgataagtggtatgagcaaggacctgatgaaagcagtgttttatctgtcagcgtgtacagaataaattagaaagataagacacatgggcctgaatgccagctagtatgctgctgtagcagtgcaaggttgaagtcatagaaacaacagtaatatgaaataggcaaaaataaataaattgtggacatacgatagagggaaatattttggggacttagtagcagacaatagaagagagataaaaataaaagagtcaaagttgatcatatgactctttaactctaacatttttaatttaagaatagttatattggtgaaaattctaggtctaaaagtagagctaattttggaaagtatattttatacagtttatatttgaggccatggcagggttagccaagtggaaatattcaggtatgcacttgaaatgtagaaatgtagctgtagagatagcataagatggcagatggaaatttgggtaacatttccatagagtgaattgctgaagttataaaaaagctaagaactctaaaatgcaacttttattatatatatgaataaaagcgattataccttatcattaatagatttcttttttctctaacaagtttgcacttgtagattctttaagcatttcttttaaagaatttaacttaaatgttattaactttaaattattgtgtccttgtactcccacttgaataatatcatgtaactaagatatgagatagctaactttaccattgtatgattctagagatagaaatgtttacttcatgacttttatcaatctatatgtccataccaggagtcagtaaactatatggcctgtgagctaaatccagtccgcagcctgtttttttgtaattagttttatcagaacacagccacagccatttttttacatattgcctatggctgctttcatgatacaaggcacaattgagtagttaggacagacccatatggcctacaaagccaaaaataattaccatgtagtcttttacagaaaaaaattgctgacccttgatctaaacccaaaagccatgtaaccaatgatgtagtcagaacttctaataatactgaatagtcattacccaataggatcagaaaatccctggaatttatcttgtcagttgggaagatgtatacaaattcaattcagcaataaaagaactattttatagttatgaaagtagtagattttaaagactgggacaatagtaaaatatctgcctttaaggatgaaattgcagcattctttttgggggaggttaggaataaaatgttgactctaagaactttagtagtaaaaattaaaattaaaaaggggctaaaggtgaaaccagaaaatacatgggctatggaagacaagagagaaaaacattccagccttcaaaattcccttgtctagaacatgataaattatactcaaaagctggacattcagagttaatttactaagtacacatagaaaagagagaatgtgtgtgtctcatataatatgtgccattcagcccaacacttaaaaggtcacctattatgattcagttcttctccaacgtctggacccttccatattgatagaaaaatgtaacacaaattccttcttatcaccttactagccatgcctcctaggcctgcacctacttttaaccacctgttaacaataaaataaagtggcctttatagacatactttcatttttactcttaatactattaatagcataatttttcaaattggaggaactatctgtgatgacatatttcaaaagatttgggaagcaattgtgttcccagagcctctttaaaaattgtaaactgtttacttatgatctcagcactgacattcgctctaaagcaaatttgtgagaatcatccttattcagaaatgagttaaagcaacacaggaataagaatataggtagagtctcttctaatcaagtaaatgcagtcttgataaaatctatattttatatatgtcaaaactatatgaaaagtttttctgatctattatattagaacacaaagtactttaaaagaaaatttatatattcctgaaagtttgaaaagcacataggaattttttatttatgacccaattcctttacatttaaaaggaaaagtggcataatgctgaagcagaattttatatcaattatccccagaatcaccagtaatttttgcccaatcttctctaaattgaattagctactctgctacataaaatgggtattttctttaagttcatcaagtgtttctgtagaaacattagaaatcttttctaaaacaaatgcttaaaatgttgtgttgatagttttatcaggattcttgggcttctataacaaaacactatagatcaagtagcttaaacaaaaatttatttctcacagttctggtgcatgtgaaggtcaaggtgccagccaatttggttcttgacgaagacctatttcctgacttgcagacagtcatcttctcactgtgctgttacatggcagagaaaaaacaaggcagagagagaaagcaaggggagtgagagagagagagacagagagagaaagtgcactcaggtctcatctgagaagggcattaatcccgtcataggaacctcacactcatgacctcaccttcaaataccaccatcacattggtgatttcaacatgtggatctgagggagatacaactcagtatatagcaatagtgcaggatccgaacttttaaataaaattcctatcatcttagtgtacagagctatatgtttgttaatattatgctctttcagaaagctgtgaaaacaggtaactcaaatttctaaaaaccaatccaaactttctgaatataattcaatataatacattctctcataaatatttattgaatgcatgctacatatttcacattgccttcatggtactaggcccagcctcttgagatattaaaaatgtataacaaatagattcagttaacttagtatggtagaaaatatactataggtatacatgacttgggttacaagtcataataatacagtagtagtgtatatacacaataatcactgaagaattgaaaaaaaaaaaagagataaccactgatacggcatagtgaaagagacacagcatttaaatataggatgactcaagcaaaaaggcaagaagtaaaatctttatgtttaggaacagctcattgaccagtttgcctagggttcctgtgagtgagttagaggcaaggggcaaggatagttttgtttttctttttctcattaaaaaaatgagaagtagtgaaggatttttacaaggctttgggtattgagaatgttatattccaggaaattttgtataatggcataagaagtaaaaagagagaggaaaaagagaaatttttaaagaagacattgacacgatttggcaactttaaaatttgaatcattcttaaatctcatatggaaattttagaggatctttgaaataggcatcttccctataaaattgtcaataaaagagaaatgcaaataacatgaagtatggccatatttcattttaactttgaagtgaatagacagcttatattttcttcatactattcaagtcactagtgtataaactttgaatagaactgtaacctccactgtcttttctctctgttcatatttatacagttcagatggtatttagaaggctgaattattggtcagtggctatgtaattgaaacctagccataataactatggatagaattgccattaaatttgcattagaaatatatgaccataatgtcaattttggatgctttgtttattcttttctttacaactgccctaagaagcaatgtcaataactacttcttcaatgtgtatcattccagtgtttattactttgtgacatgtttctacgaagagtagaatttttaaaagttgcaaagattcaaggtagacatatcacataaatgatggtaaattttctcttgctcaatcttcatgttgataatcatgccaagtgtacttgctgtagattagatggaactagagttaatattttctagggtctaccccgtctagcctaatctaatagcccctctgttttcttgcctgccaaggaacatctgttgtaatgtcactggtcactaaaatctgacatcagtctctttagatggaagccaacataatttggatgcattcttgaatctagaccacaaaaaagaaaaatacttcaataatataccttgcataggagaggtcctcctggccctaggagtcctcaccctgtgtcacttattggtttaaaaagattacaaaaggagagtccttaaaaaaaaaaaaaggtaaaagaaaaattctaattctcccctattaaacttaaatctaaatgtggaatgtgcaatacaataatttaactatattttatgctcttattttttgtgaacaaatatgcttaagttacatggtttaatctatgttgatgggccttgcttcaccctttgctgaaaactctgacccactttgctctttttttaaaggttacattttagaggcattattgaggttaggctcataatatctgggccaatttatcctggcagggcacattatctgttaattgtcaaaagagagttcttcaatagaaagaaaaagaagtggaaaaagaactaggtaggaaaaagagaaggagcttgctttaaggaaattttatacagacgtaatttttaatctcttttttggctgatatatttattagttattacccaggttttatactctgcagttatatataccattatttaaaacttctagaattatttatattttaaaatgtttaacttcctatgaatattagcatcctcgttaatttggggttttgggtttcgttttatatctctctgggagatctgtcataaaatgcttattaacatttgccattttttaaatagtagctcataaaataagcttggcaccgtgctgggtctgtgattgttcttggatgctccatgtgttctgatgcagttaacccttcccagatcccaactggggatcttagccaacctcagtctcagctactccactgggaactgattattatttcctagtaagttctcatcctagtattctcacatatattataagcatcagtgagactggggatcattggtaactatttaggatcaatcaaaaatgaaggtacatttctttccattgtgccagggctacactcaacaaattgtagttaggaactataatttggcaaacttgccagtgaaaatctcttttacacagagaaagaccaggatcattatatctacctagtaaacaactggagccctcttggattatttataggtttgatcttatttctaagcacaattaggtctcttggtaactagctcacactcacattaagctttttcttcttcatttctacatgattcattctcgctattgccatttttttcataaaaccataggagaaaatcactcatctaattacttaatgagctgatcatcttctgtctctaatgctacccagacactagtgtagtggtataaaccatgttaatattgttcagtttaataataaggtcacagagctctttgaccatttgctacatataatccaacagctttcactgcactaaggcattgatcctattctgtttcctgtaatgaacttctatgtgcccattttggatcaggcaatttatttcattctgattattcaaacaaaatgagtgcatggccttacacgctgaagggtaattcactgagcaatagaacaccttcttcttgtgaaacctgaataataaggaaatttcattcctcttcaaaaatgaagatgagcaattacactcagaattccatttgatctgcttcagagctgcatcagtagccttccatttacacatccatgtatgcataacacagatatccatgtcctcttagctcagccagtgttatctattcccttttagtccatgaacctttattatttttctctttaaaacatagcttgaaactcaatttacgtgaaaacattctagaattaactttacttattcaacttactaatctttttaatttaaacttatgggaagtttcaaagatacacaaaagtagagggactaatataatgagtactagcaatgtagtcatcatttactcagcttcagcagtttttaacatgttgctattcttggtcgtctgtccacacacttaaaaagaattttgctggagtattttaaagcaacttccaagtaagatatatatcatccataaatacttgagcatttttaacataacaatagcattataattagcaattctttcaaactatctaatacttttatctaataatttttctccattgtctcaaaaatgtttatgcatagtttgttcaaactgaggttccaaaaggtctccacgttgcatttggttcgtgtatttcttaggtcacttttaatctgacaacagttatagctccctttttcatagcatgtatttgttgaagaaacttctcttatttatctttacagcattttcccaatattgatgggctaagcttgtttaagttgattcatatgtaacccacaaatcagtcatattgattcttcccgtgctttcagtctgccaggagcagcctgtcctatatcacttaaataaaaattgctgtgctttatataaatacaataaataaatgaagtaaatggatataattaacagagttaaatatggaattttactttaaaataatcatcttgatttttgcggatctcactgagaagctttcatggtgaattatctgtagggtaacatgactttttcccatcttgctaacaatgcttcagctcaaaggagaacttgtgtcatcattagatatgacatatacatgcttcacctgtaaatacagatacaaattttctgggtatatgtagttttctggtgtgctaagaaactgtgctcttagtatgatccatcttttctactattcaaatcaccctgttttcagtgtttcagaaatgatttttaagatccataaagttgagagaccagatggtttcctttccaaacatttatattttcctcgccctagtatcaggaagttcatttcagattgtatttctgtgtttgaattgtgtttcctctaagtcagaatacaaacaagttgagatgtaggataaattttcagtatattgtacagattgtgctgttgctgcttgtttggataacattgtatgagtaatttattccaaaagtacactgtctaaaacctcagataagaggtgtaaagtgcagagtgagaatagctatgggaattttacacaatttttttttcttttcaactagctagagtacttaagattttatgtagtgcaggtatatggggaaaagggattccagtttatgtgaatagtatagatctgcacaaaataaattgtttctggaattgtattggtagtagtgttattttattttgtttttctttttggtgtcacataacaggataatggttggagcaattctgaaacaaaatttgtaagaaagacccttaagagagaacctaagtcagtttcatctaatttctcaaaagatttatattgaagtctgtttcaaagagctaaatggaatgagtaggtaaaagtagtctcatttcaaataacccaaatttagtttggtaatttttaattttcttttagttacaaacagtgaaaccctcttcacagcttacgattctcatatgatcagatgtcttattttccaaatatatcattcttgaggctcttgcatgtcctgattagtaaaaagtttaatatctttctctttatcaatttttttagcatccttggggcaactttgtccatgaaccatcggcacttactaagtttagagtgtctgaaagggtcaatcctgcttccaaatggcaggtgtagaaagaacttcaaaatcatagcagctcgtttatagcctgcatctcgaggatttctcctacactgtgttacagatgatgttcttctaaactatatggatgttcttttttatctattccctgtacaaatttctatcatgcccttcctttgaactccaagcttagagctctttcagttcatacaatgttcagccattgtttcccaaagcttggcatggtaccaggctgattaggtaccaaaggattttctgtcttagccatatgtgtttgccagaacccttcctgtaccttgaatactcaagctggtgggtctcaaacttgaatctgcgtaaggatcacctgagcatcttgaaaaaaatgcatattcctgaccccatagcaggtatctcattatctggattggtccagattatggaactctttttgggtccagggatcttcatgtttaatagcattctaggtgtttctgatgcaggtgaaaatatattacctactagagcagtagttctcatatagcttggataattaaatcatcagaaagcttaaaaagtatcctaaatcccaggaccccaacctcaaccagggaaatcagagcattagagtttagtaagggcataggtattttccaaaggttatccaggggattataatctgcagccagacatgagaaccaccatcttagactgctatgattaaacagagtaccagatgtgtcctccctcaagggggtagattctctttgagacacttaatgttttttatttgtttctgtcatctaaccttcatcaaggccaacactgttcaccctaccaggattttcatatttttaaaaatttaggggcccctgttcttttcttacaaactggcccttccaaagtcaagtcatgtgtactaaatgaaaagcacatctaaagctaagaaatagggaagtgcatccacaattgaacaatttagaagggccttttatgttaggcctgaagcagttgcattaagttgtgttcaactacacagagaaaatcttgccttgctaaaattgctagttatgtccatttacacactctattacaaagccctgcactcctaggcaataggttttagtacacagatccagacggtgttgtctaacctgaggccctctatgccctcactgtaatttaaggtcaaaaacgtcaggctccttcacctcgatttcatggtgatggaatcctgaacagggcagagatcagcggcagtttcagcctagaccataaacctgaaaaagccaagtaaatcaatctgaatgaggccatttaagataattcagtgaagccaactttaggaccaaggtttaatgtttcatctgcttcctcaataagtgagttgtttttaaaaccaatggaaaggaaatggcatagggagaaagtgggctttaaacatgcttgctctttttctttaagacttgttaccataaaacactcatatgtatatgttcaataggtaaaaatattatttctcattttaagtcagcagaacaatatcataggcgaaataatttttatgaatttaaactttgattttttaaatttatatgtaattttagaactacaaattttaacataataaatgaagattattgaaaatttttaagtgccaggttgatgtttgtgcatgtgaagaacttgtagaaagaggagatggaggactttgacattgcttatccattaatgattccaacccttcctaataaacttgaaatgtaatacagtgaacatacttcccatgccaatgcagtttcaagataagttctataagcacaccttcctgaccccaaactccaacctaccaaccagctttctgccactaaaacacttctataaaggaattctagggtgtccaatgatataaaacaatattagatatacctagtatcttccagtccctctccaaacaccctatgctcaacataagctattatcagaacccacgtatggtttgtcttacattcttacaaatttatttctaaatataccctacatgtgacatgaattgaaaccctgaatacatataattaaaactggtaaatgctaagtatgcatatgtgtccacttttctgtgccacaaaaatcactcagggttgtgtgttatttttaaaaataaccaatttaatggctactgggattattagaaacactcctataagatttctactgtaagtaaggaactacaagaggctttctctgactgcttaaccaaatgttaggttagcttctaaattatagagtaattagacgtttgaatttgttataacagctttatgcttttcttttagccattacttgtcgcaagcaagatggaggacaggctggaatccatgagtgcctacagtatgcaggccctgtgccagcccttacccaggcctgccagatcccctgccaggatgactgtcaattgaccagctggtccaagttttcttcatgcaatggagactgtggtgcagttaggaccagaaagcgcactcttgttggtaagaataattgggatgccaaagccagtacacgtcaaagtagaggaacataatacaagtcagactgagagaattctgacagtgtatttgaaaaataatatgccaatggatttagatgtatattttaaatttagctggcagtgataaaagcattatgtacttttagtaaaaagaaaaggaaggcttgaaaattgaactctgactccctatataatatgcagtggattattttctggtgtagacataatcttttagtggactgcctgcagactgtaaagtgcttggagcaaagtttttggggaacaagagaaaaagttgctactttgttaacccattctcactgtcagagcctcagattatcctttctcacctagaagggggaatatagcattaattctgtatctgaaaattgtattttaaaccatagtaatgactaacagcatgaatataatgagcaggattaggatccatcactctgaactaaagcttggtgcatttgaaatattgccaatggcaaaagcaacctaaaaatattggtgctagtagagtactcagaatttaagttaaaaaatgaaccacctatgtaatgaagactgtcgaaactatataacacagcctatgaaggtgagagataaatatatacttatctgtagtataattaaaaagtatgtgaaaaatagtgttctgaaaaaataatacaaattttactatgcaaagcacccaataccaacaggagcctatgtagaaaacactgtggaatgagaaaatagcattgatttataggctactgttaaatatggttaaaaatgaagaaaaagaaattaggaaagcagaaaatttagggatgtgtgaaattaatgatggtattttccaacttaaattgcctgattgtttctcttccacaggaaaaagtaaaaagaaggaaaaatgtaaaaattcccatttgtatcccctgattgagactcagtattgtccttgtgacaaatataatgcacaacctgtggggaactggtcagactgtattttaccagagggaaaagtggaagtgttgctgggaatgaaagtacaaggagacatcaaggaatgcggacaaggatatcgttaccaagcaatggcatgctacgatcaaaatggcaggcttgtggaaacatctagatgtaacagccatggtaattcaatcttcattgttacatatttgctatcttcgggagtgtggagggaaaatgcacacgcatcatagtggaatggaagtgaaggtttacagacgtatattctaaattaaactctgaagcaccacactatacatatatcatttatatgtaacaggacattcaatggcattgcctcattgtccagaagttggcaacttaagtcccaaagataatgacaggaagcctgatggggcccaaatcttgcaaagggtaggcaaaactggtgccagaacggtcccccagagcttatcaagagcctgtacattaaacacacccaataatccctaacaagtctgtgcacaggaagggagtaaggaggaaataagatttgaatcagtttgagatttaaacagacttttaacacctaaactggcaagatttgcaatatgcacaaaatgtcattaagcagcagagaagatggcaactagtaactggtgaaaactcaaacgtttattctctattgaatttagattgacacacacacacacacacacacacataaaacaaacgaacaaacaaaaagaaaaatgtgcatactcctaggaaactgtgcccacttttattttctaaaccaaaaaagaaaggaaaaacgcagcaattataattgtgttgccaaaagattgtgaatggtgccatctttgaccagaatatattcaatcttaatataggcagtattaagcaattttctctggtcttcttttattttaatacatctgtctttttataatggaatgaaagaagtttacagtggggcagcctgaaacatagataccacatacttgcaacaccagatgatgatctcttacttacttgatagaagtggccaagaaaggatgagttaaattgctagaagcatgatacatggcagttatcctccaaccttgctgaaatattaatatatcctgctattggaatggtgctgctccagttttattatatggttcagaaaacaatgctaataaaaaccatctcatatttataaactatcaaagtgtatggtgacatatttattgaaatctcttaaacatctcactacaaagaagtttcatttaatatatatatacatatatatagtttcattctatatatacatatatagtttcattatatatatacagcattttatatatatataaaatagttatatataatgatagttttatatatatagtttaattatatatatagtttaattatatatatagtttatacacacacacacacacacacacacagagcagacaactgtgccccctctctttttttttgttatactttaagttctgggatacatgtacagaaagtgcaggtttgcaacataggtatacacgtaccatggtggtttgctgcacccatcaacccgtcatctacattaggtatttctcctgatgctatccctccactgccccccatcccctgacagaccccggtgtgtgatgttcccctccctgtgcccatgtgttcttattgttcaactttcacttttgagtgagaacatgcagagtttggttttctgttcttgtgttagtttgctgggcatgacggtttccagcttcatccattttatgatgtatatgtgccacattttctttatccagtatatcattgatgagcatttgggttggttccgagtctttgctattgtgaacagtgccacagtaaacatacgtgtgcatgtgtctttatagtagaatgatttataatccttcgggtatatacccagtaatgggattgctgggtcaaatggtatttctggttctagatccttgaggaatcgccacactgtcttccacaatggttgaactaatttacactcccaccaacattgtaaaagtgttcctctttctccacatcctcgccagcatctgttgtttcctgactttttaatgatcaccattctaactggtgtgaggtggtatctcactgtggttttgatttgcatttctctaatgaccagtgatgatgagctttttttcatatgtttgttagccacataaatgtcgtcttttgagaactgcctgttcatatcctttgcccacttttggatggggttttttcttgtaaatttgtttaagttcttcacacaaagaagtttctaaaactcttgtccttttgttgttaccttatcacatagattctattgtattgaagtctagtgatatgcaaagaaatgataaatgtttgaggtgatgggtcatctcagttatcctgatttgatcattacaggagtatgtatgtactctgtaatatcacaggtaccccataaatatgtataatattaccattttaactatctttaagtgtgttcagtagtgttaagtacattcacgttgttgggcaatcaatctccagatcctttttattaaaaaataaattttattgtgtatatttaaggtaaaaacaaaaaaaaagtctaatgatgtgaactccaaagactccataatattgaagctctgcatataagtatgtttcaggttaatatacatgcattgctgagttgaagattattacatgccttgagaacaataactataaaagtaaagggaacttaatatttataatccatgtactttgagaaacatctcaaagagtaattgaatattttattctctatatgaaataacataagtgttataaattagataccaagaaaaatataaattctctttctactttgaggtgataatgtagaaaaccataattagccattaaaatataaaattgaagatcacttaaaagatgtgtttattttggaatgcagcacataagtgtttgctcacattttagcttgttatgcatactgaatcactaaaataattgtttaacattacctgtgagcttccagaataacatttatattttctcactcttgccttgatttgttaattagatgcatgagagcatcagcaagccacttcagtcaatcttatatttagaaacatcttttaaaatattctgtgactcacagaaatgtttgatcacttcaaaaaagtaaaagaacaaaaataattgaaattggccaaaggcagtatacattttttattttagtattgtcaactcacagcatgaagaatgcagtactgtattctagagaaaggcacttacagaaaaatgatgaatccatgatgacattgacttcgtggggattccgaaaggatctcagaaagatccttaatgaagtgaatggttctagtttagttcttctgcatgtcctgcatcattcctttctcaatctggtatctgacggaatgtccaattgatattttagtgtttactaacataattactcaaagtaaagtcttgagaaattgagtctccaatgcctgatttctttgggaattcctgctttccttaaatatgttctgcaaattctggtgtttgtggaatgttatgactttgccactctatcccagtcatcccctaattataatctctatgacaacttctttctttcagccaaatcagctttctagatggatggttattaagtggctctggagaaaaaagtatcttccagctttcaatttaaagacaaaattgatccccgtgtgtgcagtgcaatgacaataatcccctattcaatagtgtccttggggtatttctgtttaatcattgttgtctatctgtggatcatattaccagttattatattcataaaccagtttgacttttaccagcttaattatattattttagactgtttcccactaggtcacttttttttaagtttcttaaacttgaggcagaattctgttatttttgaacttgtgtgtaataataggctctgtgctgaaaagtgatataactgcattgccaaaatcagatattatagtattctttgggagccacataaaagttcatccatcctgatgcatggtattaaatatagtcactgcacaaatgatatataaacacacttatggcatatctgcagtaaaaacataatacaaattttgtatatttactcttggtatgaaatattggaaggtgtcactatagcaacaattttttagcagttttttatgcttttttttaaaattatactttaagttctgggaaacatgtgcagaacctgcaggtttgttacataggtatacatacgccatggtggtttgctgcacccatcaacctattgtctacattaggtatttctcctaatgctatccctcccctagcccccgacccctgccgacaggccccagtgtgtgatgttcccctcccttctgtccatgtgttctcattgttcaactcccacttatgagtgagtacatgcagtgtttggctttctgtttctgtgttagtttgctgaggatgatgctttcatcaaccaatatcatcttagaggaatcttgtgatgaataaaaaatgtgtaatatgatttttgagtgatttaaaattgttgctatcctctcaaggaaataagagagggtagcaacaacttgatgattaatttattagaaatgtattgagagcctaaccacacagtactaggtacttctcaagttaatcatcttcaaaatgttacaaaacaaagggcagaatatctggaacttttttattatatcatttaatcttcatattttaaacaatcttagaggtagcccagcttatgcaaggtacatgtatacaagatttctatttaaatggaaaggatagaatggtattgtgccacccctcagcttgatccagtgctcccaaatccctttatccggctttacattttacatttctaaagggtgtatcatcttataacataccatataatttacttacttattatgtttcttgtttattctttatctcccattcaagaatagagattgatgaggatatcttagactattttattcactgatgtatcctaagtacctagaacagtagtaggtgttccacaaaatttgtagaataaatggatgaataaaaagctggagagaatgatttttttccagataaagagttacaacctactggcgttgcagtggtttctatactttggggtgactgtggcaatttcttaaaataagacagtaatgaattttgctgcatccattgactttttcattcactaaagagttctctgttgcatgcaatgttgtttgatagcattttacccactgtggaacttctttcaaaactggagtatatcctctcaaaccctactactgctttgtcaactacatttatgtaatattctaaattctttgttgtcatttcaacaattgtcactgcatcttcacccggagcagattccatcttaagaaacactttctttgctcacccatgagaagcaattcctcatctcttcaagtgttatcatgagattgcagcaatccagtcacatcttcagactcctcttctaattctagttctcttgctgtttctaccacatctgcaattactttctccactgaagtcttgaaccccctcaaagtcatccatgagaaccaacttcattcaaactcctgttaaggtagatattatgacctccttccatgaatcatgaatgttcttaatggcatctaggttggtgaatcctttccagaggttttcaatatactttgcctggatccattggaggaataactatggcaagtatagtcttacaaaatgcatttcttaaataataagacttgtaagtcagaattactctttggcccatgtgctgcagaatagatattgtgttagcaggcaggcaaacaacattcatctccttgtacatctccatcagagctcttagatgactacatgcgttgtcaataagaactaatattttgaaataaatctttttttctgagcagtaggtctcagcagtgggcttaaaatattcagtaaaccatgctataaacagatgcagtatcatccaggctttgttgtttcattattgagcacaagcagagtagatttagcttgattcttaagggctctagtattttcagaatggtaaatgggcattggcttcaacttaaagtcaccaactgcattaacccctaacaaaagagtcaatctgtcccttgaaattttgaagccagccattgacttttcctctctagctatgaaagtcccagatgttgttttcttccaacagaaggctgtttcatctacattgaaaaatctgttgcttaatgtagtcatcttaatctattaccttaactagatatttgagataacttgctgcagcttctatatcagcacttgctgctttactttgcacttttatgttatagacagcttctttccttaaatccaaaccaacctctgctagcttgcaacgttttttatgtagcttcctcaccttgctcagcctgcatagagctgaagataggatcttgctcaattaggctttggtttaagggaatgttctgactggtttggtattctttctagaccgctaaaactttgtgcacatcagcaataacactctagtactttcttattatttgtgtgttcacaggagtactactttcaatttccttcaagaagtttttctttgcattcacaacttggcacccccaaacaattacaatagtaacagcaaagatcactgattacagatcataacagatataataataatgaaaaagtttgaaatattgcaagaattaccaaaatgtgacacggagacacaaagtgaacacatgctgttggaaaaaatggcaccgatagatttgctcaatgcaagattgtcataaaccttcaatttgtaaaaaatgcacgatctgcaaagcaaaataaagcaaagcccaataaaataaggtatacctgtaaaacattctaatatacttacattgtttctttatcaagttttattactctgtgtaatgcattgggtattaagtcttaatggaaaattggtgctgaacactattaaaaaatcaaagcccaattcagatttgtcctttgaaaatagtcatatttttgctgaaggaattccatattaattgaactttaatgaaaaaaatgattccacattttacagctcaatagtttttattattttactctaagactttttgtgcttgaagaaaaaaattattaaaattgcaaagagaacataaatgaatatatcagccaaaatattaaaatatatctgtcaaagtattgaggaagaaaaaagtctttttcagttcatctagagaaataagagggttctaggtttatttactaccggattgtcaaacaaaatacaatattatgtttaagtgccgggcacacttttctttgtgctctaagaatcatgatccaatggctctaaaattaccaggccttggtactgccatgtggacatcatactggcattcagaaagctaacatacagtttttgtaggccactttaattatgttcatttgtcttccaattgtagtaacaattaaatagttcagaatagtttgtctaatgccttattaatataatatctctttaacattaatttttaaatatagtgatttgtattgacttttccatgttttctctctttgcctagtatgcttgtgaatgatattacagaggactttctggacattaatgagtagcttaagcaattgcttttttgcaagcatctgtaggattcaaagtgtgctttgctagcacccaaagtttctctttaaaaatttgctttcataccagtttgcactatagcactaattattaaaataaaaagaaggctctacaaatattacaaatgaggaaaaaccttttaatagaatatctttacattataaatatgtgtgtggagtatttatatccttgtgtggaaacatttaacattattgcctaatagcctaagcagtctactgcttattccaccagcctctcacagttctgacacagatgattccaaagcaggtgtcatgtttcaatgaccattactagctactgcaaagaagtaactgtaaatatgaaacactgttttgtatcactcagggctccagtacacatgtctcagctgtgggattcttttctactaacatttgtaggaacaggaaagaatcatcaaaaaaaaaacctggaaaaggaatacatcgtggatgaactttaaaaattataatacccaatttacaaatagactttaagagtttgtgcttttaagttgtaatatggaactcaagataaaactgataaatataatcatgaatatgggtagagaataacccacctgaccactcaaccataaagtaactgaaatgtattactttttgtaataggattctaccaaagattatataggttcattattagaggttaattagaaacaaaattgaatgagaaattgttccttatcatagtggatactcgtatttgaggaagaacatgtttaattaaaccaggcagaaaaagcaataaatagagtcttgtaaacaagctgaaatggagtcctaatttctccaaagagcttttccatttggtagaatttatttaatgtctaatgcatttcagattttcagtgtctcatttgatagcataggtagagcgagtattgcttttgcagttatcattcacaactggaatctttttttcctttcaaatgtaaaagagaggcaggggatgagggacagacttttcctgaggtaactagttgcaagtttaaagagccaaggaaagaaggaaagagcatctaaggatacttgggcacaaagagaaagcaattgcctagggtcgaatttaaataaggtgtggagatcagcactaagctcacacaggctccctgagggagcacagaggaggtgatgagggagagaagggctggagattttcctgcagctgccattcatgtctggtgtgatggaagagcatctgccattgtcatttagttcatgttccgacacctcaactcatctactacttcatatcatggttttcaaactgggtttcccagagcccctcaggccaggctgtcaaacatagcctccaatagatcctgtgtccttatttggctttccttcagttttttaggaataaagtgttctattgcttaaaataaatttaactgccaagaacaattcattatttgcaacaaccaaaaaagaaaaattagaattttgcctttatcagcaatttctgccactataggaaattttaggtcatctggatataaaacaaaattgactctcctttgatcttttaaatagacattttataaaacaggaaatttatccaaataacactttcccctccctttgttgaaattaatttattgctagtttatccatgtttgacttttgacctgtaaaatataaaataatgtaggaagaagaaactatcttaagcttttggcatttttgtttggttgcttggttttgcattttcttctatatctggaaatggaaattaaaaaaaaaaaacctactttaaaaaatcttaaattccgaatgtttcaaaacatgaattcaattttaaagcattccaattataatctatttagatctatttctctagtccagtgaaatgctatgtgaaaaagtcagtcagtaattatgggaatgcagtatctgagtcattctctcagagagtcatagtttgtattacccaaaagggaaaagtccagggtaaatagacctgtataacctagtttcatgcagcagtttttcaatttaccacagactgctttttgttaaaattatgtttaatacttattagaatccagtaaactagtgtttaaagatcatcctttgcaaatactttcatggcaatattagattttaattgattgaaagaacagtgcattgcactggatcaagttaaaaataaatcattttaataagcttcaaaattaatacatcttccattacttcatcttcacaatttgaacactccatcaaatatgtttgtattcctgacaaagccctattactaatgtgaggtttttaaactctgcatctgattttcaacatcatgttagttaaaattataaatgttaaatatgaggagaaagtcaataaatgccttagtatgtgtaatgattcccaaggtttgttattatggttgaataagtaaaatataaacacaggttcttacatatataagtttattttcttttttaacaaaatatatatttgaaagtgcaatataattctgacactaactacctggagttaggccaaacttcacaggttaagggcccagtactccacaagactcctctcacttcagatatcagctgcaaatttgggagtctccaagccaaccttacttctcacaagctggctgcaaatttctgacttcccagtactgccccaggctcagtaattcactagaacagctgacagaacttggaaaagcaatatatttaccactgcagttttataatagcaaaaggatacaaatcagaaccagctcgaaaggacaggtagctgaggtgagggggcatctgaaacatgaggcatccataatctctttagtggaggcaggaggcatctttctcttagcacactgatgtgcatttccaaacagaaagctcacctgagctttggtatccagagtttttattcaggtttcattatataggcatgactgaagaatcattggccatgtggttaaatgcaatctctctcgtcttaaaggtggtcagataacatgtagctcaaagctccaactctctaatcagatgattggtctctccggtgtgaccagccccttcctgagatatccttacagcataaaatcataagtagtctgaggagcccaccatgaataacatagatagttctatcactagtgaaatttcagggccgagagacctacctggccaagggccaggcaaattctttattatacaagagaagcctttagagtttgctgtaagaaacgcccttggtaatgaacttgtacatagatatcactcaatgaatctgaaaaagcgtggtcattgagtaaattcccagtattaaaataacaataacaaaacctcacagccattcatactgatattgaaattttctgtgaaaatttataaatacttagcagatatgaatacatatgctttcaaatgtatataaaatgaataaatataattaaaataatattgtattatacttctataaatttgcctgggtactttactatgataattaattgcctaatattgatttataacttttcatccatcaaatatacaacgggtagaacattggaatataggagtttggatatatatacatagtaatttggttgccccaggtatcagatcaccagtttttaatatataattgctcaagaatattgtccgtttggaaagtttttgcaaaatgattttttttttcaactttttccagcctgtgaggaccacaatagataaaagtctagctacattttctcattcccagttgcaatcaagtgaatataatacacaattaagtagaagagattttttgaggttgcttttgaaattaatccagatgtttcagagagaatgccagagttactcattcacacagctataaatcagaagcaaccagtattttctatgtgctttcaaaatgaattctttgatccatcaacagtattcctttcagcagcacaatttagtaattgtgaaagttgttgaaatctactttatctccacattcataattcaaatgaatgagtgattgtgtgtatctcaaaggcaatatgtcctccagttgccactttaagcctgctagtcttttgtatttatttcaacctgaaagcagcagtcaaaaatataatcagaagtctggagtttaatttttccaagcgtcaaattctgtgttgaactgctgaaagttttaatatcctaattgtgaagtcatttattttatcctagcatcctcagaaaccatacattgctataagatgccagcagtttatttagccttaaaacattctaaatgtttttctttctttccatcccccatgattgtttggtgttaattgccctaaaaaatgatctgagcagagaaggcaggggaatgcttttctagcagttcactagtagcattaaggattttaatggtgctagataaacatgacaggcaattagtgaatgttgtcagacattggaaaataaaattgatatgctaggcaatatacgcttttgcagttttatctttatctcagtttctaatttgcatctatcttttaacagtttaataggctgcattttatttgagagatgttttctggaatatgctattggaaaatcggacataaaagttttgtatctccttccttaataacacaacgtgaatcagtctgaagtcatacatgttaaatcttactaaaaccataatatttcaatcaaaaacaattttccatttatctgttactctgtggggtagtgacatgtaaggccaccaggtgattctattttcagttataattactgagctaaaaaagcctagaggtttacttttgagagacattttgcagtttatcaaggtgggaaaatgcaattcttataaaaatatttcctttgaaataacttattacctttgaaatactagtgctcttttgccaaagccattgataatatttggaaatgatttggatggttcttaattcattgtagtcttacaaatattattaaatgatttggtcataatgccattgatttggaaatgactttagatacttttaaagtttgattgtatttattaaactataacttatttaaagaaaataagtgattactggccctaaaataagaagagttattttttgggcatctcatactattttaggtcaattaatttactgcctcagctgtaggaaaaaaggcatttgaagtatatttcaactcagaatcatgaaggggcttatttctccaccccaaagcataattaaagtcaaaatgtaagatttaagtagatcactgcaatctattttaaaatttcagtaacactactgtgaaatattcctttagttctttgttggactttcctctggatcattatcgatactccaaaagtcatcttgaatatatgagaagtacattagaaacttagcagtggcatcttctttctgtcttctatgtctcacaacaaacaaaatcccaactctgccacatctgccctccagaagattatctgggactaatgcccactttcagaacttttcattgtatcctaatcttcatgccaaatttgtgatcccattttttaaaatttattttatacttcatttacaatggataatataatatacataccatccaatttatccatttgtctcctaggagtacaccaaacagaaatacatacatatgtccatcaaaagacacattctagaatattcatagcagcactgttaataatggccccatattgaaaactacctaaatgcccaccaccaatagaatgaataaacaagtcatagtatattcacacaatagaatgctacacatcaaccagaataaacaatattcagcaatatgcaccaacgtagataaaacgcatatcacaatgtagagtgaaaaggctagcacaaatggatataaactatatgattcgatttacatgaaatttttaaaaagtaaaactattctacacagtgagtagtcaggatagttgttgctcttgtaagaaggggcagtggctgcaagggaatacggaggagagttctggactattgatttcaggggtgtgttcagtgaaatttacgtctatggaaaatgcacttttgcatatgaagactacaatacgaagtttaaaacaaatatctttgacaaatgtataggagatactacataaaaagatatgccagaaatctatttatcttccattttttttggttctgtctgtatcttatagtagcacttcctaacttaagacctacacaatcacacacacaaatgattaaaagtaaagcttgtgaaacctgagtaagtgctatggattgtattaatgtcaataacttgagggtggtagaagcttatgtttttaacatgtgtctcagataatttatgattaggcaaggctaggaaatactgtatagtaaattagtattttaacactttcaatacaggacagtttgggcacaatcttatagattaaatttgccattttggtttaaaggtggtctgactttcctttaattaaagaaattaatgttggtaggttctttttaaaatccacctacaataaaaagaataaaatacttaggaataaatataacaaaataagttcaagacctgtacactgaaaactacaaaacatcattgaaagaaattaaagatctatataaatggaaatgaattccatgtgtctgaattaagacggcagtgcttccaagttgatcaacaaatttgacacaattcctatcaaaatcctagctgcaattttttgcagaaattgacagtctaattctaaaatgcatatagaagtttgactcaaaatagccaaacctatctttaaaaggaaaaacgaaataggaagactcacacttctggatttcaatacttgcttcaaagttacagtagtcaagactatgtggtactatcatgaaactagacatggagataaatggaatagaatttacagttcaaaaataaatcgttacactgtggtcaactgattttcaacaagggtgccacaacaattaggaaagaacaggttttttcaacaactgaagacaggataactcaataaccacatgcaaaagaatgaagttggacccctaccttttatcataaacaaaaattcactcaaaatgaaacatacacctaaatataagagctaaaactattaaattctcttgagaaaacaactataaacctagatgaccttgactttggtagtggattcctagatataataccaaagcactaacaaccaaggaaaaaagataaactggacttcattgacatttaaaacttttgttcttcaaacaacaccaaaattttagagacaataacaagtttgacaagaattcatagaaattggaacatgcgtgcatatctggtggagtataaagtgctgcagtcattttggaaaacagtttgacacttcctgaaaaagctaagtgagttaccacataactgagcaatttcactgtaatgtatatattcaagggaattgaaaatgtatgcccacacagaagcttgtaaacaaatgttcatagcagcattattcatgatagacaaaaagtgaaaactcaaatgtccattaactgatgagtggataaacaatgtgaaatgtccatacaatgaaatattattcaatcatagaaaggactgaagaactgatacatgctataacataaatgaaccttgaaaacattatactaagtgaaagaagccaagccaggcatggtggttcacacctgtaatcccaatattttgggaggccaaggatcacttgaggccagaagttccagaccaacctgagcaacaccgtaacacctcatctctataaaatatatatatatatgaaaattcgcctggcatggtggtgggcacccttagtcccagctcagctacttaagaggctgaggtaggaggatctcttgagtgcaggaggtcaaggctgcagtgagctatgatgacaccactgcactccagcctgggtgacagagtgagacatctctaaaacaaaaaagaaataagatcacataatgttttacttcatttatatgaaatgtctagattaggcaaattcatagagatagaaagtagattcatggttgtcaggggatgaggaaggggaaagtaggaagtggctgccagtaaccatagggtttatttttggagtaaaacaaatgttctaaaattagatggtgatgatggttgcacaacgcagcaaacatactgaaaaccaaaacatggggttatttttatggaatatgaattatatctccataaatttttaaaaatctacctagagttgcctagtatcaattgtttacattataatcattgtcaaaatcgaatctctgctgttgagataaaatggcaaggcagagtgttttcttgtaccaagaacaccttctctccacattcagactattatagaggacaaccgtgcgtttcattcttgactagaggaattttgctgttttcacatgtttgccttgagaataatagtgtttaattgatattgtgaaatggcaagtttgtagttaagaagtattgaaagaaaatactcccatttcccaaaacaaatctgtgcactattaatcgaattggttggatgatttgatggaatgagtactggattagacctcagaaaacttttccctgtctcttactgtgtaaccttggactcagtcagtcatcgctctgcatttgttttcttacctgcctgttagaatgtcaatacttgcacaattcatacataagattttcaagagaatcaaatggatataagatgtgaagatgctctgaaagtgacagcatgtaaaacatgagacattacttaacatcctgcatttttcttcagacttgattttcaaagaaggagaaacgcaagatgctaagttaaatggttccttttgggtattgagtgaaagggactgggatttcttaagaaagaacgttgcatggactcagaaccctgaacttgtgtgacattaacagatagggttttatagaaaactgttataattttttaatgtatcattctgtcagcatgagaatgatatggcagcagacaggttattgtcaattaaacacgagctgtcagtcagaaatgttgaaatatggtgagcatgaatcctaagcagatcacatggcagctgctcaactgttattttaacagagtcactgtatgtatgtgacatttccctgcagaatttaattcaagtcccttacaacagagacacctctgcatttgcatgctgctgtcaagtcagtcttggaccttctaaatgacctagaatagtgggtggtaatgggagagtgacaggtggaggagatgattcttgtctcattttcctctactcaggttacattgaggaggcctgcatcatcccctgcccctcagactgcaagctcagtgagtggtccaactggtcgcgctgcagcaagtcctgtgggagtggtgtgaaggttcgttctaaatggctgcgtgaaaaaccatataatggaggaaggccttgccccaaactggaccatgtcaaccaggtattttctatcattgacagtgttaagatattgttgagattcacaatgatctgattttttctccaaaatggagaagaggaaataatagctattgaataaaaaattgacccatttttaccattagaatgcctgaataaatacatacatgttattaaaatttcaaattagacatatctgtattctctggagattccataccttgcaagtatatatgaatatgtatgtaattcaatggggagaaaaatgacacctatctttgaaataatgtcaaggtatttaatctgtcataagattgtatctaacatgtaggctgagattatctcattcttatagtttccccaaactgtcagaaaagacatctcaattaccaaatgcttaaattaaaatcaaagaaataatatgggttttggtctaaaattaggaaaaatatatactgtttatttaaatgtgtttgatataaaacaaactgagaaaaagaaatacaaagatggcctcaaaatcactgtaagtatgctatcaatttagtcattgaccattttcaattttatttggaactctgacttttgatgcattctttcttacctgctgttaatagttgtcgttctgttctattagagataaaaagaaaaagcctaatggaggaattgtgactgatttaaatggaatgtaacataatcagacaattattaccatgtttggcctataagtgaattagcaaagaataatttcatttattatgtgtgggtgttaagttgtgtatttgaatttaaatcacaatcaaatgaatcaagtccttaaatatgtagaattgtttcatacatacatagactcattttaatctctaaacacactgcttacctgtatacatactttccttcccagattaacataactttgttcataataaaagtacattgtagagaaaacagaaagaaccttggaattaagtaaattaagatgaagatcgtgaagaattaaattctataaaaagtactctaaagagtcttgattgttccccaagtgaagttgctgattttatctttatgtgcaatggagggtaaataacacactcccttgctgccatctactggtagtttagcttccatgtcacagagcattttgcatttctaagatgctaaggaaatttccaaagaaaattcagttcagcaactataattatataactgcaaaacagaaaaactgaactaaaatgtttataatacaaaagaatatttctctacaaattttgaaaccttgaattttcagtagcaaatttaaataaattatatatgactcccaatcctaataaagagaaattctacacatactcatacctatttcactttagcgtgtatgtgtacacccagtcagatatgcaattaaaatctgtgttttcctcagattttccttaagtgaatttccaaaggttcaaaacctcaggccaagttgtctttgctattcctagtgtttggcctaaaccatttgtcactttccaactctaatatattctgatgcagtttgataagggtattgtgacttggtatcggttgactgaaggcttactgagacattaacaactgaaaaatcaaagctaaaacaaataataaatttttgaacatttgagcctaaatgttctgcataaaaatagaaacttctatgaatttgtgtattaagaaatttagggaaaataaaaatgtaaagttttgtgttaatgttgaaaattgtaaatcacataggtgtttactacaattatatgttcctcagtaaaataatcagaagcattggcttgaaaacagtctctgagtttctatttttctagctgaggaaggaagtactcaaatcctcattttctacaaaacagatgaactgattaaggtaaatcaacggatagatcaatctataaatatactgatagacaacagtacattgacaagttggatcacaagttatttgcatcatatatcaatttcccatgctatgtattgtgaggtcaactccattttctaagatttctccatcctgcccatctaattttctcattggctctgctatttacaatacccatttgtgtatcttactttttaacattaataagtagttgtgtattatctcctgagacctaagaaaaatgttctaatattttaccaaaaaagtaggtttttacatgtaagtaataatacttgaaacttaccatgtgttcttctcatagcatactgacattttcacctaccttatttctctcccttttcatcattcctgttgaacaccactccaggcacaggtaagaactcttaaacctcatgctttttgatagaatccttcttttcttaaatttcctgatttctgagaatacatttctcttcttgctttgtcttttatgttttacagggagaaaatgtcatattttccattaaagaatttttttctataactgttttatttttcttttctatcatagttacctgtgttcctacatttcatatccctcattgtaatatcaaggactgaggtgaacaagagttggggagaacaagtttcacttcgctaatctcgacaggcagtgacacccattattaatggtcttgtgcttttcagagggagaaggaaaaagtgcaagtggactgaaaatgggtgggttggagattgttctgaactgatgggtattcacttcagtacaggagtttaaaataaaagccatcaaaggattaagaagaagagcatttctccttcagtttttcttttcactgcaagttgtagggtaatgttttatcctgtgctatttagttctatttttaatacagcaactaaatgtgaatataatcacttatggcaataattgcagaatttgactccaacagtgcattttttttttaatgttttttttttttattatactctaagttttagggtacatgtgcacattgtgcaggttagttacatatgtatacatgtgccatgctggtgcgctgcacccactaacgtgtcatctagcatttttttattcctctttgagacaggtccactttattcattttacttaggtttttagttcactaaaattggcacaaaagaatggctgcaaagggctatttaaatctatcttttctagaattcattacataaaaagctatagtttctctcttccctttctctctctcttgctctctgtctctgtctctcagtgtgtgtgtgtgtgtgtgtgtgtgtgtgtgtgtaaaataagggatagagttggactatcacagattagaaaaatactttcaaagaattttatttaatgcttgagtcagcttggttgcaatggattaagtgccatttatttcctttatttagtcattcttctcattgaaaaaagaacataattggttcattgtactaaaaaaaaacctgaaaccaagcataccaccccaaatgtgggactgaaaggctttatggaccctggagcagagacaatttgccttgtttcatgtggccctcactgcttgggcttgtacaccaatatcagactttgcttccaagccttaaatgattgaggattagttttaagatggctttatttcatattgtttatctttttaatttagtttcccatatgatacacaccaaaaatctaaattctcatcattatttatagttatctggaaaataggccaaattatatttatttggaaaacagctatgttttatacttatttgattcatcaatcctcatccttcattcaatcattctgcaaatccctattgagtacctaacatgtgagcaccctgggctagtattgaagtcacacaaaactgtaaatgacacagatggtccagaaagttacaatacggtgtgttaagggtcagcataggaaaatatgtaacctatctaatgtgatccagtggatcagatttacacctgcaatgtaatagcagagcaacagagtacaatatggttagccctatcctctactgctagaactcttgagttctctctattgcaatgttagaataataagcagtaaaggaggggagtgaaagtagcttcacagtgaaatgattgctgttatggtgtggaagtcttcctcctcactcttaccagattccctgagattgctgagaaccatgtgtgtttcaggtgtatgaggttgtcccatgccacagtgactgcaaccagtacctatgggtcacagagccctggagcatctgcaaggtgacctttgtgaatatgcgggagaactgtggagagggcgtgcaaacccgaaaagtgaggtaagacaaagcctaattatacagaaaagcaagacacaaaactatctcccaattgcacatgtgccaacatgactgttcactcctccccagtcttctggataaaattgtctgcagttttgcttttagggaatctgtgctcatagaaaactctaagagaatctgcttcaagcagcagtttattatattctggccttctgatttaggaagcatcacttcaaatactcttaaagagaaggaacagcatattcaatctgaactaatgcagattttcaaccccaataacttttttgcttcaaggccaaatatatttccaagttcctttctaaaataatctgttttaaactcttgctcttttgtatcaaactggctaactgaatactatcctgttgtccagggagctttctctgaagcccccagctggttcctgcgtgtcacttgttcttctgtagctacactgtcccataggatagccactagccacactaactcaatttaaattaaaaaaaattaagtttaaattaaattaaaaatgcatctccccagtcacactagccatgcttcagtgctccatagccacatgtggctggcagctatctgttggagagcgcagacatacagtattttttgtaatggcagaaagttccattggacagggttgttctattacactccatatacccctcactgtgttgaaaagacccctcttcatgtctatccccttaataaaactttataaaatttcttaaaacagagaccccacatattcataggaattccctactgcctaacactagattgatactcgttaaattttccatacagtatctatcacatgatccttaagggctctagaactctatgaaacaaatgcacgaggttttatcacctccattttgtagattagattcccaagtgctaaataatgtaccaagaatacccatctagtaaagtggcagccttggaattcaaacccaagtctcccatcactctttttaaatacactggtttcttttaacccttctcagtggcacccaggaaagacaaatataaaaacatccaaccactttgggaggccgaggcgggtggatcacgaggtcaggagattgagaccatcctggctaacacggtgaaaccccatctctactaaaaaatacaaaaaattagctgggcgtggcggcgggcacctgtagtcccagctactcgggaggctgaggcaggagaatggcgtgaacccgggaggcggagcttgcagtgagccgagatcgcgccactgcactccagcctgggggacagagcgagactccatctcaaaaaaaaaaaaaaaatccagcactcggcaacccatgttatgaagaagttcattcttacccataacccaacctttcatgcatttaagattggtgttttaatctacttcagtaggaaagcagaacaagttaatatttgttttaccgtataaaacctttgcatatggacctatatataattttatgtctaataaaaagttttatatttcttttttcaaaagcccatctgaactctcaatttgttttttctctgaggaccttaatataggtggactgggaatggggaagaggtagagaggtaataagtagatagggacacagaaaaagagattctgttttccactattctcctttcaaattattttttttcttcaaaataaaaaatattaccttaagaatttgatcaggttggttgtttcattagtaaaaaaaattataggccgggcacagtggttcatacctgtaatcccagcactttgggaggccgaggaaggcagatcacaacgtcaagaaatcaagaccatcctggccaacatggtgaaaccctgtctctactaaaaatacaaaaattagctgcacatggtggcatgcacctgtagtcccagctactcaggaggctgaggcaggagaactgcttgaacccaggaggtagaggttgcagtgagccgagacggtgctactgccctccagcctggccacatagcgagactccatctcaaaccactgggttgttttttcagctttcccttcaactatctgtgtacatgttactttttttttttttttttttgctttgtaaatagatagtcttaacatttccaaacacattctaaacaaagtaacttttcagatcaatttattttttcagtaaacaacttcaatgcaaatagagaagagaggtcagtattgattgcgatctctaatcatgtaatgatgtttctgtttgttactgattgagtagtacacttcccttaaattatcctctgctaatgaaggtcaaaatgtcctgcttgaatgcaagtgttgggtaacatttcaggatagatgggtctataaaagaggaggtttaaatttattcaattacactcttcctctttaaggatgatatggcctatcaaggagtggtggtagaagtggtttaccttggtagggaaggatatttttttcactgactttttctagaattgccagcacacagtaataataaaaaacagacagacttagttattgttgctttttaaatctatgcagaaaatacactgtcttattaccacacctgtgatgggcttctgactcaaccctttgtctacaacttggttctacaccgtgtatctctaatatagttcagttttctcaaagtataattcttgctccttagaaaggagaaaggccaagaatttggagaaaacaaaggaatttaaagtgccttcctttgggcttaagacttgatccaaatattctgtattctagggtgattataaaaatttttaatataaaataacaaaaataaagcctgtaagtataaatgccacaacagggacattttaacaattgtggcacatttaagcaatggaattcagatgtagacattaaaatatatcttagaaaaatagttaatgacaggaagatgttcataatatattgtagatttttaaaatggtacaaataggtaaagtttgcttccattttgtaaaatgaaaagatacatttaaagtaatagtccattaataaatatagtctgttatgagtggttatctctgatgaaattgtggaaatttttatttcttctgattttcttaaaatgagtatattacttgtaaaacaaaaaaataaaaggaagagagatgtattaatcttttctcatagtgctatacagaacttcctgagactaatttataaagaaaagaggtttaatttgactcacagttccacaggcagtacaggagagacatggctcgggagccttcaggaaacttacaatcatgacaaaagggtgaagcagaagcaagcatatcttcacatggcagcaggagagagaaagagcgaagggggaagtgccacacactttacaacaaccagatctcatgagaactcactcactatcatgagaacagcaaggggaaaatctgccctatgatccaatcacctcctaccaggtccctcccccaacatgagatttgggtggggacatagagccaaaccatatcattccaccctggcacttcccaaatctcatgtatttctcatatttcaaaatacaaccataccttcccaacagtctcccaaagccttaactcattctagcattaactctaaagttcaaatccaaaatctcatttgagacaaggcaagtcccctctgcctgtgaacctgtaaaatctaaagcaagttagttacttccaagatacaattctcccattccaaatgggagatattcgccaaaacaaagtggctacaggccccatgcaagtccaaaacccagcagttcagtcattaaattttaaagcttcaaaataatctcctttgactctgtgtctcacatccaggacacaatgacacaggggtgggttcccaaggccttgggcagctcgacccctgtggctctgcagggtacagcccccaaggctgctttcatgagctggcattgagtgtctatagcttttccaggtgcacagtgcaagctgtcagtggatctgtcattctggggtctggagaactgtggccctacttccacagctccactagacagtgccccagtggggactctgtgtgggggggcccaaccccacatttctgcttcacactgccctagtactgaaagctccacccctgcaacagacttctgccaggacatccaggcatttccatacatcctctgaaatccgggtggaggctcccaagcctgaactcttaccttttgtgcacccacaggcccaacaccatgtggaagccacaagggtttgggacttgcaccctctaatgcaatagcctgagctgtaccttggccccttttaaccatggctggagctggagagactgggttgcaaggtgccatgtcctgaggctgcacagagcagtggagccatgagcctggcccacaaaaccaaatttccctcctaggcctctgggcttgtgatgggagtggctgtcatgaagttgtctgaaatgtcttggaggcattttccccatgtcttggctactaacatttggctcctctttacttatgcaaattcctgcatctggcttgaattccttcccagaaaatgggtttttcttttctaccacgtggtggggctgcaaattttctaaacttttatgctcttcttactttttaaatataagttccagtttggggtcatttacttgtttatccaaataagctaggcttttagaagcaggcaggccacatcttgaatgttttgctgcttagaaatttcttccaccaaataccctaagtcatctctctcaagttcaaagttccacaaatctctagagcaggggcacaatgccacccatctctttgctaaagtatagcaaaagtgggctttactccacttcccaataagctcatcatctccatctgagaacacctcagcctggatttcaccatccatatttctatcagcatttttgtcacaactattcaacaagtctttaggaagttccaaacgttccgtcatcttcctgtcttcttctgatccctccaaactgttccaacctctgcccattacccagttccttagctgcttccactttttcaggtaactttatagcaatgctacacttcttttgtaccaattttctgtattagtctgttttcacactgctataaagaactacctgagatggggtaatttataaagaaagaggtttaatcagctcatggttctgtggattgtataggcttctctttctggggaggcatgaggagacttacaatcatggcataagggtgaagaggaagcaagcacattttcacatggtggcaagagagagaaaaagcaaagggggaagtgccgcacacttttaaaccattgtatctcatgagaactcactatcatgaacagcaaggggaacatctgcccccatgatccagtgacctcccaccaggcccctcctgcaacactgagaattccaattcagcatgagatttgggtggggacacacagccaaatcatatcaagagaaatctttgaaaataaagatttatggacataactgcttaatagagtgttggatatctgttcttaactctggtcaataggtaattctacaagttaatccttgcatatagtgacaccacctactcaaatgtaatatattcttaggagcaaatgcaacttttgagcactgaaatgtcctgtctgcaacatgtctctaagctgctgtcaccataacatttttttaatgatattgaaggtagaaatttttcctgggaaactcagattctcccaaaaatattcacaatttgatttatttttttcaacaaggaaatcatatcaatatctactttgcatatttttgtgattgctttttatgtatgtatccagtatacaaaaaaaaaatgcacaggtaggtatttgtttgggtatttttttcaggctacaggctcattaagacatgaccaacaacacagttttccagtgtttgaatgtatcccacagggaaaggacattcctaagttcagcagcactgcatagcaaggtgactctgcagaggagatttgtgaatgtccctgctgattgtaaatccctgataaaagttgggattccaggtatcactggcaatataattcaagtgatattttaaaacatgacactaggtttgagagacttgagagttcaagccttccttttcaactcctgaaatgcagttctgttcctaaatccattaagttggctgaccttttccaagttacacatgagagataaaggttttctctcctgctataatacttaagtgcccagagagattatttactatggtaaaagtgaagtctgatagtagccatgttaattagactcccaaaagatgaataaggagcccttcatgactgcttacaggagaataaaatggaacacaaactaacaattttttcaagtcaagtagtaggaaaatccaaataaccatatttagagaacctatgcgataccaattataattgtcttttcacttctcactttcttttaagattcacagcagaagggaggctaaaattacttttaaaatgacaaaatgaatcgataaatgcctctagttgttttcaaaaacactcaatgaaatctcccacttagagatttcagtgtgcctggtctctcatcacatataaatcaactaactctaccttctctatgaaatccatcattttcttgagaagaataaatgcattatatgccaaattgtaagccctctacgaagctctttggacagttcctcattagtttctccctcatatgtgtataaatgaccctcttctttcagaggaagcttgcataacatgcagagtttacatatacacagtggctcttatagtcaaagactcatgaatgcaaacacatttttgaatcatgcagaagcactacagatatttaggagaggcaaagatccttttaagtcttcatttgtggagaattttattagataacaaagcttcctactccccacccccataacgatgtcttaaggagaaccatctgtcctgtgggttggtcattctaattgtcctgttttctttacttctagaatgtatgtatattttctagaatatgtttatgttcttttctagatgcatgcagaatacagcagatggcccttctgaacatgtagaggattacctctgtgacccagaagagatgcccctgggctctagagtgtgcaaattaccatgccctgaggactgtgtgatatctgaatggggtccatggacccaatgtgttttggtgagatgattaacctttttattaatgtagagtttatttaattatttgccactgaagctttaaagacattattttttgaatataataacttcaatgtaaaatctgtttgtttgccatatttagcaaagcaaggtgtgtcttctctgccacatcattctatgactgtgctatttaaagtctgtaatgtttcctctcacactagaacagctccacctcttgcaagctttactaacccatcatcctaatccagcacaaaaggccttcagtttgccttataaatacacagcatgttaaaaactgcagtggtgataatgattccctccaggtaaaagggaaaatgaatgaagtaaaggtactttaatggtgtcaggttattctcatccattgctttttgcccagtaccttttatttaaatggtaggaataatctctcacacagtgggaatacagcagcaggggtattaacattaaaaagcaaaagatactgggtaagaaactaagtagaagaagaaagctgtgcaccaatgaatctctctttacacactgactctgtgtctctttgggcctggaaagccagctgagagtttcaaatcacacaaagcttctatatttcaacagccagtaggggctcatccacgagactctgggaagagagtcatttgaaacagaactggctgcttatgtaagacatttggcttacccatgggcacctttgtaaaactgtgcatttcaaaaacagcatcaaaagcatgagaaaaataactaatatggaattattttgttgaaatacaatataaaaccatttcaaagaggattttatggtgcatattttccaaggagaaattgatattccatttcagtgttaaacatactgattagcagacaactgatacagcaggaataaaacaaagatggcagttgattggaatgcaagttacactgtaataaagaatcagctgtttcacaaggatatacaattgattttctgttctaatttcaaaggatcagatttgaagttacatcaaataattgggctatatgctacactgtctgtgtttataacagtgagattttttgtcagatatcatattatgaagagattccatttttataaaaataggaaatattgaacccaggccccttcttaaacttattaatagggattttaataaaaggaaccactaaactggaactttgtccagtaggtttctatattaaatgatcaaggataatcatcttagaagaattattgaggctctattatttataaaagagagttggtgaagcatcttttgtgtttctgagagtttgccaataggaatgtttggataggaataaaattcaatgaggtgaataaactgtgcttcctgggctttatatttctttaaagaaaaacctcagaaaaattaaatttaacagtttaattgatcaaagaaccattcaagaatcgggcagcctcgcaaaccagaacaggttcagagagactccagcactgccacgtggttggaaaagatttttgggcaggagaagataagtgtcatacagaaaatgatgtacagaagtgaggttcagaaacagctagattggttacaccttgacttttgtgacaaacaaaatgagtaactaaggcaaaagtcccaatcaatcgaagtttaataagccagctttaggacacatctgggaaaaagcaaggaggttttctgaagaggtgttcaggaggttttatgtttatactttcccttaaatgggggaaggcacttaggaagagagacaggcattaaggcaaatagttatattcctgtgagactttagttagtaccccgtaatctacattttacataaggtaaggtgaatgttcgaagagaaaaaggtaatagaggaaaaatcaattatgcaggcatctctcggtaggtggaagaatgactgatctcctcttgtttttgttctgaacctgggaaaataagcttgtgattgatagcatcagtgtggaatcagactttagttttgggagttagacttaggctgtagacctaaagttacaattggtataattggtatgtccttgtttgtgggaggccatgaaagaatttacctatgaatcttctatgggagcaagttattcatgatgcccgaggccgtttatctttccttgggaatctggcacaatgctagcaatagctattcatttggaagagaatgttgcaagacggcctccaagcttacgcttcccttttgcatagggagtatgagatcctgagatttttttaaaaactttcctttacatttgtcatatttgaacatgatttgaacaattggccacatttgaaactcagtgattgcacaagagtaggttacagtctttttacacatccaaagagggtatagttcactgtgtgtgaagaaacctttaggatgaacttgaatgtaaggaggcagcgttagcctaaatttaatttgacatgttttacctttaactcacattgtttcttcactcaggccttcattaaacagataccaactaagcttttactgtctatcagtaacggtgttaggtagggagaatatacagctatctaaaacataagtcctctcctagtgcactgcagaaacgaacaagacctttatataatacacattatgtcaaaacagatagtgttattccagtgtgaccaaagtgcaacggaagcaggggaggaggaagcaattattttaggccttaaaaagtccatggaggcttgttcctggtttcttactgttcttagaaaccaactgttttcagaagactgtaccagtagatgaatggcaagccagtctttttagatgttgtcaactgaagaatgacaaggttcataaatttagaaaggagagctttacatctcataaagggttgcagcctgcagggtggccatcctgacaggctgggaatcatagctgccagccagaagccagaaatagacacttctagggaatggaaagggaacagtaactaatttgtgttgagcagggtggccaaatatacatatttaataagctatatgaggagtcatgaatatttataaaaaacaaagagtatgcatgtgcaattgagctttatgccccctcgtgtcccacgtaccaaaaatggtggcattagcatgatccaagggtgggattttcagtgctctaatgtcaaaaggtgaaacagaggtcacagaaacccttactgtacatcctccatggactacccagaaccactccttggtcagtggtttcttattaggaagaaatgctggttggttgttttgttgcaaccataaaagggagaggcagtgtcaggctgtaaccacccatggggttcttcctgcctgctgcacaaataaagaccagggtattgcagtaaagaaagagtttaatagacataaggccagccatgccacatggaagatggagttagtactcaaatcaatattgtctaaggctcctaggtaggggtttttcaaaggcagtttgggggaaggggtgggactgccagggaatgggtgcttgctgctgattggttggggcagagatgaaatcacaggggtcaaagctgtcctcctgcaggctgaattcttctgaggggcgcacaggaactgggttggcaggtccaggtagagccctgggtgttagacatgcaaaaaaatggaaaagatatctcaaaggccaatctactatagtggtgtcatctgcaggagtagctagcaatcatttatgtctacaccttagcagaattcaggttcctctcctctcccagcctgatggcctttcattagctttacaaaggcacttgggtttggggaaaagcctgttatttaaactataaagtaaatgtttcttgaagttagctcaccccgaaaacccaggaataactaagagaaaagcgagatgaaggtgggttagatcagatctcttttactgccataattttcttactgttataatttttgcaaaggcagtttcaagacaattggttgatcaggtgcagagtgagtttttccaaagggcttgtttctgtataacccttacggaagaacgcctaaaggccgagaactcagttttcaaggtttctctgtggtccctatggccaagagggggtccatttggtcagttgcaggtcttagaactttatttttttttctcaattctaaattaagaattaaaattaggatttagaattagaattgtttatatgcatgtatatgtgtgcatcaggaaaaggaaagtcactaacacctagtcatttaaagttattcttaaaatgtcttttaaggcccaaaagactatacgtaatccacaaacatataattatatatataataatacacatataactttatatatataatagcataataattaatatgaccaccatatgtgtggctgtgtataggtgtgaggtgatgtgtgtattaacatttgacacatggcatcttatagctagatggtacatcaaaatctcattcaacaccttcattttatacattgaacaactgaggcataatgaggttgactgacttttctgagttagccagtggcccaaatgttctaactcctgctccagtgctgtctctaatataccagttgtgtagctgagtattcacctttctgagaatttgtactgttctttttaagccttgcaatcaaagcagtttccggcaaaggtcagctgatcccatcagacaaccagctgatgaaggaagatcttgccctaatgctgttgagaaagaaccctgtaacctgaacaaaaactgctaccactatgattataatgtaacaggtacatggatcatcatctgatcacggagttaagtccaaatcctgtgtctgtcagctctgaagcattcctgtcagtatagttcatctctacctgtgtgccttttggatatgctgcttactttcccagaaataattacatattaaatgacagaaatacttatctgggttttttttttagtaaacactaagatagaggaaataaaaatgtcaacagacattagcccttaaagtaggttgtgaatatactaagtgttcctacataagacaacctctcacttcgggaaggtgaatctaaaatatttttggcacaggtatcagatttattcaaaaatgtctttctttttcagaagatgcttaattgctaaaacatactggggcaacaattcatgaggtgtgggcagtttataaacatgattagtcagcaatcttaaacttgccaaagattataaatcaatgctataaaaggtgcaggtaaaaattgatgagtattttcagaaaaacagatttattataagttgcatttttcccctaaaactcatttaataccatcaaggtgcatactctaggaaagaaaatcttttattggtttatatgaattggggcaacacgaaagcttactttggaatttttcccaagtaattttcactctgcaacaaactcaagaaactgtacaatgacacataacagtcatattggctttgtttcttttggtttttctcttcagtttcctttgatgatacaaaaaaaaaaaatcacagttatctgggatgtgctatgttacccagggaaagaggtgtcttttatgtcttcttacgaaagacataagagaatgaataaatatggccaaagtgatttttatcactttaataaacgtatgcattttcttgcattctaaatatggataagaaataaaatgtatgttttatctgaatataactacacagttaaagtaccgtctgtcacaattatgattatttggctaaaagtaatgctaagattttaaattatatttttattgggaaagaaagtttttaagtgacattgatctgtaagccaaagccattttcacagtgtcaccaaacggctagctatcaagattttcaagtagacatctgcctttaagaataatccctgtagctatgtgcaaccccagcaattccatttgactcctgatacgttcaaagctgggacccatatgctctgcatgggggatgattgattatggggcttaggaagcagttgtgaattaaatatgggattcaggtcatcagagtttcatttgaaatctgtttcttacttagccttctgttctgatgggcttccctttttttcagactggagtacatgtcagctgagtgagaaggcagtttgtggaaatggaataaaaacaaggatgttggattgtgttcgaagtgatggcaagtcagttgacctgaaatattgtgaagcggtaggtggatgctgtgttatatcttcgcgagtaaattcttccctaataatttcaattcatgctgagccaagtgacccgtgctccatgcagctcattgccagcagatgtttttctgcactgttcacaggctaagtatgttcttgaaaagacacaatgtccaacactactgattcctacatataatttcctgtattttcttctgcttggagcccaaaggtatgctaattagcctattctgaaagaaatgcttggggaacaatacgtaaggtgaataaaagcaataaattttaatcagactacttatcatctttgtaatgtgatgtgaattttgtgtagtgcctgggacacctgccaaggtccatcatttattctctttgttgctaaacattgatcacatgtggtttcatagcagattttgatattaggatctaatacccagctgtgaccatctaagtactcaggtctgattaagtgaaagcctgaaattcaaacagaggaatgaagtcagccattactatcttctaggtacagagaattgtaactggtattatctaattgattaaagtaatgtcacacctagatgtgagcgtctgaaatgtgaagaaacgtatttgtcctttcttagtttttatgaagctacactttatgttgtaataattttatctaatttccataccaaaaacatgacaaatgttgactctccatgcatctgaggtccactgggtcaaataccaaccaagataagtaggagcctcaatagatctggaatagagtagaagtggtttgtaacctcattagagtttagtatacacagacaccatgtgtcttctgtctacacatcctggggttattatagcccacagtaaattgttcctatacctaggggaaaactctacacagaaatattttaattcatttgatatgtttatcatgtggacctaacttaactttcttacatctccgttcatgagagcagagcacccacatgtgttgaaaacacaaatttgtttagttaataaatgcctcctgcaataaccttgtaacgttacctaatgtattcattatttaaacttgaataattagaaatttcacacttgaatcattttagtttcataaccaataacattgaagcaatataaccattatgagaataatgtcagtattgagccgagtagggtggctcaagcctctaatcccagcactttgggaggctcagtcgggcggatcacctgaggtcgggggttcaggaccagcctgaccaacatggagaaaccccatctctactaaaaatacaaaattagccgggcgtggtggcacatgcctgtaatcccagctactcaggaggctaaggcaggagaatcgcttgaacccaggaggcagaggatgccatgagtcaagatcacaccactgcactccagcctgggcaacaagagcaaaactccatctcaaaaaaaaaagaacatcagtattaatgaagataatggtcatatactggctggagagcttgctgtgatctacttctggttgattagtatgtccttttttctgcacacataaatgtactccttggtcggaatgaaatataaaataaatgagagctttgcgaaagctgaaacctaagcatacatgaccaattttaaaccatttcatatgattaaaggacaaagctggaaaccgaattcttgatttcttacatcgaatatgagtaaaaacctgggaaataactaattttaattatatgggagcctagatgactttaagcttacatgcaaatactacaatatttgaatgttgcatggcaattagggactcctagttttaacattctagcaaacactgtcttcaaggacttaaaattcgactgtgcaaccctgcattcagtgccacatcagtaggtaacactggctgcttccctaacagccacaaagaaagatggcattgttatctaacaaagaggaaaattagagttaaacctaactagcatttatgtagtattatttttatcttcagtgtttttcagacatttactcattggatacctagtaattggttttttctttcctatttcttagatttttgaatagatttctttttaatttatttacacacacatttaggtaaatgagagagcaaattaaaagagagatatgatcaatgtaaggaaaaaagtagtacaggactaaaatgtgtaagtggtggatatgtaagtcagtaataattgaatcctgtgattcaaactgtccccatgaaactattatttaccttaaatgtaacacttatttttatcatatcacctcaagattcctatctccaacctcccatgacttttaagtggctttatgaggcttcgattgagtgatatggtaaaagttttcataccaaatactcagctctgtcaagtattactggtgtagaatataatgggagtgcctgcagagagatgtattacacaaagctttgatctgatcctctctcagtggataacttagagctaagagctatacttgaaacacaacgtaatgtttcaaaataaatttttgccattatctgctgtataaattagaaaatataaacttctctttcatgcagaaataaaaaaggtcttggaaattccaagaattactagttttaaaaacttatattctcctaacaagctcttacattttcctatttctttttctttcttttcatttttttttttttattttggagacagagtcttgctctattgcccagcctggagtgcagtggtgccatctcagctcactgcaacctccacgtcctgggttcaagcaattctcctgcctcagcctcccaagtagctgggactacagtcatgcaccaccaatcccagctaatttttatattttttttagtagaggtgaggtttcgcaatgttggccatcatgctttcaggtgatccgcccacctcggtctcccaaagtgctgggattacaggcatgagccaccgcacccggccaacattttcctatttcaatactactttgtaccatagagattttaaatgttggaatatacagtagaagaatttgaaacctcatcttatatttttaaagcagaatatttaagtaatggaacccaaatgccaataaaatggcacaacattattatctgatgagaaggtttgacaccaacataactgaattataccacagttaagttttagaagtgaaaatctttgttttaaaaaatgcacataaaatattcataatcaaaaaaaaactttggtgacccatatttctttttttaaaagatagctgatactttatattatttcaatacatgatatcattagttttgagtatgaatttatgtttagaaccttttccttttgcttttcagtttaagatatgtaaaaataaataatatccctaagatacagttgtagatcaaaatattgatgatactagtttttacctaatggaaagtatttatgcttatatttacttgttcctcatttagggaaattcaaccaatttggaggttaaatctacttttctacattgcttattgaaaacacttaaacaatacataagtatagattcaatgggccccttctttcatcctgtgcccctaacttccactctcctaggtcaaaccactttatactttcaatagtttggatgtttgtcctccaggtaacattttattctcttatgtggcttgctttttctccctccttctcttctttcttgtcacctcattctctggctccctcccccaatttacaatatacatcctgatctacctctgttcttccagcttggcttggagaagaactggcagatgaacacgtcctgcatggtggaatgccctgtgaactgtcagctttctgattggtctccttggtcagaatgttctcaaacatgtggcctcacaggtttgtttgtaccataacttatattaggctactggtcaaggaatatgaaataaaatatccctcttgctttaacccatatcaaataatcttcagaaaggttggattggttgtctttctttgcaaaacatctaagccttacttgttcctggattgcctcaggagatatcactgtgatgccttctcccaatgagatatatgcttgcaaaaccataacatatattaaaggtgcatcactttgtatctcttcaaggaaaaatgatccgaagacgaacagtgacccagccctttcaaggtgatggaagaccatgcccttccctgatggaccagtccaaaccctgcccagtgaagccttgttatcggtggcaatatggccagtggtctccatgccaagtgcaggtatcaaatctcaagaagttgtcaggaagtgtgtactctatctgcagagacttcatctgcagaaaaacataaaaataatgtgttagaaatatgtttcagagctcacagatgacaagcttcttaaaatttgtatgtacttgccattttataaccatttaattagttttgataacaaaaactccatgccctatatttttaaaatcatttggagactgattcattttaatgaaaatttattttcctgtctttagctaggaaacaaattgttcaatgtatgctttattgctagtgccctatagggcttcttccctagggtttcaaatccttctctaaatgttcataaatcaaagtcagtggtgcagagataactaagtgatgagctctctaatgaagtatttctctttttctaattagttatttcttcctccattccaggaggcccagtgtggagaagggaccagaacaaggaacatttcttgtgtagtaagtgatgggtcagctgatgatttcagcaaagtggtggatgaggaattctgtgctgacattgaactcattatagatggtaataaaaatatggttctggaggaatcctgcagccagccttgcccaggtaacaacggcaaaggagaattcatattctgattattttttcctaggacaagggccgtgaaggggttgcatataaagtataagttacaggatgtcaacagtcttcttattcagtaatatctatgccaacagctcaacactatgcctgtggggaacgggacgctgtctcattactgccaggtagggttgaagtccaggtctcccatgtggcctctcaacaccctctggagttttaacatctgcaggagatggtatttaaggccttaagcccatgctccacagaaaagttatgaaataaaagatgagaaaataaggacaaaacataacctattcgggatttccagaagagagaaagagaggccaatgtttaaatacataatggctaaaaacagattaagtcctcataataacagcttaccctgggtccagggtagaatgaacaacaaactcatacctagataaatgtagtcaaaacataaaatatagaaaaataattagtaaagtcttcagtaagaaaataacagattatctacaactggaagacaaaatagcagtatggaggaaactattgaaagatattattcagattcagtgttagacacaatgagtgcatgcagtaaaagtagaaagaaaattttgtttatcaaatagtatggaaaaaatggcagacagtgataagctaatatttatgaatttgggcttgatgcagagaattgtagaggaaatttaatgtcaaaatatgccagaaaacccatccttgaacaaggtatagataggggcaacaatttattagtggactggaaatgaacagattgaaaatgaattacctgtattttatccccaagtggaaaatttgtattctcccaatttgcttataattatgatttaaagattgcatctctttcacaatattttcttttgaatgtgacctcaaaatattaaaaattaaggatttggcaaaaataatggggcataaaacacattttctatataaaaggatgtgatttaagaaaattttaaaagtggataacatatatcaacaaaaatttgtaaatgggattgagtccctaaaacctggaaaaactgacatgggctagctatttattcactcatcgagttacttattccttcgtaaaaaaaaaaaaaaatcatttgagatgataaaaatggtagggtatagtttaagatgaactgaatgaaattgaacagtaaataaaataaccctgataggggttattttgaggacaagccccctagactctgaaaatatccaactattgtattgatctttgcacacatggatattttcatctacttcaggtcaagaactaaactatttttaaaaaccaaaaatctgaatagcagctccttctcaatgagtgtaaaggttcagctatgcaaggtgaataagttctagagatccgttctaagacatagtgcctgtagttaacaatactgtattgtatacctaaaaatgtgttaagtgggtagatctcatgttaaatggtcttatcacaataaaaaataaaatagaataaaataaaatttaaaaataaagtaaaagaaaagaaaatctgactttctaaagccaggcaaagtgttgctgccaacaaccttttgctgagccagcaattcccctttcacttcctgctgctgaaactagtctgatatcatttaagatctcacacacaattcaataaaatcattttgcttcactgcagacccagcctaaggctgtggcagcaggtgacagctccaggcagggccaaggactgaacctttggaccttgatgtactgaatggccatagaggcaacaaaaagtgacccttggctaaaagttgtaaggcctacttttccaaaaccaaatctccagcaccagtaataggattgttgtgacattcacaccattgagcagaacgggcatccttgtcagactgtggtatatgccttactatggacactcctcacatgatttcattatactttctgcagcacacacactcactcatttgactgttacttatcaaatgtaattacaggtcaagccctggacttgaggccagagatacagtgcagaccaagagaccctgtccttgtacagcttactttctaatggaaagaacaattgctaatctaatagtgacaataatatataatatataagattataacctgtggtaaatgatgtgaaggaaaattacaggatcccatgataacatagagcaaacacattgttttaattaaagtaattgcaaatctaggaggctgctcttctcttctaaattacaatctattcatttcagttcctctcttgctagttttctctaatgatgggttttgaaagctggcagtatgtgaactaataagctttaaagagtagaatactaaattaggaaatacatctcatgtgtttaattgtcatatctttggcaggcatcgggtaattttattgttattacaatggtttacatggtcaaaatagaaaagtgtgtttaggacaagggagtatctcactctcatttgctgttattaaatctttgaagcctgacatgtattacttaggggcgaaaattacataactcacagactatcattaaaagatttattacattttgttgcaaaataaatgatgctaaatgtgaattgccacaaagataaagcctactggtgaaaaggtatgttttctttccatgtaattttcaatcactgaggtgaaattttattacattcatattgacaggaatttttttaactttagcagttttcctacataattaaaaactgagtaactccaaagtgacatttcctaggaaataaaagcgtttctaaaactttctcagactatttagaaattctttctagtttctttttcctttgcatttccaaaatttactagaactttctgtacttcaggagtaccaattacattctttaataaaggcctacaaaaatcactccattttgctattacgtatatatatgttagtcaataattcatgtcttaccaggacttcttaggcatgacacaagaagtttttccattaatcagatctccaggcaactttctgctaataccagtcaccttcagcataatataaggcaatatgaattattcatatgacctggctataataaataagtgataagaaacccttgtgaatttgtgtctatcataattgactgtgtactctgaagagtatcactaagcagtcactctgaagaatggatgggttaatggaaagggtgtatttcataaaatcttttctgttcttaaaatggctaaagattttggaagcatggatgcactatggcccagcaattgcactcctaggtacatacccaacagaaatgcatatataagttcatcaaaagacttgtactgaaatgtttacaataacatgatgggaaaaatttacaactccccacatgcccatcagtagtagaatggatatctaaattatgatatattcacacaatggaaagttgtacgaatgaagaaattagaacttcataaatgtatgatggatttcacaaacataaatgagagaaagaagccagacaccaaaaagtacatatggtatgatttcatatatcacacaagggagggttttgagatcctgggaatgttctgttccttgatttgggtgttgatcacatggttatataatcagattatcgaaattcagctatcatctgtgcatctatgatatgtgatcattttacatgtttgttatccttcaataaatcaatattttaaagagaagttgattgaggatgtagatcagaggaaatagtgagcattatttccagtactgcaactgctcagttgtctctctcacctccactcatctgggaagaaataggaatgaaaacataaaaccagctctgtcggccttggatttcaaacttttcaaaattgtgaatacctagaagactaattctgtttatatttaggctttctttgagtgtaactcatgtgtaataaaccactttactatgataatgacaagaatgatagtaggttttgatcaaatatttgttgtatcctaagaagagatgaattacggtggatgagctcctgtcagccacaatttacctttgatatcattaagcaacacatagaccagtaatagccatacggaaaataacaatacatatacaaagttatacaattacaaatttacaaatattaaatgcttatttaaatcttataaatattatgtgtgcctgggataccagaaacattgcctactggggttggaattaaaatgattatcgggctggcttttctctgtggatatgggtgtaaattacaaatatgtgttttacaggtgactgttatttgaaggactggtcttcctggagcctgtgtcagctgacctgtgtgaatggtgaggatctaggctttggtggaatacaggtcagatccagaccggtgattatacaagaactagagaatcagcatctgtgcccagagcagatgttagaaacaaaatcatgttatggtgagtgctaccgttcatatactctatcttaagcaaaagcataagattaaaaaaaaaatagtctgttaaaaataaacaaagttggccacgtgcggtggctcacgcctgtaatcccaacgctttgggaggcctaggtgggcggatcacctgaggccaggagttgtgagaccagcctggccaacatggccaaacccaaactctaccaaaaaaaaaattatgcatggtgtcaggctcctgtaatccaagctactcaggaggctgaggcaggagaatcacttgatcccgggaggccagagactgcagtgagccgagattgcaccactgcactccagcctgggcaacaagagtgaaattccatctcaaaaataaataaataaataatttaaaaatttactcagatgtcacttgaggctgaggactaaagtaaggggaagattctgaattctaaagattggaaagatggaacatcctgccacccttcataaataaggtgtgagttttgcaaaaatgtttcccggttttatgagctcaagaaggctgagataattaggagcacattatttgtacgcttataacaattatgatcaggtaggagtctaacaatcttcaatttatttaaatcaaatgacacaattaaataaaaattacaaatccacagcaaagtgtgagattttactatattttttcaaatggataaatcaaattattggtaaaaattgattttaatctgaattttacttagaatatatataaacatctatgtttatatgtctgtgtgaacgtatacacacatagaatcattcactcaatgtaagcaatacatcttcaagaatcacagcattaaatgtcgtggtttgggaaacaacacccgaagactcgaaaacaaaagaattgctatttggtagagggtgtggggctcaacaaacaacccttaatgctgctgatgttctgaaataagtaatatgacatagtagcaagtaggagacaaaatatcacctttcttactgaaaagtaggagacaaaagcttaaagtgttggaaaagaatacttgcagtaaaaaccaaatgggctagatgacttagcccaagaattagatggaattacctgctctgtcaatttgatcttcctaaatttatcaactaggtaaaacactccatatgccagcataggataagtaaagagtaaagaaaggtcaaaagttacaataaataaaataattcccaaggcaagaaagaaaagtattcactccaaaatgacaaggaaataaaattaggaatcaatagaacaatgacaaaagagatctccacacgcacaccttagagagtaaaatcatacctctaaagcattatccagcaaatgttatatgggatgcagcaaagaagtacctagaggagatcttgaagctttaaacgcttctacagaagggagaaaagttaaaaatgaactaagcattcaactgaataaattcttttttaatttttttaattatactttaagttctaaggtacatgtgcacaacatgcaggtttgttacatatgtatacatgtgccatgttggtgtgctgcacccattaactcgtcatttacattaggtatatcttctaatgctatccctcccccctcccccgaccccataacaggccgcagtgtgtgatgttccccttcctgtgtccaagtgttttcattgttcaattcccacctatgagtgagaacatgcggtgtttggtttttcgtccttgccatagtttgctcagaatgatggtttccagcttcatccatgtccctacaaaggatatgaactcatccttttttatggctgcatagtattccatggtgtatatgtgccacattttcttaatccagtctatcattgatggacatttgggttggtcccaagtctttgctattgtgaatagtgccgcaataaacgtatgtgtgcatgtgtctttatagcagcatgatttatagtcctttgggcgtatacccagtaatgggatggctgggtcaaatggtatttctagttccagatccttgaggaatcgccacactgtcttccacgatagctgaactagtttacagtcccaccaacagtgtaaaagtgttcctatttctccagatcctctccagcacctgttgtttcctgactttttaatgatcgccattctaactggtgtgagatggtatctcattgtggttttgatttgcatttctctgatggccagtgatgatgagcattttttcatgcgtctcaactgaataaatttttaagaaaagcaaaaaggaaatggaatgcaaccaacatggatgagtataaattcagtgagacagaaaataatcaacaaaaccaatagattgtttttagagcaaactgacaaaatagaccagctcatggcaaattcagtgaagaggaaaaaaaaagcaaagttgtcattaccataaataaaataaagtttagaaaaatagaatataattcggtgaatagctttttctaacagaagtaaaaatgtcaagataatttagaaggttatattttatcaagagtaatgaaaaacctacaccatagattatataactattttcaaacctatgaaatacatactcacatatgcacacaaactaaaatttaaatggctttaattatgagttttcccaaaatttaaagaaacagacaactccttgttgagatttgatcaggctggtgggaaaaataccagttatgatagccacaaaacccttttggaaggcctgagggttttcacatgactttggtaatagacctggtagaaggcggcctagtcccattacctttagttaaatagattagagtagtaaacaacgggatgtgaggaagttatctagttagcttgtttacccacgtggtctcaagatgagcctttgatacatgctttttactctttaagtccacaatgtcaattaccgtctaatggcattgactcaagcttttgttaactaataaatgtgagtctccctcactgatcagggctggctgcagtgacaaacctctctggtgtgtagatggtcagacactcagcaggactggcaaaagataatatctgtgtgtcagtgtacgttttattcatccatcgctggggtcagggtctgcagacagacccccgtagctaatgccctcttgtgaggagcaatacttcaactcctacttacgtgaaatctttttttttataagaacatattcttttcttaatatgaattacatttagtttctttttttaattatactttaagttctggggtacatgtgcagaacgtgcaggtttgttacacaggtatacacatgccatggtgatttgctgcacccatcaatccatcatctacttcatctactttacgtatttctcctaatgctatccctcccctagcccctacccctcgacaggccccagtgtgtgatgttcccctccctgtgtccatgtattctcattgttcaactcccaattatgaatgagaacgtgcagtgtttggttttctgtttctgtgttagtttgctgagaatgatagtttccaggttcatccatgtccctgcaaaggacatgaactcatccttttttatggctgcatactattccatggtgtatacgtgccacattttcttcatccagtctatcattgatgagcatttgggttggttccaagtcttcgctattgtgaacagtgctgcaataaatataaatgtgcatgtgtctttataatagaatgatttataatcctttgtgtatatacccagtaatgggattgctgggtccaatgaatcaccattggaatcaccatgctgtgttccacaatggttgaactaatttacagtcccaccaacagtgtaaaagcattcctgtttctccacatcctctctagcatccattgtttcctgacttttaaatgatcactattctaattggtgtgagatggtatctcattgtggttttgatttgcatttctctaatgaccagtgttgatgagctttttttcatgtttgttggctgcataatgtcttcttttcagaagtgtctgttcatattcttcgcccactttttcatggggttgttgttttcttgtaaatttgtttaagttctttgtagattctggatattagcctcttgtcagatggatagattgcaaaatttttctcccaatcagcaggttgcctgttcactctgatgatagtttcttttgctgtgcagaagctctttaattagatcccgtttgtcaattttggcttttgtggccattgcttttggtgttttagtcatgaagtctttgcccatgcctatgtcctgaatagtattgcctaggttttcttctacggtttttacggttttaggtcttgggtttacgtctttaatccatcttgagtgaatttctgtataaggtgtaaggaaggggtccggtttcagttttctgcatatggctagccagttttcccgacaccatttattaaatagggaatccttttcccattgcttttcttaggcttgtcaaagatcagatggttgtagatgtgtgttattatttctgaggcctcggttgtgttccattggtttttatatctgttttgctaccagtaccgtgctgttttggttactgtagccctgtggctgtgggtttgacataaatagctcttattattttgagatatgttccatcaatacctagtttattgagagtttttagcatgaaggggtgttgaattttgtcaaaggcctcttctgcatctattgagataatcatgtggtttttgtcattggttctatttatgtgatggattacgtttattgattcacatatgttgaacccgccttgcatcccagggatgaagccgacttgatcatggtggataagctttttgatgtgctgctggattcgatgtgccagtatgtgattgtggattttcacatcaatgttcatcagggatattggcctgaaatttgtttctctttattgtgtatctgccaggttttggtatcgggatgatggtggcctcataaaatgagttagggaggagtccctctttttatattgtgtggagtagtttcagaaagaatggtaccagctcctctttgtacctctggtagaatgtggctgtggatctgtctgttcctgggctttttgtggttggtaggctactaattactgcctcaattttagaacttgttattggtctcttcagggattcagcttcctcctggtttagtcatgggagggagtatgtttccaggaatttctctcttctaaattttctagcttatttgtgtagaggtgtttatagtatgctctgatagtggtttgtatttctgtgggatcggtgatgatatcccctttatcattttttattgaatctatttgattcttctctcttttcttctttcttagtctggctagccatatatctaaattgttgatcttttcaaaaaaacagctccttgattgatttttttaagggtgtttcatgtctctatcaccttcagctctgctcttagttatttcttgagttctgctagcttttgaatttactcttgcttctctagttcttttaattgtgatgttaaggtgttgattttagatctttcctgctttctcctgtgagcatttagtgctataaatttccctctaaacacagttttagctgtgtgccagagattctggtatgttgtgtctttgaactcattggtttcaaataacttacttacttatttctgctttagttttgttatttacccagtagtcattcaggagcaggttgttcagtttccatgtagttgagcggttttgagtgggtttcttaatcctgacttctaatttgattgtactgtgtctgagagactgtttgttatgatttctgttcttttggattttctaaggagtgtttgttttacctccaactatgtggtcaattttagaaaaaatgcaatgtggtgctgagaagagtgtatattctgggccgggcacggtggctcatgcctgtaatcccagcactttgggaggccgaggcgggcggattacaaggtcggtagtttgagaacagcctggccaatatggtgaaaccccatctctactaaaaatacaataatcagctggacatggtggcgggtgcctgtagtcccagctactcgggaggctgaggcaggagaatcactttaacctgggaggtggaggttgcagtgagctgagatagtgccactgcactacagcctgggtgacagagcaagattctgtctcaaaaaagaaaaaaaaaaaaaaaagaatgcatattctgttgatttggggtggagagttttgtagaagtctattaggtctccttggtccacagcttagttcaagtcctgaatatccttattaattatctgtctcattgatttgcctaatattgacaatggggtgttaaagtctcccactattattgtgtgggagtctaactctctttgtaggtctctaagggcttgctttatgaatctgggtgctcctgcattgggtgcatctatatttgggatagttagctgttcttgttacattgatccctttaccatatgtaatgctcttctttgtctcttttgatctttgttggtttaaagtctgttttatcagagactaggattgtaacccctgctttttttttttttgctttccatttgcttggtaaatattcctccatccctttattttaagcctatgtgtgtctttgcacgtgagatgggtcacctgaatatagcccaccaatgggtcttgacttgttattcaatttgccagtctgtgtcttttaattggggcatttagcccatttacatttaaggttaatattgttatatgtgaatttgatcctgtcattgtgatcctagctggttattttgaccattagttgatgcagtttcttcatagtgtcgatagtctttacaatttggtatgtgtttgtgctgggtctgtcccacagaccctggccgaccgatgaatgaaatgagtactcggccacaggtatgcagtgtaagagcagctaggcgtctgcctggctatagctgccaaagtgcagccccgagaagctggagctgcatgcttttattcagtgtaggcgtgattccaaaagcctggagcaaacacaatctgtgggtaactaacatttattgttcccctttcaaggaacatcacgtgtgcgggtgatcaaagatcggttcttggtcaacacaagtaaacaagcctgtttaagataaattcccctacactcccttgtacctactccttgccctctgcctcagggtcagagaacagctgcctttggctattctcccgcaaagccaggcagagccttcgcacctttccgaaggcctgctcctttccctatagtttctcccaccactctgactgatctacatgtttgcagtggctggtaccagttttttctttcaatattgagtgtgccctttaggagctcttgcaggcctgctggtgacaaaatctctcagcacttgcttgtctgtaaagaattttatttctcctttgcttatgaagcttagtttggctggatgtgaaattgtggattgaaaattctttaagaatgttgaatattggatcccaatctcttctggctcgtaggatttctgcagagggatccactgttagtctgatgggcttccctttgtgggtaacctgacctttctatctggctgcccttaacatttttttcgttcatttcaacctttgtgaatcggatgattatgtgtcttggggttgctcttctcaaggagtatctttgtggtgttctctgtatttcctgaatttgaatgttggcctgtcttgctaggttggggaagttctcctggataatatcctgaagagtgttttccaacttggttccattctccccatcactttcaggtacaacaatcaaaggcagatttagtcttttcacatagtcccatatttcttggaggctttgtttgttcctttttattcttttctctctaatcttgtcttctcactttatttcattaagttgatcttcaatctctgatattgtttcttctgctttatcgatttggctattgatacttgtgtatgcttcacgaaatttttgagctgtgtttttcagctccatcaggtcatttatgctgttatctaaactggttattcttgttagcaattcatctaacttttttcaaggttcttagcttccctgcattctgtttgttagaacgtgttcctttagctcagaggagtttgttattactcaccttctgaaggctacttctgtccatttgtcaaaatgattcttcatccagttttgttcccctgctggcgaagagttgtgatactttggaggagaggaagcatttgggtttttggattttcagactttttgtgctggtttttcctcgtcttcatggatttatctacctttgatgttggttaccttcagttcggggtctctgagtggacatccttttttattgatgttaatgctattcctttcttcttctaacagtcaggaccctctgctgcaggtctgctggaggtccactccagaccctgtttgcctggatatcaccaacggaggctgcagaacagcgaagattgctgccagttacttcctctgaaaacttcatcccagaggggcacctgccagatgccagccagagctctcctgtatgaggcatctgtcaacccctgctgagaggtatctcccagtcaaagacacaggggtcagggacccacttcgggagagagtatgacccttagcagaggtcaaacactgtgctgggagatctactgctctcttcagagccatcaggcagggatgtttaattctgctgaagctgcacccacagctgccccttcccccaggtgctctatcctatcccagggagatgggagtttgatctataagcccctgactggggctgctgcctttctttcagagatgccctgctcagggagaaggaatctagagaggcagtctggctacaagggctttgcagagctgtggtgggctctgcccagttcaaacttcccagcagctttgtttacactgtgaggagaaaactgcctactccagtctcaataatggtatacacccctcctcccaccaagcttgagagtcacaggtcatcttcagactgctgtgctggcagtgagaatgtcaagccagtggatcttagcttgctgagctctgtgggggtgggatccactgagttagtccactcagctccctggcttcagccccctttccaggggagtgaatagttcggtcctgctggtgctccaggccccacttgggtatgaaaaaaaaactcttgcaactagctcagtgtctgcccaaacagccacccagttttgtgcttgaaacccaaggccctggtggtgtaggcacccgagggaatctcctggtctagtgggttgcaaagaccatgagaaaagcatagtatctgggccggaatgcaccattcctcatggcttcccttggctaggggagagagttccccaacccctcgcacttcccaggtgaggcaacaccccaccctgcttcagctcaccctccatgggctgcacttactgtccagccagtcccaatgagatgagccaggtacctcagttggaaatgcagaaatcacccaccttctgcatcaatctcactggaagctgcaggctggcactgttcctatttggccatcttggatccaggatctccctatgtgaaatcttaaaaaaagaagttgagattctgggcaagatggccaaataggaacagctccggtctgcagatcccagcgagatcaatgcagaagatgggtgatttctacatttccaattgaggtacccaattcatttcattgggactcgttggacagtgggtgcagcccacggagggcaagctgaagcaaagtggggcattgcctcacctggggagcgcaaggggtcagggattccctgccctagccaagggaagctgtgaaagactgtgaacggtgtactccagcccagatacatcgcagtctttgcaacccgcagaccaagagattccctctggtgcctccgccaccagggccctgggtttcaaccacaaaactgggtggcaatttgggaagacacctagctagctgcaggagctttttttcataccccaatggcacctggaatgccagcaggacagaaccattcactgccaggacagaaccattcactgccctggaaagggggctgaggccagggggccaagtggtctggctgggcaggtgccacactcacagaacccagcaagctaagatccactggcttgaaattctcgctgccagcacagcagtctgaggttgacctgagatgctcgagctggggaggggcgtctgccattactgaggcttgagtaggctgttttaccttcacagtgtaaataaagtcaccaggaagttcaaactgggcagagcccacaacagctcagcaagtctgctgtggccagaccgcctttctagattcctcctctctgggcagggcatttgtgaaaaaaaaggcaggagccccagtcaggggctaatagataaaactcctatctatctccctgggacagagcacctggggcaaggggcactgtgagtgcagcttaggcagacttaaacatccctgcctgatggctctgaagagagcagcagatctcccagcacagcatttgatctctgctaaggaacagactgactcctcaagtgggtcccgaccccacgtctcctgactgggagacacctcccagtaggggacaaaagacacttcataaaggagagctctggctggcatctggcaggtgcccctctgggatgaagttttcagaggaaggaacaggcagcaatctttgctgttctgtagcctctgctggtgatatccaggcaaatagggtctggagtggacctccagaaaactccagcagacctgcagcagagggttctgattgttagaagaaaaattaacaaacagaaaggaatagcattaacatcaataagaaaggacgtccactcagagaccccatccgaaggtcaccaaaatcaaacaccaatggtagataaatccacgaagatggggagaaactagctcgaaagggctgaaaatttcaaaaaccagaatgcctcttcccctccaaaggatcacacctcctcaccagcaagggaacaaaactggacagagaataagtttgacgaattgacagaaggtgggtaataacgaactcctctgagctaaaagagcatgttctaaccaaatgcaaggaagctaagaaccttgaaaaaaggtcagaagaattgctaacatgaataaccagtttagataacaacataaatgacctgatggagctgaaaaacacagctcaaaaatttcgtgaagcatacacaagtatcaatagccaaatcaataaagcagaagaaacaatatcagagattgaagatcaacttaatgaaataaagtgagaagacaagattagagagaaaagaataaaaaggaacaaacaaagcctccaagaaatatgggactatgtgaaaagactaaatctgcctttgattgttgtacctgaaagtgatggggagaatggaaaacactcttcaggatattatccaggagaacttccccaacctagcaagacaggccaacattcaaattcaggaaatacagagaacaccacaaagatactccttgagaagagcaaccccaagacacataatcatcagattcacaaaggttgaaatgaacgaaaaaatgttaagggcagccagatagaaaggtcaggttacccacaaagggaagcccatcagactaacagtggatccctctgcagaaaccctgcaagccagaagagagtgggggcccatattcgacattcttaaagaaaagaattttcaagccagaatttcatatccagccaaactaagcttcataagtgaaagagaaataaaattctttacagacaagcaaatgctgagagattttgtcaccaccaggcctgccttaccagagctcctgaaggaagcactgaacatggaaaagaacaactggtaccacaaacgtaacaaattgtaaaggccatcaacactatgaagaaactgcatcaactaacaggcacaataaccagctagcatcacaatgacaggatcatattcatacataacaatattaaccttaaatgtaaatgggctaaatgcccccagttaaaagacacagactggcaaattggataaagagtcaagacctatcagtgtgctgtgttcaggagacccatctcacgtgcaaagacacacataggctcaaaataaagggatggagggatatttaccaagcaaatagcaaaaaaaaaaaaaaaaaaaaaaaaaaaaaaaaaaaaaaagcaggagttgcaattctagtctctgataaaacagactttaaaccaacaaagatcaaaagagacgaagaagggcattaaatatggtaaagggatcaatgtaacaagaacagctaactgtcttaaatatagatgcacccaatgcaggagcgcccggattcataaagcaagttcttagagacctacaaagagacttagactcccacacaatttaacacaccactgccaataatagactgatcaacatgacagaaaattaacaaggatattcaggacttgacttgaactcagctctggaacaagcagacctaatagacttctacagaactctccaccccaaatcaacagaatatacattcttctcagcaccacatcacacttattctaatagtgaccacataattggaagtaaaacactcctcagcaaatgcaaaagaacagaaatcataaacagtctctgagatcacagtgcaatccaattagaactcaggattaagaaactcactcaaaactgcacaactacatggaaactgaacaacctgctcctgaatgacttactgggtaaatattctctgaaagcaatgagaacacagactcaaagtaccagagggaagtttatagcactaaatgcacacaatagaaagcaggaatgatctaaaatttacactctaacatcacaattaaaagtgctagagaagtaagagcaaacaaattcaaaagctagcagaactgaaggaaatagagacacaaaaaactcttctaaaaaatcaatgaatccattacctggttttttgaaaagatcaacaaaatagatacactgctagccagacgaagaaagaagaaaagagagaacaatcaaatagatgcaataaaaaatgataaaggggatgtcaccagtgatcccacggaaattcaaactaccatctgagaatactataaacacctctatacaaataaaataggaaatctagaagaaatggataaattcctggacacatacatcctccaaagtctaaaccaggaagaagtcgaatccctgaatagacgacaagttctaaaattgaggcactaattaatagcctaccaaccacaaaaagtccaggaccagatggattcacagtcaaattctaccagaggtacgaagagaagctggtaccattccttctgaaacgattccaatcaatagaaaaagagggaatcctccctacctcattttatgaggccatcatcatcctgataccaagacacaacaaaaaaaaaaagaaaatttcaggccaatatccctgatgaacattggtgcgaaaatcctcaacaaaatactggcaaactgaatccagtagcacatcaaaaagcttatctaccacaatcaagtcggcttcatccctgggatgcaaggctggttcaacatacgtacatcaataaacataatccatcacataaacagaatcaatgacaaaaaccacatgattagatgcagaaaaggcctttgtcaaaattcaacacccattcatgctaaaaattctcaataatctaggtattgatgaaacatatctcaaaataataagagctatttatgacaaacccacagccaataccatactgaatgggcaataactggaagaattccctttgaaaactggcacaagacaaggatgccctctcttacgactcctattcaacatagtatgggaagttctggccagggcgttcaggcaagagaaagaaataaagggtattcaaatagtaaaagaggaagtcaagttgtctctgtttgcagatgacatgattgtatatttagaaaaccccatcatatcagcccaaaatctccttaagctgataagcaacttcagcaaagtctcaggatacaaaatcaatgtgcaaaaatcacaagcattcctataaaccaataacagaaaaacagccaaattatgagtgtacttccattcacaattgctacaaagagaataaaatacctaggaatacaacctacgagggatgtgaaggacctcttcaaggagaactacaaaccactgctcaaggaaatcagagaggacacaaataaatggaaaaacatcccatgatcatggataggaagaatcaatattgtgaaaatggccatactgcccaaagtaatttacagattcagtgctatccccatcaagttaccattgactttcttcacagaattagaaaaaaactactttaagtttcatctggaacaaaaaaagagcccgcatagccaagacaatcctaagcaaaaagaacaaagctggaggcatcatgctacctgacttcaaaccatactacaaggctacagtaaccaaaacagcatggtactggtaccaaaacagatatatagaccaatggaacacaatagaggcctcagaaataacaccacacatctacaaccatctgacctttgacaaacctgacaaaaacaatcaatggggaaaggattccctatttaataaatggtgtcgggaaaactggctagccatatgcagaaaactgaaactggaccccttccttacaccttatacagaaattcactcaagatggattaaagacgtaaacccaagacctaaaaccgtaaaaaccgtagaagaaaacctaggcaatactattcaggacataggcatgggcaaagacttcatgactaaaacaccaaaagcaatgggcacaaaagccaaaattgacaaatgggatctaattaaactaaagaacttctgcacagcaaaagaaactatcatcagagtgaacaggcaacctgccgattgggagaaaaattttgcaatctatccatctgacaaagggctaatatccagaatctacaaagaacttaaacaaatttgcaagaaaaaaacaatgccatcaaaaagtgagcaaagaatatgaatgagcacttctcaaaagaagacattatgcagccaacaaacatgaagaaaagctcatcatcactggtcattagagaaacacaaatcaaaaccacaatgagataccatctcacaccagttagaatggtgatcatttaaaagtcaggatacaatggatgctagagaggatatggagaaacaggaacgcttttacactgttggtggaagtatcaattagttcaaccattgtggaagatagtgtggtggttcctcaaggatctagaaccaggaacaccattggcctcagcaatcccattactgggtatatacataaaggattatgaaccattctattataaagacacatgcacacatatgtttattgcagcactgttcacaatagcaaagacttggaaccaacccgaatgcccatcaatgatagactaggtaaagaaaatgtggcacatatacaccatggaatattatacatccataaaaaaggatgagttcatgtcctttgcagggacatggatgaagctagaaaccatcattcttagcaaactgtcacaagaacagaaaaccaaacaccacacatgttctcataagtgggagttgaacaacgagaacatatggacacagggaatggaacatcacacaccggttcctgtgagggggtggaggtaagggggagggatagcactaggagaaatacctaatgtagatgacaggttgatgggtgcagcaaaccaccatgtcacgtgtatacctatgtaacaaacccccagttactatgagagtataaccttggcagtaaaaccagttaaaaataaagttacttatgaaagtagatgtcaaaatcataaaaataaaatattagctaaccaaattaatatttaataatatgactataattgttgaaatacaaagataaccaaataattgttgaaatacaaagataaccaaatattaataaaatctcttaatgtaatttatcacattaacagaaataaagatataattttttatacacattaaaaggtatttctaaaattcagttcactttcacaataaaaacttgtagaccaaacttgaactagaagagaatctttttacttaataaataaggtctatcaaaatttacacaaacatcataatacatggggaaacattagaggcaggctcttggaatcaataacagaacaaggataccactgttgccacttattttcaacctagtgaaggaggttccagccaagtgtcatcagaagtttaagaattgaaaatgaaaaaataaaattatcattctcatagtatatgaatttcacattttagacaatcaagataatttatagacgactgtttggaagtaagaaaattcagaaacattgtacaatttaaaaaccaatacacaaaataaatagtcttttttttttttttaaccagcaaaactgttataaaattgaattggaaaaagctgcattgacaataaaactaaaactataaaaaataaatgcaaccaaaatcatctaagataggtatgaaaaattataaaatcttattggaagatatgaaactaaaacgttggtgaaaatgtttatgaataaaaagccccaatattataacatgtaaattttatacagatttacctataaaatctatgcaatttgaacaggttgttaatgtaatctgagaaattgatcctaaaattaagtcagaggagttaaaggccaagaagatcccagaatgtttttaagaaggaaaagtgggagactaattcaagggacttacatggctttatatcaagacttactctaaagcatcaatagttaaaaagggtaattgatcaacaattaagccattagactaaaagaatagaaaagagaatctccacgacaaattcttatgtaggtaagtaagtggcagagggaaagtcagtgggagaatgagtggatgaataatattgccaaaatgtgttatccatatcaagttttaaaaaatatctttagcttacatcacatacaaaactatattttcaataaattatagacctaaagatgaagaacaaactgtaaatactaaatataagaggatattttcatgaactcaaggtagagaaggatttcctaaatatgacaccaaaagcacaaacaaaaatgaaaaaattttaaatttctttaaattaaaatttaaaacttctacacagtagaaggttacaggacaagccacaaacttgaaaaatatacttatgaagccaattaatttcaaaggattcatgtctagaatagcaaatctagaactttttgatccaaaacaagttaatagtcttaaaattgttgaggacctgaaagaactgttcttttctgacatgtataattttaaaaatagaaaacttataatatttattaatttatttaaaatgatcaaaaaacaaaattgtatgttactataaataacaaatttcctgcaaaataagttcaccataacaaatggaaaataactttaatgacgagagtggtcttgtttggatttttgcaaatctctgtgaagtctaacttaagacagctggattctcttatctgcttctgcattcatcttattgcaatcttattttagtttatgtatgtaaagaaaatccaaccttacacagattgtagttgcaaagaggaaatcctcactcacactctgaaagaatgtcagtgtctcccagggtctctgaaccgcactttaagaatcactgttccagaatgaagaatttctacaattcaatgagaaaaaatatagaaggccaaatgtttaaataagcagcttgcataccaggagatccaaatgtcctgaaacatttttgttactgttcaataactttagtaatcaaggaactttaatttaaaatgacaagataactttccatacccaaaagactaaccaaaaaaaattaaaatctggcaattataaattttcatgagtgtttagagcaatggcagtctttatgcactactgatggatttgtaaattgtcaccttttgcaggaaaaaaatgggcaatatttaataaagtttcagctagccatacagtgataccaagaaatttcccttctagatatgtaatttaaagaagcaccaggccatttgcacacagttgaccttcagagcattgtttgaataacaaaattaaaaataatctaatagaaaaatagctaaataaactgtgttatgtagtacaatggaattctatgtagccgttaaaataaactgactgtactacattttttaaaatcacttagaagtatttcacctgtaacattgactaagtttcagaatgctacacagaataggatacatttttaaaatttatgactgtatgaaagtaataccatatatcatttctgtatatagtaattatgtgtgtgtgcgtgtgtgtatagtgaaaaaattaaaagcatggcaaagaaagtcatacatcttcagaatagtatgtattgctggacagacagggagggtgatcagaacagaaaagaatataattatatatctcatgttttattcatcaacaagctaatgaaaactgaggcaaatatggataaataatatttgttaaaattgcatgatgggagatatatatatatatataactatatatatatacagttattctctatacctggctgcatatttatttcataatattttttaaaaattaaattaaaaacctaggttcccaccaggtagtgtgacagcagacatggaaaattagttgggattgaggtatatagctgcaattttaaacatatgcatggcaacttcaggacaataaattgacatttgaatcatcagagatgagcttattacttttcagtaatatgttattaatactctatccccatgattgtccttctgggtaacagaatgcttctgctaatgtttattatttccctgcagatggacagtgctatgaatataaatggatggccagtgcttggaagggctcttcccgaacagtgtggtgtcaaaggtcagatggtataaatgtaacaggtaaacctccagtttctctttgtcctttgaaaatcttcctgtaacacacatgtgattggttgaagaaaataattaaggaaacaaagttactctttcagtattcaaagcctgtttgggattcaggatgcctaagctgtatatacccatctggtgaccaatgacaaattattttattttataggtggttcaaattatctctcacctagcctttttaggtattgctgctgaaacttaattaaaatactatctaattctaataaataattgttataaataattttcagatcttttctagaaattttatatatgagtaacttactatatgtttaaaaatcaatttttttgactttctgcttctgtgccttgaaggcaatataaatgcagaccaaaaataccagcaagggaatatgattatacaaatccaaataccttgcttaaattcagaagtctatgatttagagatttttaaattaattaatagggaagacctactggtaaatttcaaacccagaccatctgagcagctgacctactgtgcctgcatccccaaattattatatatccaaagaagaaatccaaaggaagaactttatttgattgtacttcgaccaacatatacctccaaagaactactctagtgtggaattactaaaagcctatctgaagcctgtaagcgtgagggatcctaaggaccccttgaaggaggaagagactttggctcaagataggtagtgaaccaccaagcaaatttcctagaaagaaatacaagtcagaaccagaaccttaatttcaggcacatggacccagaaatctaagcctttccataagcaatttctttttataaatctaacttataggaattgccatagcatagcaacagcaggagtcttgacagttaactgctcaggcagacctgcttacttgctgctgttttgaccctgctgcgggggaaaaaacagtgtgcatttggatgcctctgagtgatgtttgtttagaaatttaactttaatatatacagtaagaaacaggagcaaggatcaatatggtttttgaaaactatccatctttatattgaattttaaattacctggatttattgaaacccaattacttatttcctccatatgggagctggatcaggatgtcaatttttttcttgtgaagatatgattttatacatgagaaagctctctcaagaaacccttaataataacaactccctgtggtcacatacggaacaaagaaaagacatctagtagaaaccctttgctctctcactgtattattttttgggagaaaaatctgctccatctaccccactctaagaggtatggagtgagaagagtcctgagagggatagacaggctttctgaatgaggaggtgttacagaagtcatccattgagctcagagattggaaacgaatgtctccattcttttttaaactattcaaagaaaatttaacagcttctctagatgatcctgtaagtttgcagttttttttcaataatggatgcaaataatatttacctgacttttcttctacatattcaaaactctttttccactgcaattggggctattcccccaatgcaaaggtaagtcgaattttaaaagacttacctataaaatcatatttttaatttcttttcaattcagcaaagtgtacaatggattatttctaatgctattcagtaccaaaaggccaatgtgtaaatgatttgtgttaagctctatatgcattcttctttcatcttttaggagagatgagattctttatgacaaatagacaagcatgtaaagtatattacctatcttgatcaattgctttaatttatgaattgtccttgtaagaaactcaaaatactgctttgtgtgtgtgtgtttaataataacttcagtgtggccaattaactgcgattgccttgcaatgactaactgcttttctgtgacaatttttctatgagtattttgtgattataatattgagagaaacacagacaattagcaataggcgcctgtgattaaattccagagaatcatcagttccataaataaagaaaaaattttgttttgctaaaattctgttaaactgaacaagtatagtttgaaaataggagcttccttcacgtcaccaatgttttttatgacatctatttccatcttaaaacctcacttgagacaaattaggcacagttggtactacacttgaaaataaacgagataaacagctgtaatatcaagttaaaaccatagtgcaaaacaaatgatttcgtagatacatttgttttcttctctatatccaaaaaacaccatgaattagcagaaattgtgacttttctgaaaaagaaatatgcattatttaaagaaaacatttatttaacataaagagctgaagagttatttcaaagtacgtgaaaactattgttttgaatctccaagaaagaattttaacttgaaatgaaatcagcttttcaattgctggacttggattcatgtgctcctgacagaaaaagcttgtgtgcaattagtattttcaaaatagcagctataaaatcattctttcaacaaatgcttgttgaatacctgctgagtaccaggcactgagctagctcccctgggtaaaaagggcctggagtcactacataaggtggtcaaggttaaccaaatatttcacagtcaaccactgacagaaaaattcctgggattcccaaggtggttcaagattcaaagacaagtcactaaccacagtgtattttcatcatagcaaaatatattatttgtcaaaacatgattttctgttccgcagggggctgcttggtgatgagccagcctgatgccgacaggtcttgtaacccaccgtgtagtcaaccccactcgtactgtagcgaggtatgtgaaaattcatcagggcagacaagccagctccatcatgtgtcaccccactgtctcttatgcagtttatcttcctccaaagaaagcatgtcttgaggcataaaaatcccattttagacatctccttttatcaatctaaaaagtcctgacttcacttgctttcacctttagaatacattttcatataatgccaaaagtatgtttctttgtagttaaaaataatagaggaattatgtatagtaattcccaaaacaaaccttgtttaaagccttctcttcaagtcaggtctgttagacttccaaagattccttgcatggctagtataaatcttcttgttctcctgcagacaaaaacatgccattgtgaagaagggtacactgaagtcatgtcttctaacagcacccttgagcaatgcacacttatccccgtggtggtattacccaccatggaggacaaaagaggagatgtgaaaaccagtcgggctgtacatccaacccaaccctccagtaacccagcaggacggggaaggacctggtttctacagccatttgggccaggtgaactgactagactagtgttgaaagagaaacctttagttcttttaggcaatgccaaaggattaaaaaagtgagcaaagcatttttatatgagctattgattattttatctacatgcatttattctgatagtgccatctattcttcaattttttactatcattatggaaaataactcatgtttgaagttcagagaaatgaaattacattcttctgagaaaaaattttggatcaatataattcaattcaattccagtccaaaaattacaagtataattaatttcaaattgaacaaagttagaaacatgaattttaaaaaatgtgttgtcattcagaactaggataaaggagactataaagacattccagaatttttcatttgatcataggaacagtaatagtttgacccttaaataaaaacatcactaatgcagttctgtgccagggcacacgtggtagctagaccagtttctattagccctaaaagtcagcatactcaaatacttggaatctgtactagtgccagataaacagggagacaatggagccttcccttctggataggatgatccaaatttgttttcacattcacagacagctcttaatgtatctggtaataaatgcaaagccaatacaggcaaatgcttgaatacctcatgatatgctattctctactctgcacactttccctcctcagttggatttcatcatatgctcatccctagaactaacctggtgcttgaaaatgtgctacatggattataaagcagctaatatgccactttttctcacaacctggaagaactactagtctatgaagtaatctccaggcagagccaggcatagtctactttaaaatgccattagaaacatgagaaaagatggaaggaatctgcatagctagcacatctccatttctatgcattaagtctgaatactttcccttattggagaataaatattggatttttaagatattttaagtgtttgggtgatttgcttttaatcacattattcctgctttaattggcttatttagctgatagtatgatttattttgcaaagctgacttatctgtgtaagcatgggaaactcttccctcagtgtttaagacaatggactagcagacaaccagtagcaattttgaccttcactaagaattgaagcagatctcctcagatcaaaaccagtccttttgaaaaaaaaaagaatattattgtcattattttaaattttatatatagtttccccaaagttaaaattttaaaatatttaaaaggtgcatgttctgaaaacttagatattctttgattttgaaaaaccccaaaaaacatttgttgaagaaactctcaacagagatcctcaatcgtggaacagctcttttgattctaaactgagctcaaatttaaaaaatgaaagctttaggattagaaagaaaggatatttagaatattaattgagtttattcccagcaaatgaacctctaacttgatctaactccgggcaaaaaaattccacagtaccaatttccatttgatgcctttcaaatattgaataaaccagagtctgtgtgaggtcaattttgcccaatctataattttaacactaagatcaaatatttaattgcaacagaaaatatatgttgatgtgaggatcaaattaaattagccaatatcattaataacatcttgtgcttgaagtttattcggagcatagaactgaggagttcaaagatgagaccagaaacccaaattacaaaagttcctgttatgtctgattccatataatagaaaaggtagaaaaaaaattatttatagatccttttatatgttaaccaaaccagttgtttttgaaaatgacattgtcagccaattttaaaacacattgtaagtgcagactagataaaagattattaattccataaaatcttaaatatattcactttcattttacctggaataaaaatgacaaagtttttgtttaaatacctatatgcattaactcgagtttgtagaaactttcttaaaattgcatttttcatcttttcttctcattgcaattctcaaaatacactgaaaatcagaagagaatgtttatatagcattacacatgtattgagtttgaagtaaaattgagatgaaaggcagctgaagtttagccaaagaaacttgaaatctgaagtcaaacatttataatttttcagttcagttttccttgatagcttatctttaatgaagcagaatctaactcataatagcagctttgcattaatcattaactgtgctgaagcaataattcttttcgggttttgaaagaaattggtcatatatgactgatcattggtcatagttaaagactgcctcatgtataccagactaatgtaaattaataactaatatccattcttcttagatgggagactaaagacctgggtttacggtgtagcagctggggcatttgtgttactcatctttattgtctccatgatttatctagcttggtgagtgtttaaataattaaaaatccaaagagatacttaatcgtaacacagaaacagcaaactaatgtctcaaataagtactctacatttatctggtgttcacatgaatttctaaataaacatggctttagtcctagatgggctaaaagctaccaaatctgagccatttcgtttctaaagatgagcaagagcttgctgcaggtcatcttctcgagtatgttctcttgcatactttcaagaaaatattgctttgtactcaatatggtgaactgtagatttttatattgaattactaatggaggaagatattacagtaatacctaatcatattcaagtatcttctaaaacatgtataatttataaattatgcattatttataaaggtttctggccaaatgaaaatgaccctactatgattttatttctgttgttaatactaaaagaatcccacttggataatttatcttttgtagggtagtgaaacacttgaagtttacttagagtttattcaaagcataaaactgaaattcaagatcagaaaatcaaattctaaggtagatagactttaggcaacgcaggcaacgaggcaatttcagtttatcaatttgcttttacttttttttcgcttaaagcaatcaaatttacaattagaaactgattttctttctcctaattccgaatttttttacagcaaaaagccaaagaaaccccaaagaaggcaaaacaaccgactgaaacctttaaccttagcctatgatggagatgccgacatgtaacatataacttttcctggcaacaaccagtttcggctttctgacttcatagatgtccagaggccacaacaaatgtatccaaactgtgtggattaaaatatattttaatttttaaaaatggcatcataaagacaagagtgaaaatcatactgccactggagatatttaagacagtaccacttatatacagaccatcaaccgtgagaattataggagatttagctgaatacatgctgcattctgaaagttttatgtcatcttttctgaaatctaccgactgaaaaaccactttcatctctaaaaaataatggtggaattggccagttaggatgcctgatacaagaccgtctgcagtgttaatccataaaacttcctagcatgaagagtttctaccaagatctccacaatactatggtcaaattaacatgtgtactcagttgaatgacacacattatgtcagattatgtacttgctaataagcaattttaacaatgcataacaaataaactctaagctaagcagaaaatccactgaataaattcagcatcttggtggtcgatggtagattttattgacctgcatttcagagacaaagcctcttttttaagacttcttgtctctctccaaagtaagaatgctggacaagtactagtgtcttagaagaacgagtcctcaagttcagtattttatagtggtaattgtctggaaaactaatttacttgtgttaatacaatacgtttctactttccctgattttcaaactggttgcctgcatcttttttgctatatggaaggcacatttttgcactatattagtgcagcacgataggcgcttaaccagtattgccatagaaactgcctcttttcatgtgggatgaagacatctgtgccaagagtggcatgaagacatttgcaagttcttgtatcctgaagagagtaaagttcagtttggatggcagcaagatgaaatcagctattacacctgctgtacacacacttcctcatcactgcagccattgtgaaattgacaacatggcggtaatttaagtgttgaagtccctaaccccttaaccctctaaaaggtggattcctctagttggtttgtaattgttctttgaaggctgtttatgactagatttttatatttgttatctttgttaag

SEQ ID NO: 37953 - DNA, 21697 bp, Homo sapiens
gccagaaatatgacgtgagtcccggcacctccggccctggggccctagcggctttcacccaccagcagagcagccatctccctgcgtccctaccaaactctggacctgcccaccccagggacctggaccctgagaggcccaaacaggctgttgccacggacccctggctgaggctgctttcctgctggggactgtggccagagcccgtcctcctggctggccatgcagcgccctgagcgatgaacctggcccctttgggcggccttggttacccctgccaaaaggactgtcgtggcagagcagccatggccaagtggactcagggttcattttcggaacccctttaagcttatagaaagtccccatcatcacccagctcggccccggggcaccgagtccgtctggtgtggggcgtcctttcgacagagcctcctccacaaacccagactctggcttccaccagggccccggacacctgcttcctcagggcagacagagaggggtgacacactgcaccctgtggctgggaaaaggggcctgggactgtgcccgtctgggacggagcagagccaccatcccatgcaggcactatcaccgcaggcaaagctgggactggggaaggcagcctgcccgggcggcctcagggactggggtacaatgtgggagctagggtggaagccaagctgcttcccaccctcccaaacacccgtttgggctccaggggcgaggggtgaggggcgcagccatgggtgatccacgtgctcggggcaaatgcagacactccagcatcaccatcagggccacgatgtccaccctccagcaccgccagaggccccaggggagggcggctgtgcccacggggcttgtgctctacccaggtgcagcaggtgtggggcgaccagtccaagccagccgggcaaatccgagctccttctcgggggttctgggcaggccacctgttccacctgagcttccacgagctcccctccgacagaggcagggcgattacactccctcccagagctgtccccagggggtccaggcatgagggacagccctgacctcacccttggggctctcccagaggggctggccctgagacgggcttcacggcacaggacccaggtccttcccatgctgtgttcccagagctgaatcagggacccactggctttggatagatgcggccacagcgggcccccaggggctccagagcctggagggccatcaccaggccaagctagcccacagccgggcctcgatgccccagccgcccatccagccttgtaaccatcttggtctttctagatcatgaatgtccgggccagagtgcagatgctggccaagttgtaagtagccgggtccgccctgggccaggcccgtgggtgtgcgttgcacggtgaggtgaacctctcgcatggcaaaaacctggatcgctcaggatgctggcggcagggggcctggagccttcctcctgcccccgctctcccctcgtgcctgcagccgggggcttcccagtggccgctgccctgttggcaagcgaggaagggcccccaccttcccaggagctccgcctcaagccagcagcggccacagagtgcccctgggcacaggcacgagggcgggagcggctggcccaggagcagcagggccgttcggagctctgagctcagcggctgaagggagctggagctgagaaggaggggtccgcaggcctcacctgcaacccctccccagccccatccgtgctccgtaccccccgccccacatcctgccgcaggctgaaggtaagtggccagctacgggctgctgtgtgtggcagtccaggccagtacaggctggcgagagtaagtccaggcatgagcccaggggccacgggacggtgtccccctgcacaaggagccaggagacagtaagggagccgaggagccctcatgggggcccagcagccctgggtcgcgcagcccagcccaccctgcggtggagacaggccttcacccagtacacgcaggcctggccctcgggtcgtcgcagtgagtcactcatgttgttcacagatcaccacgctcaggagccgcattgaccaggcccagaagcagtgagtagccctgccgtcctcgctccgcactgggcacaggggcccttggggccagccgctgtagccagtccctaacaagggccggtggtggctggcctcggcagggcagtaacgagactaacccggccaggccacccaggccagcatgcgcaggcctgtggccagggacccggagcctcctccctctcctgcacgcaggggagccctggggggtggcagagtcaggaggagggatcccaatggggcttgcctgtcacgccctcgccccgagtctggcactggctgcagggagagggcagccaggggacccctagaaggggctactcggggggcctttggtgtggccaacctgggccccagggtatcccgccagtgtcccaccctccaaggggacctaggacagggaattaagcagtcagggcttcatcaccagcccctctgtgacgctgggcaaaatcatggactcctcaggatggtgaaacctcatccataaaatcgtgtccctgggggctgtgggatcccttgacacagctactcgaccacctgcatggggctgcacccagggtgcccccggcgatgccacgctggggatcctgtcatggagcccagctgcacagccagtgccatttccccaaggatcgcagtgtttgggggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtgcatgtgtgcatgtgccgagagtgcccaggaacgtgtgtgagggcacggcctttgccagccaggtgtcctgctgagcagccgcgtctgaatggggccggcctcgcgggccgaagcactcctgtcctccacccgccttcacccctcacccgcacccagctcctcccggctcgtggccacatgaagacctcagacaaatggggcaggctcctgggcccctcagaggccaccgtctggaggggcatgagctctttcaaggccaagcgtctaggattatatcattatctgctaagacagtcttccccagctcaggggtctgtctgcagtggtacctcaggcaaagaaaggaggacagagggagggtgccccgggctcacgtgccagccccctaaccacactaacgacctaggcccgccaggcacaggtgagtgggcactgcccggactgaagctgggtgtgggccgcaagcttgggccgggcctgtgccctgagagcagcctggggtcgggctgagagtccgcccagggtgggggaccaggaggggcatggccagaggccctgaccctgaaggatcacttgcttcccatttgcagcagcaagaaggctgggaccccagccaagggcaaagtcggcgggcgctggaagtagagaggccagaaaggcccctcgaggcagagaccctccgccctcttgcacaccagggccgctcgtgggactccacatcctccagcccccacaatcctgtcaggggctccctgacagtcctgggggtggagaggccatcccggggcgtcccccgcgtctgtgtccttgctgccttcatcccctggggcctgtgaataaagctgcagaacccccttcacagtctgtacttgcttctgcatgggggccccggaggacacgagaggaggcaggtaggggctagccaatggcacagcgtcctggtcatccgcggggccagctcaggagggcactggccagtacgcgcagggccagctcaggagggcactggccagcacgtgccacctgctgctacggccagggcggtgcctggatgcccatcagacgctgcccacagcttttccctctaaaacgtgggctccatccccgcgcaagcctatagggcccctccactctccactcccatagggtctttgtgcagaagggggtgatctgcaggcctcacccccagccccagaccctggccatctgcgccagctgtcaatccactgggggcagagaaactttgcctcgggagggggtgagggaggagggcagggctgcgaaagagactttgccaccccccagaaaggcagaggcaggcgggagcggctcctgcgtgaggggtgcaccccaggccctggtcggggaaaaacagtgcaggagagtgcactcccagcagacagcaggcagggaagacacagacagccttctccggaacgcaggacagcagagcgcacgcgggtcgtaaatctgaaaatcctgaccagagaaaattatggaaagtataaatcatagaaattggatcaagacgcagagacttgtacagcaaaatattcacagaggaaggtttggagtccagaacggcccccagaaagactcaggggcgggcgggcggccacatccgggagttctgctgccggggatgggggccaaggagcgggggatgggggggagcagcacggccccctcagtctgcgatggggttggggacaaggccaggacccagaggacaaaacagaacctccagatagcatcacacacatgtgcagaccctgcaacacacacacacataacatcaccccccacaacacacacacacagaaacatcaccccgcacacacacacatacaaataatatcccccccaacacatgcacacacagaaacatcaccccccacaacacacacacacacagaaacatcccaggtgtgtgaccccacaacacacacaaagaaacatcatctgaggtgtgtgaccccacaacacatacacacacacacacacacacacacacacacacactcccacactccagcctgggaaacagagtgaggccctgtctctctctcacacacacacacactcccacactccagcctgggaaacagagtgaggccctgtctcaaacacacacacatgcagaaactaaccagagtgagacactgtctcaaacacacacacacaaaagcagaaaccagagaccctgtctcacacacacacacacacacacacacactcccacactccagcctgggaaacagagtgagaccctgtctcaaacacacacgcacaagcagaaactaaccagagtgagacactgtctcaaacacacacacacacacacacacacacacacacacacaagcagaaaccagagaccatgtctcacacacacacacacacacacgccggcgtgcccacattccagcctgggaaacagagtgacaccctgtctcaaacacacacacacacacacacacgcagaaactaaccagagtgagaccctgtctcaaacacacacacacacacacacacacacacgcagaaaccagagagagaccctgtctcaaacacacagacacacacacacgtagaaaccagagtgagacgctgtctctctctctctcacacacacacacacacacacacacacacaagcagaaaccaaccagggcattggttgcttgggactgggaggtccagggtgggatggggagccacacagggcacgaggacaattttggggcaatgagggtgtttgtctcctgatggggctggcttcatggctgtctatgtagattaagatggatggaatcgtgcagtttaaacatggcaatggctgcgtgtcaatgacaccctcaacgaaggtggttttaaaaagtataaggcaaatgacaaaactgggaaaatattttgaatcaagtatgacagagaaggagtcatgtcattcatacattaaagacacttggaaaaacacgtcaggaaaacattcccaccctaagtaatttgttcaggctgccataagaaagcaccaagtctgggcagcttaaatgacagacatttattctctcacagtcctggaggttggagtccgagatcaaggtgctgtggagctggttcctcctgaggcctctctccggggcttgcagatgccaccatctccctgtgtccccaacggggctatccctctgtgcgtgtctgtgtcctcatctcctcttgttataaggacaccagtcctattggattaagacccacccatatgactccattttaatttaattatgtctttaaagactccatctgcaaaaacagtcacattctgaagtattagcgactaaggcttcaacatatgattttttttttgttgagacggatttcactctgtcgctcaggctggagtgcagtggcacgatctcggctcactacaacctccacctcccaggttcaagcgattctcctgcctcagcctccctcgtagctgggactacaggtacgcaccaccacactcgactaatttttgtattttcagtagagacagggtttcaccctgttggccagctgatcaactcctgacctcaggtgatccacccgcctcggcctctcaaagtgctgggattacaggcgtgagccactgtgcccggccgcaaggtaagaattttaagcaggacacaattcagcctgcagaaaacatgagcgacagacagaagcagccaagccctggaatcagaaatatgagcaaccgatacacgcacgccgctacacctggctcacttgtctattttttgtagagacaggggtttcaccatgttgcccaggctggacttaaactcctgggctcaatgatccacccaccttggccccccaaagtgtcgggattacaggtgtgagccaccgtgcctggccgaggctgcagttttcaatgaggtgggtgaatgaggcctccgtgggaagagggcatggcaagtgtgcggggtcagcacgtgcccaggccctgcggcccgggaagcccacatgctacaggggcacaagaaggcccacgtggaccctcagaggcccccgaccacgccatgtgagaggctgactacctctgccaccccctctttgtggcacccgagagcagggtgcctaggaggccaagaatggtggggggaactgggattaagatgggactcctagaatggaggcactgttgagccctgggccaccaggagcaggtgctgggaggggctctgctgctgcagcaaaggggccaggttggctgggaaggtgggagggagtgggggaggaaggtgggagggaggggggagggagagggaggggctgatggggagacaagaagtctctaatggcagctgattctgaagggcttcgtcagggcagcaccaacacacccccgcctgctgtcctggtcctgtccaaacgcagcctcccatgtgggtggggggccttctcttctggttgggagaaaagccaggtggccacgtgtgtggctggtgatcacaggctggcgctgcaaggagctttgaggctgcaaggagctcttgctgtgccactgcacttccacactccagcctgggaaacagagtgagaccgtctcaaaacacacacacacacacacacacacacacacacacacacacatacaaaagcagaaaccgaccaggacattgcttgcttgagactgggaaatccaggatgggatggggagccacacagggcacgagaaaaattttggggcaatgggtgtgtctatcacagctctggggagggccgcaggctgtttgggggggtggtgtcttctgggttctatcctggtgtaatgcacaatggctttgtggatgtgagcaagccacattcccagagccatggtcacccagccggtacacagggtctgaggatgctggacgcaggcaaggagggtttgtggtccacgctgtggcctgcaggatgggcaagggctggcaacaacccttctgagctgcctgtgcctctcctgtgagtcctgcctgctctgccccagggatcctggtgcctgggtctggcctcccctgggctgtctggttcctggacagtgagagccggtgatctgcagccagggcctggcacaagtaggtgctgggtaaaacaagggggttgccatttcttcctaatctttgaaaacctgcatttgaacatggtggctcactggtttgtgcttacagtgatttcgctacaagtgtttgcacctttttgtgtgtttattggcgggatgaatgaatgagtctatgaatgaatgagtgagtgtatgtgtgaacagcccctcccccaccctctgtatgaatgaatgaatgagtgtatgtgtgaacggcccctccccccaccctctgtatgaatgaatgaatgagtgtatctgtgaacggcccctcccccaccctctgaatgaatgaatgagtgagtgtatgtatgaacggcccctcccccaccctctgaatgaatgaatgaatgagtgtatgtgtgaacagccccttccccaccctctgtatgaatgaatgaatgagtgtatgtgtgaacggcccctcccccccaccctctgtatgaatgaatgaatgagtgtatctgtgaacggcccctcccccaccctctgtatgaatgaatgagtgtatgtatgaacggcccctcccccaccctctgaatgaatgaatgaatgagtgtgtgtgtgaacagcccctccccccaccctctgtacgaatgaatgaatgagtgagtgtatgtgtgaacggcccctctcccccacgacctgattctcatctgcaggctgaaagtgctttcccagctgaattcgtacgttcccttaaaacccttcagggaccctcactgtaaaaacgccccagctcccccagcctgactcgcaaagctcagtttaggggctgcccttgcagcggggctcctggctcaggtctagcaggtggaagcagaagagcatgtcccgacacaccgatgagaagttgctgaggacgtggagcagcaggaagcaccacctttgcagtgggaacgccaaacagtgcggccactttggaagaccgcggggcagtttcttacaaaatcaaacgtcctcctaccatacaaccagcaatggccctcctgggtgtttctgcaaatgaattgaaaacttgtgtccaccctaaaacctgcacacacatgtttgcagaggctttattcattactgccgagacttggaagtaaacaagaagtccttccgtaggcaaagggataaaccgaggtacatccagacaatggaacaatatccggcccgaaaagaatgcactatgaaaccacaaaaaaacccagaggagccctagctgcatctcactcatggcaagaagccaatctcgaaaggctacgtgctgtatgattccaatgataccacagcctggagagggcaatgccaaggcggcagtggaaagagccagggctgccaggggccgggggaggcaggaatgcacaggcagggcagaggcagcttttcaggcagtgacacttctgtgtgacaccatagtggtggctaaaggacattttgcaaggatgaaacctgggggtaaactctggacttaatagtaatgcatcagtattggtttatcaattggaacagatcacaccacacgatgcaagatgttaataatggaggggcactcaaggagagggggtctgtgggaactctgtatactccctgagcaatttttctgtaagcccaaagttcctctaaaagataaggtctacttaaaaaggaccaattattgggccaggtgcagtggctcatgcctgtaatcctagcactctgggaggccgaggcaggtggatcacctgcggtcaggagttcgagaacagcctggccaacgtggcgaaaccccatccttattaaaaatacaaaatcagttgggcgtgggggcccgcacctgtaatcccagctactcgggaggccgagtcaggggaactgcttgaacctacgaggtggaggctgcagtgagccaagactgtgccattgcactccagcctgggctacacgtgaccctgtctcaaaaaataaaaaataaaatacaataaaataaaataagggccaggcatagtggctcacgcctataatcccagcattttgggaggccaaagtgggcggatcacgaggtcaggagatggagaccatcctggctaacatggtgaaaccctgtctctattaaaaatacaaaaattagccgggtatggtggcgcacgcctgtaatcccagctactcaggaggctgaggcaggagaattgcttgaacccgggaggcagagattgcagtgagccaagatcgcgccactgcactccagcctggcgacagagtgagagtgagactctgtctcaaataaataaacaaataaaaataaaatgacaatttattagttgtttatctgaacttcagatttaactgggcctgtatttatctggcagcctcaaccccgtgcagaccattgatctcaggagaggcaggcagagcggaagccgcgctggcatttgtgttcaatggcaggtgggaaggaggaagaggaggtctccactggctccccaggcatctcagagaccccccatacttagcatgccttccggaggatcccattagcagactatcagagaaacagggatggaaggagtggtgaggggtctgctccattgtgaccccacccctgcctcgccctgaggaaggacctcagctcctagctcaaccgccgccctccagcagccccagtgatctgagcagcacccacccgtgacccacagctcggcctccaatcaccctcctctccacatcggccacccacaactctgaacccaacttccagcagccacatatctctaagcacactgcacaatgtggctgccgaaagaggcagcattgcatgaacataaaaggaagcctgaggacccccggccccaggaccccccttctccagctccatccctgtcctgcggtctgctccttgggcctggccaagggcacctgctgctgggcaaaggcctgtctggtcaccagcctcctgggaccctgccactggcagcctggagcttctccacctcacgcaggcctggacaacagtggggacggctgccaccaccttccctgcccactctggcccacttctcactccatcctgcttcaatgccttcatgctagatagaccccctggagtcatttccactcaaacccacccatcaggaggaactccagccctacccggcccaggccctcggaggggcacagtgccctctcctcctcctgaatttccatcaaccccagtgccctcccgcagccctgttcccacctgcaggcctgggccccctgcccccagcaacaaccaggacccatggccccgcttcttgctctgaagcatgacacccctgcctcttgctctgaagaacacttagggtgctgttgggtgcgggaacaagccaggcttgggggtggggggcacgggcagttaaagagatagatggagaagtggcctgaatccagccaccaggcagaggaaaccaggggaggagggagaggcctggggacaggggagggaggctgctgccctctactcccgaagggtcccagcagccctcctggccagcactacccaaggaaaggagtgaggactgggccttggacgggggtccctgtagagagggccttgccagaggctggagggggctggccagaagggtggagagggggtgagcaaacggcaaggcctgaagaggccagtggccctcttggaggaggcgtggtgggagcaccgaggatggacagcgtggctggtgtggccagcgtgggggctgccaaccgggctggccagaagggcgaggtgaggggccctggggttccgggctcccgggtaaaaacagccagatggagagaggggcttcagaccccaggcccggggacccgccctccccagcactacagccccggttctccacttccagctcccagcagctgcaagcgcagcggtgcggggccaggctgtggcctggagctgccaaagggcaggggcacgggtgtggggggcgtgcaggccggggtcccgggaggcagggcagacaggcccgaaagagtgcgacggcggcgggaggtctctggggctgggaggggtgcgggcgtgggcggggcgcgagcagcaggggcgcgggcccgggcttcaggctgtggggccgggagtgcggggcgggactgctgcggccccgcgtcctgtggagtctgcggcgcggggagtgggggtcggggcggggaggaacgtggggtgcgggacaggaggggggcagggagggagaagaaggcggcgcggggcggggcgggcgcagggctggggacggcacgggcgcgcggcacgggcgctggcgcgtgcggggggggcggcgcggcctccggaagcgagggggcgctgtgccaggcggcggccgtgcggggcgggcgcgctgctccttccgcctcgcggaccccggaagcgcgcgtggccgccatggcgcggaatgtggtgtgagtaggggtcgtcacccccccgtcgcggggcgccccttagtgtcacaagcagacggaccccacagggcgcgcggactccggggagcggggtgggcgtccctgggccgcctcctggcccgggcgaggcagggttctccgggaccccctgtcatgccttgagacacgcgaggcgggtggcggaggagccccccgccaggtttagggcaaccccagggggcgggcgtggccgggctggggacagagggtccgagccaaacccatggaggccacggtgcccccgcgtggggagtgggagggtggcccggggtcaggcccggggctggtcccgcagccagggccgagggagctgtttggagacgtttctgatcgtcacggggcgggggccacgtcggctgttgggtccaggcggggaggcccgggcggcccccaccgcagcgcgggcgcggcctgaggcagaggagctgggaatccagattgggtttgagtgggaaagggcagctgaccgcagccctcagggctttggggcaggcagggcgggaggcccggttctgctcagcccagaccccccacgcccactctgcatgttctctggattcccagggggccatcggggcgctgtcctgcaccacttcgccctccccaaattgaagcaggaagccctgcatatttcttggtgaacgaatgactcaggcgtaatcagtagatgtgggctcccgggtgggttttggagaacagtaatcagtgtttctggagagggacggtcaaggggccagggtgtggctttggaggcccctgcacatagctggggagagaggggagggtggcaggtgggacccccagtggaggaggcttccttcagcagacacctgggaccggtgctgcgcgtggccctgaccttggggaacacccagcaccaaggaagaaaaggtctgagtgaggccaacactgccctgagcctcacgtgaattccacgctggcccttcgcctgtccctggagaatgaggaggaagtgagggtcagaggacccgggtggggtgttcctgaagggccaagggtggtgggcccctggaaacggatcaggtgtggttgccttggaggcagcggggcccgctcgcccagcagtgcacacactcctgttgccagggagcctttgcagggagcgctgactggacttgctgtggactggatgcagctggggtgggggtgccgagagggtgggatcctgggtgagtcactcgtggggccgtggggaggcaggctggtggcagtgagccaggtttttgtgttttgaggaagaagttagtgcagagttctacttgagataggttaccgtggaggtgcttgtgaaatcccatgcggagtgcttggggtgctccctggggagagtgggactgagggaactgagggctggtgggcccacaagggttcgagaacaaaagagaggccttagagccctgtcctggggccctgggtgtcgacagtgcagattgttccagatctgcaggctccatgcacaggcagctggcgctccagcctggagaggctcggcctgtgggaacaaggacagtgaatcgtcctggcccaacccctgccagcctctcatctcaagcccacacatggcccttcagacccttagcaaagtgtgcccttcaggccccaagcctggagactcgaaaattaatggcctgggagctgttgaaccctcttttctactgtttactgggagtccccaaactttgtctccactcctgcagtcccacagctggtcaccagagggaatgtgtgagcccctcgggtggccatggctagcctgaacctgtgggtaaaacaagtcaggcccctccacctccagagcccaccctttcttctcggcctctcactggggcccacccctgaaggctgcactctgaggcttggaaaggccaaggccatgcccaagaggaggctctgctggggttgggtgagtgaagactcagccccactggcccggccaccaggctgccatgtgtcagtgtggtcatcaggaggcctggggtggacatgattagtgatcgggctttgttacaggcgccttgcctctgagaggtcccagcagctcctggcccctgccaggccctcaggcccagaggctcagtgctgcctaccactgttggcccttcaggaacaccccacccaaggcctctgaccctcacttcctcctcatcttccctagacaggcagaggccagcgtgaaattcatgtgaagcctggggcagcgttggcctcacggagcccctcttaacttggtgctgggtgctcccaaggccagggccatgtgcagtgcctcagataaggccaccagagacccctcaagagcccctgtgctccccgtccaccaagacctgcacctaggctctcagaccccacatcccccgagacccagcaggcctgagtttctcctgtgcccctcctccccccagctctgaggcccagatagagccagggtgtgccggcagtggcaggggcgggaacgggggtgggggacggtaggacggtgctgcctgtccacccagctgaacgtgggagaatgcacgaaaccaactggctagagattctgcacgatcgtcacctggccccccagcccaggcagcgtgctggtctagtttgcggtggccacttggcacctctccatctgcctctgctggcttttagtggagtgctggggtgtggtgcactcaactcacatttagtgtactgaatcagagtcttggcagcaccgtcttccaggagcctaagcctggttagcctgcgttctccataccgaggagctaggccctgctgccaccgggagagtgcggagctggccttttctgtcccatggtgtgtggttctctgcagctccacttcacccgagcagcaggagagtgggccggccgcgtggggtctgctctcccaggggtatcagtgccccaacacacgtctttgagccttgccatcagcttattgggggaatgctgtctgcggggttctgatttttgtccattggccttttctaaagtctgaccttgggggtcaacagcgcatgctccttaagtcgatgctagggactggccgtccaccttggcaggcccatgtgagaaaggggctgtggggacctctgtgtccttgggtggtgacctgctgatagctaccccgtttcccgcccacccctgttgtgagtggacacgcgggggtctgcagggttagctaccctgtttcccgcccacccctgttgtgagtggacacgcgggggtctgcagggttagctaccctgtttcccgcccaccactgttgggagtggacacgcgggggtctgcagggttagctaccccgtttcccgcccaccactgttgggagtggacactcagggatccgcagtgttagctacccccttttctgcccaccctgttgtgagtggacactcggaggtctgcagggttggtgtgtcgggctgccttggcctaagtgtgtgacatggacccaatctcttctgtacaggtaccccctgtaccggctgggtggcccacaacttcgggtgttccgaaccaacttcttcattcagctggtgcggcccggtgtggcccagcccgaggacaccgtgcagttccggatccccatggagtgagtccgggaggattccggctggggttggggagcaccctcggggggatccccgtggagtgagcccggaagttttcccgctgggttgggagagtgccctcaggggggcctgggtcctgagttaaaacaactctgctcacgtgctagcctcttcctgctgggaaggcacctcaggcggccctgcccggcaagtattgatggagtgcctgtaggtgtggagcccggcaggcaggctgcacgccgccctccacccggggacggcttcactggaagccttaaaatttggacctctgtgctcgcgtcttctgttgagttcttgcagcttctttttaggagaggcgccctgagaggctgggttgggagcaggccgtgatgtacagaaccgctcagaagagcctgcttgaccttcagagaaatgcacagtccctacgagcaaaactggggtgctgctctgcagtgtttaagttcacaggtccccagctcagggttgatgcgagccaggcggggcagcagcgtgagctcccctgggggcgaaggtcaggcctgtgcagcctgcaggggcccagaagctgagttgacagtgaccgtgaggttctgcagtagagggaacttgcagttaacgcaccgaatgccaggcaggcctttccagaaggtacttcctagaaccgcatcagtcccatcagccgcagagcaggcctaaccctgatgcggccactgggccccggggcagacgaggtggggcacctgccagccaggagcgtgcagagactgtcacctcctctcacaggcacttgcccggagcagggagccatgtggggctgtggagcaggccaggggttggttgggcagtgctcccactctgtggggtctgtgccactgccaccccatgctggtgtgcccagagtagggagtcttgcagccagcagcactggtgttgctggggctgcctggcctcactagtgccgctgatgtacccagccctcctccctgccccctgtgggtcttggtctgtcggcctctcagcctcgggtgcttgtgcatctgggacagtatttttggcttttagcctggttaagatgccgttttctttctccttcgcctccagaatgacaagggtggacctcaggaattacctcgagggcatctataacgtgcccgtggctgctgtgcggacacgggtgcagcatggtgagtgcccatgggaggttctcctgttggtgtcgtgcccatctgtgccacatgcccacctcgccgagccacagcctcagctactgcatgggggtcttggtctgacgtggctcatgggaaactgaggcacagggtgacttgtcagggtcacacggtgcttacgtgccagagcagggattggaattcaactgggctggcccggggtccattctgagccctgactcctgccgtcagcccccgaggtgggactgcagtggctgaggctggggagcaaagcgctgtctgttccataagcccctgtcgtgtgccctggctggtgccacgtccgctcctttgttgagaacctgctggcctctgttgggagaagggaggagcctgggagcctgctgtgctggctcgtttgattacagtgcccatttccctgagaaatcgcctttttgagtttttaaaaacatatttacatttttaagagagcagaggttcgttttagtggcattgacctctgaggatgtaattttttaaagttctgatttttttaaagttctgatttttttttcactcccttccggcaggctctaacaagagaagagatcacagaaacgtgaggatcaagaagccggactacaaggtcgcctacgtgcagctggtgcgtgtgagctggccagccccagcggggcctccgaggggctcctcgcaactgtgtccttggggatgtttgtgccggagacgctgcgctggggcccagggagcccccgtgaggccggatctcagggcctcagcgcagaggcaggctccacataaggtcatgctccgtcacggccttgggggtgttagtggtggcgctgggagcacgtgagcactggggcacatggggcacgtctcagcgtccggccgttttgtgattttgaagtttgaattctctgtgggcaaaggcagccatcacaggcctagtgggtttcaactccaacgcacaccagggtgtcagagcatgggaggccccggcctctggagagcctgtccttggctgggtttcagcctcggaggcagagtgtgaggcccctgagggcaaaggtctttggtgccaaggcaggtctggctggccgggctgttggctgaggcccatgtcctgcattgcagggtagcaggtcccacgtacttgttagggctcagcaggctgcttctgagcaggtgctttcttacgtatcctggggggctctggggaggaagaaccctcaccccacgttgcctgggccttcagtttctgaaacccagacttgtcaggagtgagacccacagtttcaaagcctttctttgggctcttcattttgagtcccaggcaaacccagaggcactttctctctgggccaagatgtccacagcctgccccggccgcctcctgggcctccccactctgcccctggggctggccttactgggtggggatggggttgtcttccggtgtaaatggtccctggaggccgagccggcgggccctgccactagatggcagtcacacgatggtggaaaccgcctcctgggccagccggcctgttgtggggctaaggaggcagtttgtgaaaaaggccaagttagcatggcagcttttctgaaaaacagtcacatttgttgttctaaacaggggcccccggaataatttggcctgatatttgctgtgcatgaaatcagccaatccaggtggggagagcagccgttggcctcataaaggcctctgtgtgctcagtgtcagtcgggcccatctgtctttgtcatggcatgtgggtggacatcccgtgtgccggcaccgccacgggcacttcagaggcagctacggttacaagtggcattcaagtcatccgagcccttgcgttcttcctctgggccccacctcccatgaaaactgaacccagcagctccgggatccggtgtctgcagctgctgcccgcgtgttgttctccctctgtgaagtccaggcagccagagacagggcagggcaactgggagcctgaagggtcccagttgggcatggatcctcctgttccagaatgaaaatttgtaacgggtcctcaccccccttcctgaactccagcacatctttgcacagcctagaaatgggccgtggccgttggtccctgtctgcccgcagaggggactctcaaggccctttcctgtctcgtgtctgctgagaccttgctcagcgtgtccccctgggccctgcgccagggcttagaatcactgctaattgcaaagcccagggagggagcattggaaaggtaaaattatccacgttatttggagttggccgctgtggaaaggccctgtcccacgtggcgggagtcccacatttctttctccgacaacctgataagcatctccttggcccaaagtcctgggagctgaaagcagcgcctcagtgacccacacaacaaaaagaccattgactgcccgctgccccgaggcttgtgtggatgctgagcagcgcgggaatgaagggcgcgcaggaatgaagggcgcacgacatgagaggcaactccagaacaaaccgctgccgccagctgggccgagctccgtgctcggggctccggcctccaggtccaggcaggcggcagcccccagggcgccctgggattcctgaaggcagggctgccttgtttacttgtcattgggacatttttctccattcctgttctttaccccgatcagctgtctctctcctttttggaaggatcaagggctttttttttttaggtacaaggtgaactcttctagaaaggggaagcccctgggaaaccatgcttggcatccccaaacggtgtttgtctcctgtaagaaacggattttctctcagcacctttccccatttcttcccgaagctgtgacaaatggccatgtttgtgctttaaactgtcattttgggttccccttgcctcggaaaactagcagaatcacctccatatagtcaaggtgaatctcccattctgggcagtcagcctcacgtgtaaacgactgccccttggtattttaaaagacgcaaagttcagagctgtgtaaggcaatcctcctgcaggccggctacggcgcacgcagtgccactctccccgccagcccctgcgctctgcgccagggatcagggtgcatacacctccctcgcagggtgggatctgggcctgtttcagatcatacttggctgcctgcccacatccagatttatttacacacaaagggtctgcaagagccaagtgtacctgactgattttactcactaaagggttccagattcgggtgccatcctcactcctcctccctcttctcttccctctcctctggtctgctctttctgcctcttagctttggagcacttagtaatcattagcaagttaagatggcttcttgtatttgcttaggtccccaaggagcagtatcccctccttctcgtgaacccgagccacatgctgtggcctgggctggggcttggctgacacggacatattctgaactctcagcagaagatgtaagaccagttaattggcagagccggtcctgatttatcaactgccgcacgtgcatgtttcttcgtacgtgatgttcactttaattgccaggctctgggctgggaggagggggagctttaatgtgagtagagcctgaggcattttggatggacaggttcagcatggtaccagacgtgatttgtgtcatgtttttccatgccttgtttctgccccccaccaaccaggtggccccgtgctagtaaatgggtgcacccagggcgggggcagacaccaggccctaaagagacaatggtggggaaagcggccctgtcctggagctgtggcctctgctgcagcgtgacagccgggggccggtggccgtgggggtgcttacattccaggcagggacgctgccccaggaggcccagggaggtacctctgagcagttgaatccggcgccggcagaaaggggctgccagaaagcatgaggctcccccacagacccctctgctgaggagtctttgcagctctggctggagcctttgttctcccccttaggcccatggacagaccttcacgttcccagatctgtttcccgagaaagacgagagccctgaaggcagcgctgccgacgacctctacagcatgctcgaggaggagaggcagcagaggcagagcagcgacccgcggcggggcggcgtccccagctggttcgggctgtgacggggtggccagcagggacgcgccccaggtgggcagctgtggcagagcagcgacccgcggcggggcggcatccccagctggttcgggccgtgacggggcggccagcagggacgcgccccaggtgggcagctgtggcagagcagtcccgacacctaaataaaagtcttgctgcaggagaaaga

SEQ ID NO: 37954 - DNA, 284903 bp, Homo sapiens; identical to SEQ ID NO: 37619

SEQ ID NO: 37955 - DNA, 28537 bp, Homo sapiens; identical to SEQ ID NO: 37929

SEQ ID NO: 37956 - DNA, 2271 bp, Homo sapiens; identical to SEQ ID NO: 35694

SEQ ID NO: 37957 - DNA, 2469 bp, Homo sapiens
ggggacgaagggaagctccagcgtgtggccccggcgagtgcggataaaagccgccccgccgggctcgggcttcattctgagccgagcccggtgccaagcgcagctagctcagcaggcggcagcggcggcctgagcttcagggcagccagctccctcccggtctcgccttccctcgcggtcagcatgaaagccttcagtcccgtgaggtccgttaggaaaaacagcctgtcggaccacagcctgggcatctcccggagcaaaacccctgtggacgacccgatgagcctgctatacaacatgaacgactgctactccaagctcaaggagctggtgcccagcatcccccagaacaagaaggtgagcaagatggaaatcctgcagcacgtcatcgactacatcttggacctgcagatcgccctggactcgcatcccactattgtcagcctgcatcaccagagacccgggcagaaccaggcgtccaggacgccgctgaccaccctcaacacggatatcagcatcctgtccttgcaggtaagacctgctccggggtccccgccccgccgccgcacactcccgcggtcgtctgggctgtcactaggagatccgtagcccagacggtgactttcgtatgagctatttaactttattttcttcagaatctgctgtagattgagctgtgcgtgaaattgctagtaagttctgacatgttaatgcgtctgtctttaaatctgaattgttaccataaacgtgtttaatggaacttgctggtctgtggactacaaaaaaaaaaaaaaaaaaaaaaaaaccctttctacttaacattgtcttaacctcgtactctttatcctctttctttccaggcttctgaattcccttctgagttaatgtcaaatgacagcaaagcactgtgtggctgaataagcggtgagtgtttgcttgtgccacccgtgggtaaactgcccctcggtgtgtgtgcgcgcgcgcgcatgtgtttttgcttgtgtatctataaaatgtctgatttggtaaatgcatgcttacttcgcggtgttacccgtactacattgtctcactagacatgaaggagcttgtagctttgggtgctcgagatcacagaacattttcctttaaaaggaaatgatgccaataacttactacgaaggcggccgaggaacgtgtgtattggctttgtagcaaatgtaatgccctggatcttcctacgagtcctctggtactatgaggtactaacctccactgtaattaatcttaccgccacaaattccatagtgatcctccttccctaaaactatagtcctctgggattctctgggctagttgaggattgctaccctgtgccttcaaccctgtgatgtgggatcccagacttccctatctgttaactaaagggctgttttcaatcaaataattgttacgagaagcagactggcgcctgtagcactgctgttggagatccaaataggagattgggttgggaagtttttcccttgagtctctgctattttaatgtttaatttgcgctgtcgaggcgagtgtgtgtgttgcatctggacgccagggtttgcccaatctttgagtgtttggttaaatgttcaaactgtggcttcctcccggcgccagtcgcccgcctctgcccttaggttacattctcttaaacatgcctttctcccccactctttcgcaggtgttcatgatttcttttattctttgcacaacaacaacaacaacaaattcacggaatcttttaagtgctgaacttatttttcaaccatttcacaaggaggacaagttgaatggacctttttaaaaagaaaaaaaaaatggaaggaaaactaagaatgatcatcttcccagggtgttctcttacttggactgtgatattcgttatttatgaaaaagacttttaaatgccctttctgcagttggaaggttttctttatatactattcccaccatggggagcgaaaacgttaaaatcacaaggaattgcccaatctaagcagactttgccttttttcaaaggtggagcgtgaataccagaaggatccagtattcagtcacttaaatgaagtcttttggtcagaaattacctttttgacacaagcctactgaatgctgtgtatatatttatatataaatatatctatttgagtgaaaccttgtgaactctttaattagagttttcttgtatagtggcagagatgtctatttctgcattcaaaagtgtaatgatgtacttattcatgctaaactttttataaaagtttagttgtaaacttaacccttttatacaaaataaatcaagtgtgtttattgaatggtgattgcctgctttatttcagaggaccagtgctttgatttttattatgctatgttataactgaacccaaataaatacaagttcaaatttatgtagactgtataagattataataaaacatgtctgaagtc

SEQ ID NO: 37958 - DNA, 104073 bp, Homo sapiens; identical to SEQ ID NO: 37679

SEQ ID NO: 37959 - DNA, 48695 bp, Homo sapiens
actcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcaggaccactgatggtggtactttcaacgccaaagctgaggcttggggtccagcaggcgtaggccaatcacaggagagcacctcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacatgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtattttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatgatagtccaaattgagatgtgtaaagtgtaaaatatgcaacaggttttgaagatgagtttcaagaaagaatgtaaaatatttcaacaaattttatgtgatttatatgtcgaacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccacttcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattatagtgtacccagcactggagtgttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaacctaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccacctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacatgagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcatctgaaaatagccgaacaaaatgcagtgctcagaaatgttagcttataaatgctctacagcaagaccaaagataatcccttgcctatgtgaatacaggactcggtggttaacatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcacgccctcatggggtttgcctgggggttgccctgcaccttggggccaggaggaaggcaaaattaaagaggcaccatgagccaggggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtgcctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtgactcacacctgtaattcagcacgttgggaggccgaagtccaagagttccagagcagcataggcaacatagtgtgacccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcctatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggccgtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagacggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcgggggggggggttctgtgcatggggctggggacagcagatgcccgggtggggggcggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccatttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcgaggtgcgaagtggggaacgacatgccccagggtcttggagcagggctgagaagcccagtctgcagggactctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgagtctcgtgcctcagcctcccgagtagctgggactacagtcccgcaccaccacgctagtttttgtatttttagtagagacggggtttcaccatgttggtcaggctggtctttaactcctgacctcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcgtttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgtaaagataatttcctcctttgtaattaacatgtatcttgtgggtagattctttgagaatatgtaaatatcttactcttcctcaaacctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtccgggtcagcacctctccaccttagggctagttctccctccatctttacagttttgccattcatttgttgagctactagtatgtgttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggttgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactccttttttttttttttttttttttttttgagactgagtttcgctcttgtcgctcaggctggagtgcaatggtgccatcttggctcactgcaacctctgcctcccgggttcaagtgattctcctgcctcagcctcccaagtagctgggattacaggcatgcaccaccattgcctggctaatttttgtatttttagtagagacggggtttcgccatgttagccaggctggtctcaaactcctggcctcaggtgatctgcccgtctcagcctcccagagtgctgggattacaggtataagccaccgcacccggccaccctctccttttataaacttaagtttatttgaacttagaaatctgtcactatcatgtatctcaaaccaatactacttaagtaaatagaatatatatatataaacaaagaaaacactgaaaccaaaagtgtcattaaatagcctgccgtccaagcatgagctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctctatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccatcgatttcttacccctgagaactcctactcatcctctaaaacccttcccaattgtcccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagaggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaagggggccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggcgcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagaatttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacacccggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggacatattgttctgaaacttattatacttttctccttgttttcaaaatctaaccaagtggatagatatgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttcttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatattcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatagagagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggctttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctcattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaacgagagaaaagggatgaaagcctcaggttggaggataataacaaccacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaactgaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacacaggtgaacatcatctgtcctgtgacataggggcaaaagaaaggtaaaaaggctgaatttctggccgggcgcggtggctcatgcctgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaagctgaatttctttgacctgagtgactgcagtcctctgggactgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattacttgtatgagccagcgcatgcgtctttttttttttctttttctttctttcttttcttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgacctcagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttaggcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctgctcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggcgggcccaccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacgtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctcacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcatactgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcagctcctgacgcccaacccagtgaccctctccactgtgcccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcgggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagtagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataagttcccagatgtggaattactggattgaaagagcttggtttgctgttgttgttaaggctgttggcatctgtgtttgcaaacactttctgttgatttttttttttaactatacttctagcaggtgacacatgcacctggctgcaccacttgtagattccacctccatgtttccatcgtccctttccaccctgcctctggctctgtacagcatctcttcatccatcatccactcaacgagcattcaggatgcaaccgtgttttcctcagcacctctgacagtgccggaggacagaaagtaacctcaggtgtagctggtgttgacctgacactggtcactgggcacggccagggcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtcttttttttttttttttttttgagacggagtcttgctctgtcgcccaggctagagcgtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcgtgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaatgtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaacaaaaagaaatttatttcttatagttctgcaggctggaaagcccaagatctaggggccacatctgatgagggccttctctctgcatcataacacaatggaaggcgtcacatggccagagagtgcacgagagacagagcgagggacggtggaactctcacttttacgacaaaaccacttctgcaataaccaacacacccctgtgataacagcattaatccgttcatgaaggcagactcctcatgacctaatcaactcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgactaatttttgtatttgtagtagagacagggtttcaccatgttggccaggctggtctcggactcctgacctcaggtaatccacacgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaagcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggataggggatgggagaatgcttgacacaaaaataaagccctcgaggttatccgctttcaaccagctgccttggagctggcagctgctgctcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagccagccagggagttagcgaggacggcaattagagggctgaagactttctgcctgatgatgaagaggcccacacggtttcctggagagggctgtctgccagggtgtgcacgcgcacatgcacaagctcaggctcagggggtatgtccgtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcacatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggctggatgtagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatctgggaggtggaggttgcggtgagccgagatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagctgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccgcttcacaatcctccaaggttccctagtcactgtgacagcctctaggacagtaccctcagaggagcagaggggccttcaggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtctcagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgggttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcactgaagcccggtcactaccaacactcaccataggcctactgggcgccaagcctggagttagtgccggagaggtggtccctgcccttgagatgtcacagttcaggaggggagatgagactgagacaaacataattcaggagagaaagtggtaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacccaaggcctggcacacagtaggtgctcagtaacatgcattgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccagcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatatagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggcccttggtccatcagcccctccctcggccacggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggaggggggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggcaagaagaagggtgagtgcccattcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcagccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaaggttcagtcattcatcctttatgatatatggatttatacctcttgcagaggaatttgagcttaatcaccttgcattatgaatgtattcaatcacctttatcggaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatagtgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagaacagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgccgttcatactctaccatccctccctacacctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggataggaagaggaaagataacgctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccgcctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccaccgcctctgcttgcagattcccagcggcatcgggtcacagatgaggaggtccagcaaagcaggttccagatgccacccttggaggaaggtgagtcaggatgggaaggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggcttccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatg

SEQ ID NO: 37960 - DNA, 26628 bp, Homo sapiens
ctttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaaccgcgatggcgcctcagaagcacggcggtgggggagggggcggctcggggcccagcgcggggtccgggggaggcggcttcgggggttcggcggcgacggcttcgagcggcaaatccggcggcgggggctgtggaggcggtggcagttactcggcctcctcctcctccgcggcgttaccggtgaagaagtcgaaaatggagcacgtccaggctgaccacgagcttttcctccaggcctttgagagtgagtgcgtgcgaggctttgagggcaggaagacccactctgccaacaccggggatgggacactctgctgggcccccttcctcctcgggagtccacttgtgtggtagtggagggaggaattgaggggatgtccccctttcggagattacgtctccaggggatccggagtccagggccttgggagagctggaaaagagggtccgggcgggttcttgactcccccaagattgacgcaagaggctcgggactggggccccacgttcagagcaggcggcttttagatgaggaggtagcagttgaactgagccgcagtcacatcccgagactggttcttgttttctttcatgcctttcggactctagaaatacaggggtttcggttgtagcttttgaggggcaaaatgaagcctgtgaagggatgagtgcagtggaaccgaagaaagtgtccttagtctgaaatgccttcgcgctaacttggtgctgcaggttcctatggcacctttggatgcttaaaacccttcaaatctatccacccattttgtggatatgtaaactgagccagagagtggtcaagcatcttctctggagacgaccccagaattctgctttttctactcggcttacaggacattttcttgggtcaatttctgtttctaaggtctgtctggtaggtgaaactgacttatttggaaaggagagcaaggtgtctggaaataaacaatagaatttattaaaaacatcgtgactatgaataatcctgattgttctttaaggaatgttatatcctgattggtttccttttttgcttttgtgtgttataatttgggtgatctttaatagctaagtaatcttacagaaacttgaataaacttggctctaccgcccagtgtccttatttacagtttcactgtggcatatattaagggcatggtatcagctgtgcttagaaagaccgtattatgttgtttaatacccttccttcattctctctcattagtgcttcatgaaattctaattggaacttaatagaaggagtttcagtttttatcgaaacgaatattgaccttgcttcagagagattcacattattcacatatttcttaatatactttgaaatatctagagaggctttaattggaaataggatggagaactgaagggcagtggtgacaataatgatacttgtttgtaccccttctaaagtatctcatctccctttagttaatttaagataaaactaaccaattgaagatttaggtggaaattttaaaagttctttctgaatgttaagagaagacacattctccaagaaagttttaactatttgcgttctgatgagtcgacctcagggaagtcaagtgtcattaagagctagatctggtcataaaacaacttgaagttgtttactggaaagtttaaatacttgaatgtaattattcacagttatttctatttggtttattctgatactgctgtataatgacaacgtgatactaataggtcattaatgtaactaatataatagtatatgtatttttcatccacttaagtcctgtataacaaattacattttaactaatttgaaatttaattcaactcattttaagcgttagacggttttgtgaatctgtcaattgtgtaaaaaatgtattgaggtaatatttatattgaacaaaatagataaaactttaaattataattaggaatatttattgagaattttttctgcagtttgtgtccgagatttatttcaacattgactgacttttgagtgcagtggatcccacctgtaatcctagctactctggaggctgaggcaggaggatctgttgagcccacgagtttgagaccagcctgggcaacatatcaagaccccttttcaaaaaaagaaaaaaaaaatcttgactgactttcatcatacctgtattaggaatgtctggatctgtattaggatgtcatcatatctgtattaggatgtattaggattctgttttggctgactacaattttttttttttttttgagacggagttttgctctttgttgcccaggctgcagtgcaatgacgcgatctcggctcacggcaacctccgcctcccaggttcaagtgattctcctgcctcagcctcccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcagtaagtagtcaacaaaattcatcaatattatttctctcttataactgcatctgtattcaattttaacatttttaaaactctttttgtagccaatatttttgcacagaactcttacttacatgtctcatcgaaactccagaacaaacatcaaaaggtacattttatgaatcttatttcaagctgatcaaaccatgttagttttattttaaagtactatttctcaaaattaaaaaaaagaacaaaaataagtactatttctaactaaagatttaatatgaaaactgaagtgagagagtgactggttgaattggttgcacagtggttttcaatagtataatctttgtaagtctcaggttgttattagctttttttttttttcccctaatagaaatgaggctgggtgtggtggctcatgcctataatcccagcactttgggaggccaagttgggcggatcacttgaaggcaggagtttgagaccagtttggccaacatggcaaaaccctatctctcctaaaacaaaaattagccgggcgtggtggtgtgtgcctgtaatcccagttacttgcgaggctgaggcaggagaattgcttgagcccgggaggtggaggttgcagtgagccgagattgcgccgttgcacttcagcctgggcaacagagcgagactctacctcaaagaaaaaaaaaaaaaagaactgattttagtagttaagtgaataaagtgattttactgattatatttttactctgtgccatgggttatttctctttttgtttgtttggttttttttttgttttgtttttattgatcattcttgggtgtttctcgcagagggggatttggcagggtcacaggacaatagtggagggaaggtcagcggataaacaagtgaacaaaggtctctggttttcctaggcagaggaccctgtggccctccgcagtgtctgtgtcactgggtacttgagattaaggagtggtgatgactcttatcgagcatgctgccctcaagcatctgttcaacaaagcacatcttgcaccgcccttaatccatttaaccctgagtggacacagcacatgtttcagagagcacagggttgggggtaaggtcacagatctacaggatcccaaggcagaagaatttttcttagtacagaacaaaatgaaaagtctcccatgtctacttctttctacacagacacggcaaccatccgatttctcaatcttttccccacctttcccccctttccattccacaaaaccgccattgtcatcatggcccgttctcaatgagctgttgggtacacctcccagatggggtggtggccgggaagaggggctcctcacttcccagtaggggcggccgggcagaggcgcccctcacctcccggacggaggcgcccctcacctctgcactctgggcactttgggaggccaaggcaggcggctgggaggtggaggttgtagcgagctgagatcacaccactgcactccagcctgggcaccattgagcactgagtgaaccagactccgtctgcaatcctggcacctcgggaggccaaggctggcggatcactcgcggttaggagctggagaccagcccagccaacacagtgaatccccgtctcctccaaaaaaatacgaaaaccagtgaggcgtggcggcgcacgcctgcaatcgcaggcactcggcaggctgaggcaggagaatcaggccagggaggttgcagtgagccgagatggcagcagtacagtccagcttcggctcggcatcagagggagaccatggaaagagagggagagggagaccatggggagaagagagggagagggagagggagagggcttgtttgtttttttgagacagagtctctgttgtccaggttggagtgcagtggcacgatctcggctcactgcaagctccgcctactgggttcatgccattctcctgcctcagcctcattttcttttttttactgttgttgttgttttgtttttgttttcttgagagaagtctcactcttgtcccccaggctggagtgtaatggtgcaatctcggctcactgtgacctctgtctcctgggtttaaacaattctcctgcctcagcttcccaagtagctgggattacaggtgcctgccaccacacctggctaagttttgtatttttagtagagacagggtttccccatgttgaccaggctggtctcgaactcctgacctcaggtgatccacccgcctcggccttctgaagtgctaggattacaggcatgagcgtgcctggcttttttttttttttgaaagggagtctcgctctgtctcccaggctggagtgcagtggcgcaacctcggctcactgctacctccgcctcccagattcaagagattctcctgcttcagcctcccgagtagcttggactataggcgcgtgccaccatgctcggctaattttttgtatttttggtagagatgggatttctctgtgttagccaggatggtctcgatctcctgacgtcaggatccgcctgcttcggcctcccaaagtgctggcattacaggagtgagccaccatgcccagcctggccttctttttctttttttgagatggagtttcgctcttgtctcccaggctggagtgcagtggtgcgatatcggctcactgcaacctccgcttcccgggttcaggcaattctcctgcctcagcctcccaagtagctggaattgtaggctcccgccaccacacccagctaattttttgtatttttagtagagatggggtttcactatgttggccaagctggtctcaaactcctgacttcatgatcttcccgccttggcctcccaaagtgctgagatgacaggcgtgagccactgcgcctggcctccactggttattttcaagtttgatagaagttgaggatttaaatatttactaaagggctcagggtaactatatttgttatgtaaaatttaagttaacttttgattattatgtgtaatttgaattagctcctgtaatgctgggttcagaaagtctcattttatatctttggttttttgttttttgtttttttggttttttttgagacagagtttcactcttgttgcccaggctggagtgcaatggcgcaatcttggctcactgcaacctccacctcctgggttcaagggattatcctgtctcagcttcccaggtagctgagattacaggtgcccaccaccacacctggctaattttttgtatttttcatgaagttggggttttaccattttggctggctggtcttgaactcctgacctcaggtgatccacccaccttggcctcctgaagtgctgggattacagacctgagccacagcacccggccttggtggtggtcttattgaaggggaaacgctttttgaaatcaataggatgaaggttttttaaaaacaatgaagtcttaaatcattagattttaaagtggggtctggaggtggaagacagcttatttctgctgtgtaacatttagtacttaaccatacataattatcaatgcaagttttttgtcctaggtgcaagattatatttatttgagagtatcaggtgaacaagtttacatttaaaggcgagaattgtgttaagcatttggtattgacattatagttttagtaaaaccatcaagttatctcgatagagtttgaaactaagctctttggtggactgctactgtttattaagtaggtatcacatttctatagcaagacatagttgagttttgtaaatctacttgtattttgaaggattgaattgtgaaaattatttgtcttttggcaatctttctgaatagagagcgtgcatgagcaagtttgcattgcaattaataggtgaaaattgctgagcacctaagtaaccaaaaaggaggtgatgaattaggttacagaattagttttgtccaccctttacctgtctactccattatttgatttttggcagcattcagcatgctttttctgtaaaggaccagtaaatagtaattattttaggctttgtggccaggatgcaaaattgaagatattatgtaggtacttaatattaaaagaaagaaaaaatttacagttttttaaaatttcagtccaaaatgtcaatctgtaaattttttgttgataaaaatacaacaatataagatacaacattttgtaatacaggcctactaatgagaaatgagaattttatttttgtgagggtaggggagataacacttagctgaattggggttcagagttagtgttttctataatcaaatcaattgctaatgtttatctgtaaaaaccattcttaccttccaggctgtacaaaaacaggcgataggccagatttgaccatggtccatactttccccacccttgatttattctataaaactagtagaattcgactaactgttttgtttcatcaaagcttttttttttttttttttttgagacagagtcttgctctgtcgtctaggctggagtgccgtggtgcaatttcggctcactgcaatcttcgcctcccaagttcaagcaattctgcctcagcctcctgagtagctgggattacaggcgtgtggcactacgcccagctaatttttgtatttttagtagagacagggtttcaccatgttggtcaggctggtctcaaactcctgacctcatgatccgcctgccttggcctcccaaagtgctgggattacagtcgtgagccaccgtccctggccatcaaagcatttttaatatagaaggtcagttgagttgctgcctaggatgcaacctgatcttaatttacaaagtaattaaattattataaaataagtttgcattcatagattaaaaagtacacatttattttattattattataattttttgagatggagtttcgctcttgttgcccaggctggagtgcaatggtgcaatcttggctcactgccacttccacctcctgggttcaagtgattctcctgcctcagcctcccgagtaactgggattagaggcatgcgccaccatgcctggctaattttgtatttttaggagagatggagtttctccatgttggtcaggctggtctcgaactcccgacctcaggtgatctgcccacctcagaatcccaaagtgctaggattacaggtgtgaaccaccacgtcctgctaaaaagtacacatttaaaatctaagttccattttcccgtcatgtttattaatttgtcccattgcaagatatgtttctgttgtctgcatgggtagagataattttaaaagcttggttaagtaaaaactgattttcttaattattgccctttaggttaaaaaaaaaaaaagtctttggggaatttttaagccatctgccagccaagaaacaaatttaagtcccacctagtttagttcctacagaaatgggtaggaataggctaggcatggtgtttcagacctgtaatttcagcattttgggagactgagttgggaggattgcttgtgtaacatttagtacttaaccatatgtaattatgaatgcaagttttttgtcctaggtgcaagattatatttatttgagcgtatcaagtgaacaagtttacatttaaaggcaaaagttacaggtcagcactggcaacatagcgagaccctatatctacaaaaaattaaaaaaattagctgggcgtcgtggctcatgactgtagtcccaaatactcaggaggctgaggcaggaggatcacctgagcccagaagttcgaagattgctatgaatgtgccagtgcactctagcctgggcagtagagggagacgatgtctcaaaaaaaaaaaaaaaaaaaagtatgggaatcatttaatcatcttgttagatgcctgatcttattacttattaggactaattattaagaaattaaagcacaactcatttgctgttgtcttcagcgtagttggtgactttggaaggtggcagatttagcccagtgattgtcgtcttttctcaaaatgttttcagaactccttttttactattacaacaacataatatccattgttggaataagcatatcattccctttaaagtcatactctcagtcgtgatattaattctggtatatttattaaagtcagctcgtgctttactctttttagaagtattcaacttccataggctaacattgccccaacaaagtaaaaatataggtcacgagaagggcatcttttactgaatccattttgctagatttcgtgtgagctgtttctgaagtctcccaagaaaattttctgaaatttcttgaatttttaaatatgctccttttcgatgaccttttgatagttatatccttctttaaatctgacctacagtaacattacctttctaaagaacagaaatccttggtgttgggggaggagcggcttttatatagttgcttatgaggtttgttttgtttttttcctaaggaaggctgggttgcttttgtgattttatctgtttcaaatggttaatattcagttccattcacttctcctgtatacagcttcataaaggtagatgagatgaaccttagaacatacaatctttttctgcagacagaatttcttaatcattacataaacgttattctgaaaagttttcagtaatttcatggccctccccaatagtaactttcagtatttatactgaatagctctttgcaactagcctaaaagagtcctttatttttgttcttttttctctcttatctgtggagattgaaaatatatagccatccttcagaaagcacttcttactatactcttggatgaaactttaatattgaagttttcagtaactctaaagttagagctttttttcccttaagagcttcgctatggaggctcttctcattcacttgaaatatagattgcatcaattctgctctaatatcagtagtttactataatatatttacattaacatttctctactgataatttttacagtagttgaatacaataaatagctcttttttggccaggcatggtggctcacacctttaatcctagcactttgggagacaggggtggatagatcacctgaggtcaggagttcaagaccagcctgaccaacatggtgaaaccctgtctctactaaaaatgcaaaaattagctgggcatggtggtgcacacctgtaatcccagctactcgggaggctgaggcaggagaattgtctgaacccgggaggtggaggttgcagtgagccgagatcacgtcattgtactccagcctgggcaacaagagtgacactcccatctcaaaaacaaaacaaaacaaacaaaaaaaacaaacaaaaaactctttttgacgaatgagattattcgtaatttttggtgtctgcattcaagcattataaagtaacaaattgatgtggaatacatttggcttttcaagtcctaaagaggaagggactatatgagtataaagagaaacattttttctaattaaattatatatgggtatagatttttagactctatctctagaacatgtcatagaccaccttaagaactaagatgaagcttgttttacaatccattcattctttaattgctttgagaagttatacttaactttcaattttttgggaaatagattttttctcttaaacttgtcgagttaaaaggtaatagttttgcgatttgatggatcattccctaacttcaaaattttttcatgatgtcaacaaccatctctttaatatgacatatcattgagctttaggctttgctgataatctttgaggataccttatgaacttcaaatatattttatagaatatttctttttttatgtgatggtgctagtacatatttgttgtgttgcttagtagacgtattaagtgtttcagaatacacataatttatatttgtttggcttaattcaacagatacttgaatacctaccaagtagaaggcactatgccagcactgcatagctttccttgaagaagagcaattactgcccttcaggagtgtataatctagtaggagaaataaaatatttacatgagttttacatgtaggaaactgaatgaaaagtaagtgtcaaaataaatataaaccaagtaccatgggtaaggagaaatcactggtttgggaataattgggtaaaaggtttaatgaaaacaagttagcgttttagatggggcttgaaggcttgtgtgctgtattatacaccgtctccatagtattcattgttatggctaatcatccatagtttatcttactaaaaataatcaaaatctgatttccatcttgcctattagagtgacaataaagtataatttgtttcttttatccagttgagaagtgattattttgtttatctgtttcttccaggaaaacatttaaagttgatgatatgttatcaaaagtagagaaaatgaaaggagagcaagaatctcataggtaagataacctatcagtttacattaagtgatatactttaggaaagaggaaaaattacagtgatcattttcctagtgatcaccttgatataaggagttagaaggaatcttagaggtcagtttggtccaaactcacacacaagtcagaaattaatttctgtagcattcctggcagagaatacttaagctgtggcttgaatacctccagtgtagttgtatttattattctttatctttattaccagtttcttccattttgagtgaaacctctgacttctgccgttggtcttaactctaccacctcatttaaagagggatactcacatttatagtatatgtgctaggtactgtggcagggacttcacaatatcacgtatcttgtaagttattctcaaatatgagaggggttctctttttttccatctttttcttctcatttaaatctgtcaggcaacatattcataacttttatttcatatttgaaatatgtttctcacatagtttcagaaacttgaacatttggacagaatctacttattgtacattagcaaatatatacctagaacgaatccctaaatgttctgactagtctgatatctgtctactctagatagtatgcttctatttattttttgatatgtaaactttattttttgatatttttgatagaaaattgaatattctaaggagaaacagcagcttgggtggtgtttgttcattcattaactacctttagagagaatgcagaactaaaaatattagattcttaaaaaaatagagttggaaaatttgtcacagtgcatttttcttttccttctagttttaaatcacagcttacgaatttagataggatacacacttaatgatgcatcatttatgcatctcattgttttcccattgttctgttaactggtaaaagacttcctttttttcagtttggcttccttctactttaagtttggctttggaattaagtgatttttttacttggattgtaaaatgatattttttattttatatcctgcaatcttgtggggttgaagtataatttatatttccatgtctaggcagtcctgacttgtaaataaactgtgatagtccattctagaagctgagatcctgaattgttacctggtacatctgttaatgcccagggaggaccctataagatagaactgagaatattcgcagtgcacacacatttttctttactagaatttgtattccagattcttgtctggtctcccaccctagacagagctcttgggatcctcagggccttttttacttaaaatacagactgtagtaagatcctggtctgacctccctgcttcttttctcctgaccacattaaaagtttgccctatagtcatttcagggttcaagtgagaaggaagcatgaaccaacaacaagaacactggacccttctcttcatcttcctcatcaaggtttaccttcactactaaaccctattactatctcattgtgacattgggtttgaaattacagagcttccctaagtaagagtgtgtgggagatacatactgttcaattctctctgaacaattgtttccccagtaattttgttccttttgacccagtggttcaatagcaactcaaagattaaaatcagagggttacataaattcctgctggtagttttggaagagaattttttgagtctttagggtctagctaggaccagtgagttggccatttaagcctctcaagattcttatgaatgtctcagtattgctcccagaagcactaagatgaattaagaaagtgtgtcattttaagtttactgctaagaccctacattattaactttctttaatctatttcttttttttttgagatggagtcatgcagtggtgctatctcagctcactgcaactgccacctcctggattcaagcaattatcctgcctcagcctcccaattacctaggattacaggcgcctgccatcacacccagccttttttttttttttttttttttttggcgaccgagtctccctcttgctgaggctggagtgcagtggtgcgatcttggctctatagcctccacctcccgggctcaagcgattcacctgtctcagcctcctgaagagctgggaatacagacgtgcaccaccacacccagctaattttgagtttttagtagaaacagagtttcaccatgttggccaggctggtcttgaacttctgacctcaagtgatccgcctgccttggcctcccgaagtgctgggattacaggtgtgagccaccaagcctggccaatttttgtatttatttatttacttatttattttgaaacggaggtttgctcttgttgtgcaggctggagtgcaatggcgtgatctctgctcactgcaacctctgcctcccgcattctcctgcctcagcctcccaagtagcagggattacaggtgcccgccatcacacccagctaattttttcttgaactcctgacctcaggtaatctgcccacctcagcctcccaaagtgctggaattacaggcgtgagccactgcgcccagcctcctttaatctatttcttatttcaaattaaggtaatcttatttttctcctaaacctatcacacagggttgtaagaaggaccctaaacaccagtatgtgatgccagcagtataaatatttgcttctaaaatctattgttaaattcttaaaagataacacaggccgggcatagtggctcacacctataatcccagcattttggtggctgaggtgggtggatcacttgaggctaggaatttgagactgccctggccaacaggggaaaaccctttctctacaaaaaacacaaaaatcagccaggcgaggtggtgtacacctgtaattccagctacttgggtgactgaggcaggagaatcccttgaacccgggaggcagaggttgcaatgagctaagattgtgctgctgcactccagcctgggcaagatgtgactctgtctcaaaaaaagaaaaaagatgataaatctttgttgttccataacattagttagtagaagttaatatcttaaatcatacacaaaagtatctctcctccatttatattcttttttttttttttcttttttgagatggagtctcgctctgtcacccaggctggagtgcagtgacgtgatctcggctcactgcaggctctgccccctggggttcacgccattctcctgcctcagcctcctgagtagctgggactacaggcgcccgccacctcgcccggctaattttttgtatttttaatagagacggggtttcaccgtgttagccaggatggtctcgatctcctgaccttgtgatccgcccatctcggccttccaaagtgctgggattacaggcgtgagccaccgcgcctggcatatattctttgtactatttcagtttaactgggtcctggatctgtacaggtctagtctgggagtcttccactagaattcatgttcttttagcactgccaaagttatagtatgtctgctcctgagcccaatatatttcattcctcaaagttcaaggggtatcaagataaaaataccatagtagtatggcccaaaagttagttcagtcaaataaatgcctgagtttattatgacgtttgtagtaatttataaactaaaccaagatatgagcattaatctgttcaaaagaagttggtgtttcagggtcttttatattttagacctacagttgtcttaagtcatttgcagaaacttgttggtggaaggagctgatagaaaaacatgggctattaaatggttattagttcttttttttcttttttgagatggagtctcgctctgtcacccaggctggagtgcagtggtgccatctcagctcactgcaagctccgcctcccgggttcatgccattctgcctcagccttctgagtagctgggacaggtgcgtgccaccacgcctggctaattttttgtatttttagtagagacggggtttcaccatgttagccaggatggtctcgatctcctgacctcgtgatccacccgccttggcctcccaaagtgctgggattacaggtgtgagccaccgcgcccagcctttttttttttttttttttgagacagagtctcacattgtcgcccaggctggagtgtagtggtgcgatcttggctcactgcaacctccatcccccaggttcaagagattgtcctgccgcagcctccctagtagctgggattatatgcatgccctaccacgtccaactaatttttatatttttagtagagacagggtttcaccatgttggccaggctggtgtcaaactcctgacctcaagtgatccttccaccttggcctctcaaagtgttgcaattacaggcatgagccactgcgcccagccttctttttctaagagacagggtcttgctctgttgcccaggctggagcgcaagtggctgctcactacagcctctaactcctggcctcaaaccatcctcccatcttagcctcctgaatagctaggactacaagtgcatgccaccatgcctggctaatttttaaattttcgtagaggcagcatcttgctatgttgcccaggctggtctcaaactcctggcctcaagtgatcctttcagattggcttcccaaagttccgggattacaggtgtaagccaccacgcctggcctttattttctttacagaaggtctgatataatgccttacatcctttccagctcttgtttctggtactccagttttgaatttttcttggattttgaccaggcactatggctgattagaataaatctcttgcctttgtgtagttgtatatgctagcgattcttatgctgtcctaccaattttggaattatcttttttttattgctgtttttttgagatggaatgtagctttgtcgctcaggctggagtgcagtagcgcgatctcggcttactgcaacctcctcttcccgggttcaagcagttctcatgcctcagcctcctgagtagctgggattacaggcatctgccaccacgcccagctactttctgtatttttaatagagacagggttttaccatgttggtcaggctggtcttgaactcctgacctcaagtgatccaccttccgtggcctcccaaagtgctgggattacaggcatgtgccactgtgcctgtccccaatgttggaattctctggtaacaactcttgagtgctgagtgcatctccatggactaaaatgcatcatgaaaagatttttaaagctgagttgcttccgagtgtttaccagggctaaacgaagcaaaatgtcacttctctcttgtccttattcctcttctattcctggtcttctgttagtagctggagaaaaatcccctcaaaggatacctgaattagaacttttattagggttattttcaagcatgtatttttattttttgagacaaagtcttgctctgtcacccaggcaggaatatagtggcatgatcttggctcactgcaacctccgcctcccaggttcaaacagttcttgagcctcagcctccccagtagctgggattacaggcacctgccaccacacccggctaatttttggttttttttttccggtagagacagggtttcacctattggccaggctggtctgaaactcctgacctcaggtgatccacccgcctcgacctcccaaattgctgggattacaggtgtgagccaccatgcctggccttatttttattttttgagacaaggtctcgctttgtcaccgaggctggagtgtagtggcataatgataggtcactgatggattgaactcgtggactaaagggatcctcctgcctcagcctcctgagtagctgggactacaggcatgtactgtcacaccacactaattttttgaatttttgtagagtcagggtctcaccatgttgcccaggccagttttgaactcctatcctcaagtgatcctcctacctcgacatcttgaagtgctgagattacaggaatgagcccccatgcccagcctgaatttttatttatttatttatttatttatttatttatttatttgagactgagtctcgccctgtcgccaggctggagtgcagtggcgcgaactcggctcactgcaacctctaactccttggttcaagcaattctcctgcctcagcctccggagtagctggggattataggcacgtggtaccacgcccagctaatctttgtatttttagtagagaaggggtttcaccatgttggccaggatggtctcggtctcctgaccttgtgatccacctgcctcagcctcccaaagtgctgggattacaggtgtgagccaccgtgcccggctcatttttatttttagtaggttgataagtcaatgtgccttttttgactatttatttatttatttatttatttttgagacggggtcttgctttattgcccaggcaagaatgcagtggtgccatctcggctcactgcaacctccgcctccagggttcaagctgttctcctgcctcagcctcctgagtagttgggattacaggcacacaccaccacgcctggttaatttttgtatttttagtagagtcagggtttcaccatgttggtcaggctggtctcgaactcctgacctcgtgtcctgcccatctcggcctcccaaagtgctgggattacaggcgtgacccaccgtgcccagccgactttttgtttttgatgcaacctaagcttttgaattagtaaccttccttttctaaacctccccgtttttaagcatttatttttacaataagaaggcctgcatctatattcttggttgcacgtttcatttccgtagtgtgcaatgtcctaagcactatactaagccctcgggtatataagggtgaacaaaatggatgaaggccctgcctttatggagcttagtgtttaggggagaaagacataatcatttaataaatatgaaataagtgctgggaaggaaaagcataagaaaactgtgagtgtataaaacaggagaaccagctttcatttgaggtgttagatttgggaataatgatgatcaggaaaggcatctctgaagaaataagctgagatttgaaagaagtgtacagaagtaaaatggggtgggaggatgaacaaataggtggttctagttaaagggaatattacatatacagcatttgatgccagagtagctgtgtagaaagagcaagtctccttgagagtggtatgagaagaagctggagcagatggccagggccagacagtgcattgtcttcaaggtaatttaaggatgttggtcttaagaaagtcgttcgttcttttttttttgttctctaagacgtggggtcttgttctgtcacccacacgggagtgcattgatacgttcatagcttactgcatcctcgaacttccaggctccgttgtcttactttattttttattttactttttagagatgaggatttgccctgtcgctgaggcggcagtacagtggtgtgatcatggctcaactacagccatgagctcctgggctcaagtaaccctcctgccttagcctcctgagtagctgggactacaggcacatgctaccatgtcccacttattttattttattaaaaaaagtttttttaggagacagggtctcacttcatcacccaggctggattgcaattgtgcgatcatgactcactttacccttgacctcctggcctcaaatgatcctcctgcctcagcctaccgaatagcctaggaccacaggcgcaagataccatgcctggatgattttgtaaaattttgtagccgggcacggtgactcatgcctgtagtcccagcactttggaggccgaggtgggcggatcacgaggtcaggagattgagaacagcctgaccaacatggtaaaaaccccatctctactaaaaatacgaaaattagctgggcagagtgtcgtgcacctgtaatcccagctattcaggaggctgaggcaggagaatcgcttaaacctgggagatggaggttgcagggaggagagatcgcgccattgcactccagcgtgggcaacagagcgagactacatctcagaaaaactttagtagagatccattatcttgtcatgttgcccaagatggtctcaaacttctggcctcaaacagtcctcctgtctcagcctctccaagcattgagattacaagtgtgaaccattaacacccagcctgttgttttaaaagttgtatattattattattattatttttttttttttgagacggagtctcgctctgtcacccaggctggagtgcagtggtgcgatctcggcccactgcaagctctgccttcccaggttcaccccattcttctgcctcagcctcctgagtagctaggactataggcgcctgccaccacgcccggataattttttgtattttttagtagagatggggtttcaccgtgttagccaggatgttctcaatctcctgaccccgtgatctgtccgccttggcctcccaaagtgctgggattacaggcgtgagccaccgcgcccagccaatattactgtttttttgagagggagtctcactctgttgccagcagtctcgactcactgcatcctctgcctcctgggttccagcaattttcctgcctcagcctctggagtagctgggactacaggcatggccaccatgcctggctaatgttttgtattttagtagagatggggtttcaccatgttggccaggatggtcttgatctgacctcgtgatcggcccacctcaacctcccaaactgctgggattacaggcataagccgccgcacccagtcagtttttaaatatatatagttattgtttctgcattgttctgtttcttctaacatcagaccagtagtacatatgatggttaggattgtaatctgagttccaggagcaggatgctgctctttggtcacttcagaacctcgagatatcaccgaaaaccctccctacccacctctgctattattgcacttctcgactagtattgtggtatgtaaaaaagtcattaaattcttaaattatttttttctctctatatatacgtgtgtgtgtatatatatgtgtgtatatatatgtatatatatattttttgtttttttgagacagtctcattctgtggctcagcaatgtcaccatctaggatcactgcaacctctgcctcccaggttcaggagattctcatgccttagcctcccaggtagctgggattataggtgtgtgccaccatgcccagctaatgtttgtatttttagtagagactagttttcactgtgttagccaatctggtcttgaattcctgacctcaagtgatccacccacctcgacctcccaaagtgctggattacaggcctgtgccagcgtgtccggccttattttattactattattatttttgagatagagtcttgctccattgcccgggctggagtgcagtggcacgatcatggctcactgcagtctcaacctcctgggatgaagagatcctctctcctcagcctcttgattagctgggactacctggctatgttttttgttttttttttttttctcttccagatggagtcttgctttgttgcccaggctgtagtgcagtggtgtgatctctgctcactacaacctccacctcctgagttcatgtaattctcctgtctcagcttcctgagtagctgggattacagatatgcaccaccatccccggataatttttgaatttttttttttgatacagagtgtctctcttcttgcccaggctggagtacagtggcgtgatcttggctcactgcaacttccacctcccaggttcaagcgattcttctgcctcagcctcccgagtagccgggattacaggtgcctgccaccacgcctagctaattcttttgcatttttagtagagacagggtttcaccaggtagagcaggctggtctcgaattgctgacctcaggtgatctgctcgcctcagcctcccaaagcgctgggattatagccgtgagccactgcccccagccggtttttgtatttttagcagagacggagtttcaccatgttggccaggctggtctcgaattcttgacctcaagttatccaccagcctcagcctcccaaagtgctggattacaggtgtgagccactgcacctggccctggatcaccttttgtactttttgttgttgttgttgagacggagtcttgctctgtcacccaggctggagtgcagtggcgcaatctccgctcactgcaaagttctgcctcctgggttcatgccattctcctgcctcagcctcctggagtagctgggactacaggcgcctgccatcactcccggctaatttttttgtatttttagtagagatggggtttcaccgtgttagccaggatgtctcaatctcctgacctcatgatccgcccacctcggcctcccaaagtgctgggattgcaggcgtgagccaccgcgcccagccccttttgtactttttgtagagatgaggtttcaccgtattgcctagtgtgactcgaagtactgagttcaagtgatctgcccactttgtcctcctaaagtgttaggataacaggcgtgagccactgcatccgacctattaaattatttttaagagaactattgtattaatgattttttcctacttttctattttgtacatttagctgcattttaaaatctttaggctggccaggcatggtgactcacgcctgtatcccagcactttgggaggtcgaggcaggcggttcacttgaggtgaagagttcgagagcagcttgaccaacatgggaaaaccccatctctactaaaaatgcaaaaaattaggccaggtgcggtggctcatgcctgtaatcccagcactttgggaggtcaaggcaggcggatcatgaagtcaagagattgagactatcctggccaacatggtgaaaccccgtctctagtaaaaatacaaaaattagctgggcgtggtggcacgtgcctgtatttctagctactcgggaggctgaggcaggagaattgcttaaacctgggaggcggaggttgcagtgagccgagattacaccgctgcactccagcctggctacagagtgaaactctgtctcaaaaataaataaataaataaataaaaaattagctgggcatggtggcgtgcacctgtaatttcatctactcgggaggctgaggcaggagaattgcttgaacccaggaggcggaggttgcagtgagtagataccgcaccactgcactccagcctgggtgacagagggagactccgtctcaaaataaataaataaataaaatctgtagactacatcttaggttggttgtgtgtctttcccaccattaataagatctgatgttttccctttcttttttttaatacactttgccttgactataagctttgaagttgttttcaaattgtcatcttttcagtcttgagtttttgttcttttttcagaacctggctatacatttctttttgcatacttactcttgaaggtgcctcatcagttgccatttgagcatatctgattcttaaaaatttgaatattcaagaacaaattgtaaaaatattccttgtataatttttttggttttgtagtaattcctttgttttcttcacagtacttctgcagagtgatccatttgtaattaatagacacacacacatcatccaccattcagctttatcttctcattagaaagtgcgtctaacccctatattttgagatcctggatttcagaatattggacttgatgtagacacgagtttctcagctttacatatcataggatcaaatgtatataacaaaagttgaatagctaacatgtaactatagaaaccaagtagattatcagacttgtcctgttttgaggtaatactgccatacccttaaaatgaagccttatgcctgccgctagcagattgatgtatataaattagaggcactaatcttggtctcctgttgtcataaaaactacttcctctgtgggatctggctgttcttaaaatgggaggctcttccttgaattagatttcaaagtgttagtctcttatgaattagcttagcatcattttctgtagaccgtatcagaactgtcagatgtttgtgcttggaatgctgaaatttgcgtctcaaaatttcaaattctctacctgatttcttgttatcatgtggcttacttcctgagaagatacagggagcatgtgacatagatgaactaagtctcttatatcttattctggtcatgtaaactagattttgttgtggcctaaaaccaaatagtcctgaccaaccttacatgtttcttttcctcccgttcatctggtccagcctaaccaattaagatgtggacaaagtagctgcaagagaggggagagggaagggagagaaaactttgcccttttccttggaacaaaccacctatggaagggatcattggtacactttattctaggtacatatcagagcgtttactttttttttttttgagacggggtctcgctctgttgcccaggttggagtgcagtgacgcaatctcggctcactgcaacctctgcctcccaggtttaagcgattctcctgcctcagcctcctgagtagctgggattacaggtgcctgccaccacggccagctaatttttgtgtttttagtagagatgaggtttcaccacgttggtcaggctggtctcgaactcctgaccttgtgatctgcccgcctcggcctcccaaagtgctgggattacaggcgtgagccactgcgcccagccagagtgtttacttttaggtgaggaaggggaaatcatgcatagcaagtcacattcccaatgtcacctttatttattatttatttatttatttttgagacttgctctgtcacctaggctggagtgcagtggtgtgatcttggctcactgcaatgtctgcctcccaggttcaagctattcttctgcttcagcctcctgagtaactgggattacacgcaggtgtcaccacgcccggctaattttttgtatttttagtagagacaaggtttcaccatgttggccaggctggtctccaactcctgacctcaagtgattccccctgcctccttcccaaagtgctgggattataggtgtgaatcaccgtgcctggccccaatgttgccttttaaaattggttaattgaaatttagaattctttctcaaagtccgggcatggtggctcagacctgtaatcctagcatgttgggaggctgaggcaggtggattgcctgagctcaggagtttgagaccagcctgggcaatacgacgaaacctctctctactaaaaaatacaaaaaattaactgggcatggcagcatgtgcctgactcccagctattcaggaggctgaggcaggagaatggcttgaaccctgggaggcagaagttacagtgagccaagatcacaccattgaactccagcttgggtgacagagcgagactccgtctcaaaaaaaaaaattctttctcacaaagaaacactagtataataatggctggttggctgggcccattactcatacctgtaatctcagcactgggaggccagggcgggtggatcacctgaggtcaggagttctagaccagcctggtcaatgtggtgaaacctcatctttactaaaaataggaaaattaacctggcatggtggcgggcacctgtaatccctgctactcagagactgaggcaggagaatcacttgaacccaggtgggaggttgcagtgagctgagatcgtgccactgcactccagcctgggctacagtgagactccgtctcaaagaaaaacaaaacaaaacaaagctggttatacaggctatcctatgtaaggtataatgtaccatttaaaactgtctgaaatcacctgtggtgaaagatcattttgtttatttgttaattttcagtgtgttgttagtagtattctcaagttcttgagttgttgtagaatggtaacatttttcctaatgacctcagtttgtagacaacattttaagtaatactgatttaaaatattctctggggtaaataaatgtaagatctttctggcatttcagagttggagcttaccctcacacttctcagaaaaataatgtaaataatactaatagtactgcagtgtaatgggccatcattcctgacctttaaatttgtattactctaggaggacgttatcttatgaaaaaaatttgttgggtcattttctgtaagacactgctaggtgctagggacactaataaaaagatgtatatggaaaaatagtgactaaacagtggtaaataagagtgcttgtaaagggataaagtggtcatttagctcttgattgattgggtttagggtctttgtagaagagggagagagtattttgctggatactttattactttctgcaagcctgactgcgcaatggcgcagtctcggctcactgtaacctctgcctcctaggttcaagcgattctcctgcctcagcctcctgagtagctgagactacagccatgtgccaccatacccagctaatttttgtatttttagtagagtcggggtttcaccatattggccaggctggtctcgaactcctgacctggtgatcccctgcctcggcctcccaaagtgccaggattacagacgtgaggcactgcgcccggcccacactgtagtttttttagcagacagtttcatggcctacttcactaagtagatggagatatccccccatcttccatggaaatgactttcttacttgcctcttatttctctatcttagaaaaagaggaatccagtcgggctcggtggctcacacctataatcccagctacttgggaggctgagacaggagaatcgcttgaactcgggaggtggaggttgcagtgagccaagattgcgccattacactccaacctgggcgagaagagcgaaacctcatctc
